United States Patent 8,781,750 (CELL-TYPE-SPECIFIC PATTERNS OF GENE EXPRESSION) - sequence listing, part 51

SEQ ID NO: 38232 - DNA, 116636 bp, Homo sapiens
cgcgagagggactttgtgttccgctgaccctcctcggggcgcttcctcccgtgccgcccttcccctcccccgccgcgtccttgcgaggcgcctcccattcggtgggaccgacccggggggatggagggggcacgcttctacaaccctcctgggaccccgaagagacgcccgcgtgcgacctgagacgccgccctcgccgagggcccatgggcgcgtccccacaggcgggcagtggacgtgagggcggcgagcggcggggccgcggcgtccaggagggccgcgctcgggctcggccccgcgcaggccgcgcgcgcgcgctcccgccgccgcccgggccgcgcccgccccgcctctaggcgccggccccggagcccggtccgcgagcagcggcggctgccggagggacgatgagctgcgcggggcgggcgggccctgcccggctcgccgcgctcgccctgctgacctgcagcctgtggccggcacgggcagacaacgcgagccaggagtactacacggcgctcatcaacgtgacggtgcaggagcccggccgcggcgccccgctcacgtttcgcatcgaccgcgggcgctacgggcttgactcccccaaggccgaggtccgcggccaggtgctggcgccgctgcccctccacggaggtgagtgccggcccgggggcggcgggcggtggtcgctgcatcccgcgtaggcggcgggactagggttcccggccccggctctggccctggctctcccgcgctgcccggccgacagccccagccagggtcgaggcttccgtcgtggacagcccggcctgctcccgtgggaaccaggctccaggagcgtgactgggtttttcccttcttttaaaaaagacttggaacggtcatctttgcgttcaggcagctcgtttgctggagggcattgagctaggagtttgcagggacagcgtagacaaaggaggtggtgcaagagcgcaaaactacttcatggggaggacgtctcagcctgtattttggaagcggcaggttcctcaaatcacggacttaaggctgcgctagatctggaaggatgcggcccttttctaatataaaaacgtgccgtttttcttaagtggtaaattggggggggggtgtaaatggaaaatggacatcttccctgttgcttttggctcttgttcttgccctagtagttttactgtaatttgacgcctgaaaatgtcacattatgaggatctgacactaatcggaactactagccaaggcttttcaggtcacgggtgccgaccaaaagggaaataggtaaaattttcaagaattgtctttgaaaccattcggcttaatgtcatgttttcctatgaacaaggactttgtttagttgattatttggtgtaaacatgtatttgtttaaattattagtcatggtttgaaagaaaccttttgcacatcgtggaatatgattttttgggttttggcccacgctgaacttttgggagatatctgccattatccccaccctcattgtcaccctgagaatgctgagaggggatttttcttttctaaactgctgttcatgttaggatgacctaaagtaggcaacctaaataaagtcatgatttgcttgtacactcttaagatactaacatattatgcccctctgaggtctgtatttgtatgccaaagtgctaagctgttttcttctttgagacagtctggctggggaaaaataatcacataaggcttttactgtagcctgtccgcaactcagactaggctttgaaaagtccgttttacaccagtaatcaggtgcttaaggtgcatatctcatctctactgtgttaaaaatggcagttagggtcccagcttggccgtagaaacaacttttgtcttgggttcattcagtaaatatttgcgttcctgctctgtgccagtcactgtggttgagatgcacagtgttgccagactggcaactaacaatggtagcctcttttctggtggagagaaccgtgagggtcacgtggaagggtagaaagaggaaggggaggcaagctgttgtggagcaagagctggtcctctgcagtgttgtgaaatctgtggtttgtctttgaggcttggttccatcaggcaccccaaatccatggtctgaacttcagatccttcctccacggtgttcgtgtgcttcagctacttgttgcttgcctgtcaccccaaacaaaagccccgtctttgagaaagcttgttttaggtgtttctgtagaagggtattggaaactaactcatgtgtattgaggtatggatgaagattagtcctgttcccctctcagtggggaggcagcattgtaggattaaaggttctgagtcaggcctgtgctttacgtccattgtgtgacactgtaaaagtaactctgccatttagcctgtttgctcatctgtaaaatggaatgatgaaatgtacatctcttaaggttgttgacaggtttaaacggttccttaattctgaaaagaggagatttgttaacctagaggaatctctcagttggtgagatttcagacactgcaacaaaatgaacacatttgggcagtgtgtgaagactgggtgtgaagtcagtccccttgagttttagcctccctttccttgattccctaggggtcattctgtgtccgtcccacaggggcttgctccaggttttctcggggtgggggtgagggtgggggatcctacaggtggtttaagtctggctttgtaccaagggtcttcacacatacgcagtttttcagtccagcaaatattaattgaaatcctgtgtgcccagtctcagtcaaggcattggtgaaggagaggcaacagcagtgaacaaaacagatttaaaaaaatccgtctctatgaagcatagcttctgctgggatctttgtaagttagcctacctgtcagtagtttctaaacctatgggtttatatgaaatctaaatcttctgctgttgcagtaggaacttaggaatttattttagaaacagaaatggtgatataaatctgttaaaattattcgtgttaagaaaatgatttaaaattggaatacttgggtattttacattataatcttgatttaatgagtttaacaattttttagttttagaaaaaatagtgcatctttatgaccttgatgctcttataattttgaattgaggagaattcttgacatgtttattgaggacttactgcacgttgacactaagcaaagtaatgctcagattacacacaaagttatcagacaggtcctggtggaaaaacagctgtggccaatacgtgaaattcatgaaaatttgttttgagggtgtttgatagaaatgaacataaagacaaaagaactttatagttttcctagagttgaacctgatggctcattttgaagctgtggattgatttatgaaactagaaaccttcctgttcgctttgcagtgctactatcagtttggcacgtgtgaatttctgaataacatttatttgtcctatccctttaaagagcaaatagtcaatttttttcttaggcactttggtattttaaaagtatattttggcaagtgctatactttacgtagtatactttatgagatatcttataaacaagtgtactttaaaaatatgtctttgtcattaagtcgaatgcattggtgggtgtagaatcatttgcctggggctaacacattttatattttaactggtaaagaattcgtgtttagaaacggagttttgaaggaacatgtcttgtatttatgcacagatcacggttgctttcttattacttactcaaatggtgagcttagaactaggagcaaaatatttagtacctttgcggagcagcctagctagggtctgctgtggagcagacattgtaaatgtgctttatgtgtgtgcacactaactttttgtttggccccagagtgggggttgggagaggagaaagccctgtgttgatgatgtgattatgtatgcagatgtgctggtggggaagagtttagtatcggccacttcttgctttgcatagaaattttcaggattggatgttacagccttagagaataattttaccaaataataaatcttgttttgctaacttgcttagggatacaataaaactcaaaaaagtgaatcttaggttttcatgtttaaaaatgtaatcctattagacgaagcctttaatggttcctttaatgaatctgaaatcggtttttagaaattctcatgaacagtggaggagattgatgcgaaaacaggatttgggtgaaaggggtcatgtaatgtttgaattcataacagcaaaggcaggggctattggacacagatttcaaaatattcagagaaaaaggatatatgatcatgggagcagggtctctgaacattcagaaagagctggaggctctaaaaatcaaattttaacataaataggctggcaagagaaaaggggatgtatataataaattatatttatgttgaactttacagcttatgacatgtttttacataccgtgtttttccttcacatttgaatgatgatttccattagcctataaatatttgaatttttttaaaaaccacttgatctctccaccaaatccctgtcctgctaccaccccatttctctcttacagcgaacctctaaacgttatctacatttactgcctctgatttttcctcctgctgctcttctctttgtgaaggtcttctattgccgtgccagtgattttgatgaagacgtggcatatgtaacatatatttgatagcagggtcagaattgcaaagatcttaatgtgtacaatgatgggctatatagctttaaaaaaattaataggaatgaagacatagatttgggttaaaaaaaaatcaccttcatggaggggagcagaagggagctaaggcttagctacctgtcagatgacaaagcttgtgagctctcactgacctcaccccaccttgccctgtctaatcttgcgctgcatttgggcctcaagactagataacttctgagatccctcccgccttgaataaggtgtgactgtaaattggtaagacatgtcttttattttattttaaggacagggtcttgctctgttgcccgggctggaatgcagtggtgtggtcatagctcactgtagccttgacctcggggagttgagtgattgatcctcctgcctcagtctccccagtagctgagactgcaggtgcatgccattatacctggctaatttttttatttttatttttatttttattgtattttattttttagagacagagtttcgctcttgttgcccaggcggagtgcaatggcgcgatctcggctcaccgcaacctccacctcccgggttccgccttcctgcctcagcctccctagtagctgggattacaggcatgtgccaccaagcacggctaattttttgtatttttagtagagatggggtttctccatgttcatcaggctcgtctcgaactcccaacctcaggtgatctgcccgatacctggctaattttatagattttttatagagacagggtctcgctgtattgcccaggctaagacaaatctttttaaacaaacttgctagactatacccatgagggacagtgttgttcttgtccctcatgttggggagtatattagtcatattgggaaggtatattagtctgttttcatgctgctgataaagacatacctgagactgggaagaaaaagaggcttaattggatatacagtttcacatggctgaggaggcctcagaatcatggtgggtggcagaaggtacttcttacatggcggcagcaagagaaaattaggaagatgcaaaagtggaaacccctgataaaaaccatcagatctggtgagacttattcactatcacgagaatagtatgggggaaaccgcctccatgattccagttatctcccactgggtccctcccacagcatgtggaaattatgggagtacaattcaaaatgagatttgggtggggacacagagccaaaccatatcagagggcgtgtgtatgtgtacacatatatgcacatattatgcagcagtgaaaacattaaacattattaggatgacactgtttaatgtttgtgatattacctttttgattgaataattttataaagtctgcaatatgtaaaatttttatcttttcttgatagatttgaatttggacaataattgaaagttattccgaggcagttgtgaataagatacctgcttaagcaaggtaatgaaagtttaattaaaaaaagagagaaactataaaggaaggaaacatttttttctgtgtttgtgaactctttctttacatagttgtttttttttttttgagacagagtctcactctgtcgcccaggctagaatgcagtggcatgatcttggcacactgcaacctctgtctcctgggttcaagcaattctcctgcttcagcctcctgagtagctgggattacaggtgcccaccaccacacccagctaattttttgtagttttagtagagacggggtttcaccatgttagccaggatggtctcgatctcctgacctcatgatccgcctgtctcggcctcccaaagtgctgggattacaagtgtgagccaccgtgaccggcctagtgcctgtactttaaccacttctttgtacagcttcccaagtgggtttaataaattatgatatatccactcagtggagtgttacacagccataaaacgggaacattgtgaactacgattgtgttaaatttatttacagtgggtgaggactccagataggatgcagacataaaaatggttgtgttatatcgattagataatgggtgacatttctcttaaaaattattgttaatttttactatgaaaggggaaaattttccatgaaaggacagggggaaaagttgtaccttctgaaggggacaaccaggaacgagtaggtctttgcaagattttttttttttttaaattcattctgtagctccaagaacaaaatgaattccaagcattggttaggattattaaggaactggaggatactaggaaaatgttgaaaaaggcgtgttttttctctagtaagaaaagaggcactctaggaccaagacaacttggtccaaatatgaagcaagctaaaatatgtcataattttgagcagtttgtgaatcctagagagaagtaagtggaatcctagttcaggacttggcttttagtgtaatatttatatgctgatgatattaatgctcttactggttttgtggttttcactgcttagaactaatctgtagttaaagcatggaagacttaattctagttacagagcagaaagcttgagactctacaaacacagatgacaaaggtggagaaatggaagagagaaaagttagggagggcgagggagtcagtgtattcatctcacaggatggggattcaagagatagtttctagttgcgaagctagaaaggtttaaaaacagaggaaaatgaacataacaataaaattgggaagaaggggagatgaagagtaagtgaacacacaatcctaattagtgacatcatatatctgcacacaatttccaaagttggcaaaccaagaaatgatggctagagacctgtttggaacggtggaatagaccaccagaagaactaaaaactgttggaagtggttgcctctggggactatgggcaggtagggtgactggggcaggtgtgtgtcattgcaagccattgaatgaatttgcttttttcatagatgcatgcagttaagattcccactcttttccctttgcttgctgcaaatgaatctgctccctatttttattttttctcatttgagaagctcattattttcccagcatcttctccaactccagtgacatgctgtggaatttgagattgtgcacaaactaaacagtatttcaggagactctgaaatcagggaaagctactgttaaattgattttattccataaataggcttaaatccatggacataaaataatttattataataggtcctacgttgcctagctcatagtgtttccattttctctggcacttccctccttccccagtccactgtggcaggctctcagcggtaatggaattgggcacagtgtgattgtgtcctttgtccccattgggtagaatgagttatctttcagccccctcctggcttctcacttctcttcttttttgatgtaattccatgaaatcacctctttttcctctgtcttccaaaaataattttgtatttacagaagtcttttgtaaacacaaaatttccattgtggatgaaccatgtaccgttggtctttctcatgcttcctacagctcaacagctgagtgttgctgggaaaagtcttaggtttgagatcagacatgttaagaaaaaccaaatgggcacttaacagtgtccagtaatccaaaaatattttcttgtaatgaaataagacaacactgagacaggaattgttttctctccacgtacctcctgttacctcctcccgtatcttgatttttagcctaggcctctctaggttcatgcgcttggcttcctattggtatctttacttcagtgtcacaaagacatctccaaattgataagctccagatggagctttgattcattttttcacctccctatctgctaccactgctctccagtctttcccatctcaataaatgacatcgccatccacccttgttatttacacaaattaggaccatccttgcttctttggctcacattccacatctaatccatccttcatgatttacctctagaatggatcgtacgtatctgttgtttgacattttcacggctgccgccttagttcaggcaactatcatttcctactctctttttcttggtctctctgccttttttcttaacttctttcaatcttttcttctatagtagccaaaataatcttaaaggttcacccagtcatgttactgcttgcttaaacccctgcagtggctcgtcatcatccttagaacggacatcagaagtctctgtgcagtatgaggtgttcactacctggtctagctccagccccttcctcctccccacccccaggtcatttcacccttactcaccttctgaaaccattctgatattctttcagttcccagggcttctatgtcttctttacagtgtgtgccctctggttggcatcccacagtgtttgctatattagtggaactttacaaaaattcttgggttctgtaaaatggccagttaacgggacagattgagaatcttagaatgtaatggccattagtagtcaacaagtcaagtcccccatctgaggcttcagcattccagtcagatacttgtacaggttaagattgaacaaatgtgacagaagtctaccacattcatctctggcaaacccaatgttagaaagtctttttcatctggaaaaaaatggttcaggtatttatagacactttccttgtctgattcaagtcctctaacctttaggcttcatatccctatttattttgaccattcttgggaatatggtatcttaaacctcagaatgcatttgtctattaatattccacttaaagggtgtagtaggtgctgtagtctcaatgttggtgtcccacccaaattcatatgttgaagctccatttccaatgtgatagtgttaagaggtggggcctttggtggtgattaggtcatgagggcagagctctcatgaatgggattagtgcccttataaaagaggctggggggaccgggctcagtggctcacacctgtaatcccagcactttgggaggcagaggcaggtggatcacgaggtcaggagatcgagaccatcctgaccaacatggtgaaaccccatctctactaaaaaaataaataacaaaaattatctaggcgtggctgtgcgtgcctgtagtcccagctactcaggaggctgaggcaggagaattgcttgaacctgggaggcagaggttgcagtgagccaaggtcgtgccactgcactccagcctgggtcacagagtgagactccgtctaaaaaaaaaaaaaaaaaagaggctgggggagggggaagcatgtttgcccttttctgccatgtgaggacacaaagaagtctccattgatgaagcagacagcgggctctgacaccacatctgctggtgccttgaacttggacttcccagcctacagaactatgtgaaacaaatttgtgctgtttataaattacccagtctaaggtattttgttacagcagcccgaaaggactaagagatgagttaaatagtgtccacaaaaattcatgtccccctagaacctcagaatgtgcccttatttggaaataggatctctgcagatgtaattagttgaggatcaggataaaatcatttcagtttactgtgggccctaaatccaacgactaatgtccttataagaagaggaaaagatacaggaagacacacagagaaggcggccataggaagaaggaggttacagagatggcatcattctgccacaaaccggcgggtgcaaaggatggctagcagccatcagacgctgggagaggggctggaggtggtttttcccttgagcctccagtaggaatcagccctgctcacaccagactttggggccccagaactgtgagacaatgagactatgttgttttaagccaccaagtttgtgatgtcttgcggccgccactggaaactaatacaaagagaatcccagcgttgaacacaggcatgcagggttagctttgccagcacaggagagagtcgagctatactttcttcatccttctggatgtgcctgaagtcacgtcagttgttgtggttttttccaaaagaccatcctgagcccactgttgattaaacttccagtgttttccaccgaggctgctcctaagccatcagccatttcattcagcctttcaggatacttgctgaatcctgatgcgtcacccacagtctttactctttctagcagcttgtgtcactagtgaatgcatgaacatagctttttttttttttttttttttttttgagacggagtctcgctgtcgcccaggctggagtgcagtgggacaatcttggctcactgcaggctccgcccccccggggttcacgccattctcctgcctcagcctcccgcgtagctgggactacaggcgcccactacctcgcccagctaattttttgtatttttagtagagacggggtttcaccgtgttagccaggatggtctcgatcgcccgacctcgtgatccgcccacctcggcctcccaaagtgctgggattacaggcgcccggccgaacatagctttctgtatcttcatctaggttagtggttcttagccttttgctttatagatcccctttgataagtgatgaaagcggtgtacctttctccagaagactacgtatttatgtagagatacacagaacttttaataaggttaggaggccagttgcctcttgaagccccaagttaagaatccctgcgctaagttagggtggaagtgctggcaagtgaacggacaggccctcgcggtgtgttggtaaaaatctaggctgctgggcgttattccattaatcagcactcttcaaggatggccgtttcacagagttctaactcactttattgactttgcatttagcatgtgtttcttcagcttatgataccataaaagacataatcagatgctttgctggaaaaaacaaggatactctatgtactttgttcctgattggctaggccaggagccactgcacggaaggaaaagaagtgaatctttcatggcttagccttggtgtgttagtttcttattgccgcagtaacaaatcaccaaaaactaggtggctcacagcaacaccaatttactcctcttacagttctgggggtcagaattctgaaatgagttttactggcctcagtgagaccaaggtgttggcaagactgcgtggctttggagctctcagggggaatcatttccttgcctttttcagcttgtagaagctgcctgtgttccctggcccatggccccttcccccatcttcaagtctctgactttgactttctccgtctgtcacccacatttaaaagacacttgtgattacattgggcccacccagacagtccaggagaatctctttattgtaaagtcagccgatgatcaaccttgtttcatctgcaacctagttcccccttgctctgtaacctgatgtattcactgacaggtcctggggattgggagatggacgtctttgagggagccgtcgttctgcctctctcacgtagcaggcctgtgctggcaccccaccattacagctttctcttcacactgtctgcagattattccttcagtaatcatttgtgaaatttttctaaggcttagcaggaccctaatgggtcagttgttttcacggctcaccttcattgtttcgtatcagtgctctgtacacgggttggttttccaacatttcttttctatgactccttaaaggtcagtgatgcaccttctcatttgcatgttatcagcagactaattcatctggatcagaaaaatcctaaattcctgtgggacagctgcctcaagtattcattcatcaaataattattaagcacctactgagttccagacaggacaggaagttcctgcatgctgttgctgtctggtggggggaagtaaaaggagtcagctcttgtgtcctatctggggaaagcagaccgttacacaggtcataacacgattatttaatcatagtcttgggaaagcatcgggatgctgagagcataaatggcagaagagactcagtctagggtggtcaaggcgtccctgaagaaatgatgtttcagctgagacggcagcatgagcagatattacactgagagggggcagaaaggaggatgtttcagtccaaggaaatatacacgaagactaaaaggtgcaaaaactgtgatgtacttgtggaatttgaaaggagttagagagtaagggggagagtggggcacagtagagttgaaaaagtcagtgttttccaggccttgttaggattttggactttatataagaggaatggaaaactattggagggatttttgttggtgttttaagattttttaattgtggtaaaataacgtataaattgaccatctaactgttaagtcatggtaagtacatttccactgttgtgcgacccatctacagaactctttgtcttgcaaaatggaaactctatacccattataccagctgggtgcagtggctcagcctgtaatcccagcactttgggaggctgaggtgggcagatcacttgaggtcacgagttcgagaccagcctggctaacatggtgaaaccccatctccactaaaaatacaaaaattagcgttagccaggcgtggtggtgtgcacctgtagtctcagctactcaggaggctgaggcaggagactcgcttgaacccgggaggcagaggttgtagtgagccgagatcacactactacactccagcttgggcgacacagcaagactccatctcaaaaataaaaaataaaaacatacccattaaatgacaagactccattaccccctctgccgcagcccctgcgaacaccactctactttctgtctctatgaattcgactaggttagttcctcataatttgtaactggattatttcacttagcatatgtcctcaggttcatctgtgttgtagcatgtgttaaaatactgttgaagaattttaacctggggaataaagtgaccagatttttaaaaattagcacacatttttaccagctgtaacatacactgaaaaatacacaaccgtaagtctgcagcctgatgacttcccacagaatgaacacactgatgtagccatgaacctagtggagaagttgagtgtggccagctttgcagaccacctcaggtcccttccagtcacggctccttccctcctcgctccccagcagtaacttctgtcctcgctttgacaccgtagtttatacctgttccttaacttatgtgtaaaggacagctttttacctgcagcactctgataccaaatgtgtggattttcaacatcaattggatgtcctacagtttaattcaattctgacactaactacctggtaaagttagcgcagaccccacaggtaaagggcctagtcccacaaaaccgccccctacttcagacaccggttgtaggtagtgggacaaagggtacccacacatctgtcttgacttggctacaattcaggaggttcccgtaacgccctactcagtttgataatttgctatataacagctcatagaactcaggaaaacactttacttactgtccctgttattataaagggtgttatgtaagatacaaattaagagccggatggagaggtacatagggtaaggtctggaagggtcccatgaccaggagcttctgtcgcggtattgcgggggtgtaataatcctcttggcatacgcctagcccaaagctacctgaaccctgttgtttaaagtttttagggaggctccattacacattacacatgattttttttttttgagactgagtttcgctctgtcacccaggctggagcgcagtggtacggtcttggctcaatgcagcctccacctcctaggttccggcaatttcctgcctcagcctccctagtagctggaattacaggcatgcaccaccatgcccggatagtttttgtatttttagtagagatggggtttcaccatgttggccaggctggtctcaaactcctgacctcgggtgatcctcccgcctcggcctcccaaagtgctgggattacaggcgtgagccactgtgcccaccccgacacagacatgattgatttaagtcattggccattggattggctcaacctttagccccttgcccctccccagaggtttgaggggctgggagttgggctgaaagtttcagtcctctaattacatgattggttcctctggcaaccagaccccatcttccaagagtcaccttattagcacagacgctggtatggttgaaaggggcttattttgaataagaaaacatgctcctctcacccctgtcactcaggaaattactaacgtgttaggaattctatgacagaaaccagggatgaagactaaatatgtatttcttattatatcacaatatacatggaatcacggtatgccttcttgtgactagtttcttttgctcacatcatgttagtgagatgaattcatgttactgcatgtagcagtggttttgtcggtgatctgctttatgaatatgtggtagttatgcattctgctgtccatgggcctgtgggtttcctgctttttggtggttaagaacaatgcagtccagtcatgagcattgtatgtgtcttttgtacacatatatacacattttattgggaatacatttgagtgtccataagacactcttaagagaggaagaattgtcttctttctctgagtcttctttcaagcccaacgtgtccaacatggttcatctttcctaatcttttcctcctctagtgtttgctgtctgtcggtaacaccacctctgcccagtgtgttttgccagaaactgaggcatttccctctttagaccccccactcccatatctaagtaattactgggtcctattgatccaaactcctaaatatctctaaaatgtggtctgtttctctccacacctgttgcagcctcctctggtctgtggctcccttctagcccattctctatagtaacaggacacagactttctctgttgcacatccacatgtagccccagggtatgcattaaactcataaatgtcatacatacactattagggtttttttttttttccccacagatactatcttaaggctcaacacttaggctaagagtaacagcgggaataaatctatatttctgatagtcttcatgatattttctagttttttgactttcttttccaaatctgattggtggtgatggtttgtttgtttttttgtttttgtttttgtttttttttaagacccagtttcgctctgtcgcccaggccagagtacggtgacaccatctcagctcactgcaacctctgcctcccgggttcaagcaattctcctgcctcagcctcccgagtagctgggattaaaggtgcccaccaccatgcctggctaatttttgtatttttagtagagacagggtttcaccctgttggccagggtggtcttgaactcctgacctcagatgatccacccacctcagcctcccaaagtgagaggattacagccatgagccacgcaccagttgtaatggtgatggttgttttttaaccctttatagtagctaaaaagagagaagtatcagctctaccagtttatttttgctggggtttttaaaaaaaggcatttgtccatttgatgagggacaatttagtaaaaagtggatcatttcgtctgtaaatcctgtaactgagtagtgtatggctattatactgttggcagtattatctgaaaacaaacggatgaatgagagagtcactaccatccctgttgcatttcagaaatccctctctttatttaggacaactggtataccacatgagacagacagacacacagacacatacgcgtgcgcgcgcgcacacacacacacacacgcacacacacacaaagtcatctgacattcaggttgaggaaagcagccagtgttaatccttaattaaatgccagtaaaacttaacttacttctagctgggcatggtggctcagagtgactccttctcaaagaaaaaaaaaattgcattttttgtttgtttgctgtttttttttgttttttttttttttttttttttttttttttttgagacagaacctcactctgttgcccaggctggagtatagtggctcgatctcagggcctggctaatttttgtatttttagtagagatgggttttcaccatgttggcctcaaattcctggcctcatgagatctgcccgccttggccacccaaagtgctgggattacaggtgtgagccaccactcctggccaaaatttatttcttgttaccaataaccagcagagtaattttttaaaaactcaaatacatttaggaacacccatagataaaagatcaataaaacaaaaattaagtcagttgtagttctatatgccagtaacaaacaattagaaaataaaaatttcacaatatcatttaaagtaatattggcactgaaaactgcaaagcactgttgcaaggaattaaagatgtaaataaacagacttttcatgttcataggtccaaagacttgttttgttaaggtacctgtgccctccaaattgacctacacattcagaccatcctgtgaaaataccagaacttcatatggaagtaaaagggactcacagtagtcaaaacaatcttgaaaacaaataataaaattaagagaattcacatttctcaatttgaaaacttactacaagacagtgtggtactgatagagacatggtagatcagtggagtagaactgagaaccagaaagaaacccttttgtcacttgatttttgagaagggtgcccagacaattcaatagagggaaagaatagtcttttcagtaaagggtgcggggacaactggatatcggagaagttagagggagagggaggatgcgaaaggaatgtgcattgtctcaaaagctaagtgggcatctgcatctgaccctggcctggagggtgacatgccacggggtggaaggaattctttgcatttggtgatataatgcaaagtgcctagaaattgggaagaaagcgattgtatcattttttaagtttgcaaatcctaggacaaagaaagctgggtcgttacaaatcatctcaagaaacaatatgagtgattaattgaagaaaccagcatgaatgcataagatataaacagctgttctactgaaatgaagtaaaaataggtaacagagaaacctattctaagaatgtatttgctggccgggcgcaggggctcacacctgtaatccagcactttgggaggccgaggcgggcagatcacgaggtcaagagatggagcccatcctggccaacatagtgaaaccccatctctgctaaaaatataaaaattagctgggtgtagtagtcccagctactcgggaggctaaagcaggagaatcgcttgaacctgggaggcagaggttgcagtgagccgagatcgtgccactgtactccagcctgggcgacagagtgagactctgtctcaaattaaaaaaaaaaaaaaaaagaatgtatttgcttttttacagtctctgcactcattgtcagtgtcatgtagccgtgcttgttgcagttctcaggttattctctgtggtagagaaagcaaaagcaaaaaagtcttgagaaatgtttccatccatcatttagttggccctgggcagtaaacctatttctttccaactcttcttgctctgaatatacttaaaaaaataataaaacttttgtgagaagtagctttgcttgttcctatcattactggcaaccttcaactttctgggctttttaaagaaaagctgtgtaagcctgtaccatcatcttgtgtttgccttttcaggttttgtttgagtcctccttaaagcttaatttgtcttgtgtgttcttgctgctttcttcataaaatgtgtcattttctttctcatcaagatgatttgttactgagctttgtttgcccaggattttgtaaactctgaaatgatacgttgctttcttccatgtgacttgtcacttctgttcggggcctgcattgggttcgggcagctgttcaccgggatatgcctggccactgtcctgtgggaggcaaagtgaatggaagcggaggggtgagatctcttctgcagctctaggtggttgcaatccctgtccatgccctatcctgtctgccagttttgagatctgttaaaaacctttatctttactccatttggccagttgacctcggcatgctcccgcatcgaagtctaatttagctttctgcctctcagaggtgttcttgagtgcttctgtttacttgggattccttgaaggacgtacattatcttgacataaaatcctttttttccctctgaataatagtgtgctttccatcattataggccaatcttgagacctgcctcaacaagtgtcactgattattttctatatttaaggtgaactttaaggttttttcttattacttgtatttattggtttatggacgtctcagattaagaacactttaaacctcttattttctcaggtgagcaatctctctcagtctttctttttctgtaatcctccgtagggactgattttatgatttcccttgtattctcttcctccctccctcctcaccaatttagcttaaagtcctttggttgctggacagatggcttcttccctgttagtgtgagctgcatggctcctggcctgtcattacattttaaattatggtccagatagcccagtctttgtcattactgtcattgcatcgagtcattagtactggaaatactcatactagaagaaagaagtgatgaaataaaacaagcttgctcccacattcttttctgcccaagagttagtagtgccttcaggcgctgctctggatcaagggtggtgtccttgtgtccctatgtgtggcagcagcagtgggaagttgagtctccatatggccacttggtttccaacaggaattttcgtcctttgtgtttcagtagatgatgctgttagccagaactctacactggaaagacgtcacatgtgagaggaagctaataagtttggactgctcagtattcatggagaaatgtcaagcaggcaggtgaatattaaacagaaaagctcaagagggagatttagatttagattgtgatgtacacaggtggtagtcgaaggcaggggagtggatgatactgtccactgagaaaagagggcctgggacagaccttggcgagggtctagcagtggaaagtgagaaagaatagttagagaggtgggaggaaaacttgatggataggagccaagagaacagagagcctcgggaagagttgtactcagtactgtaattcctttgtggaacgaagagtgatgtggataaacaattaacacttatattgcactgtgacaccaactttgtatgaggaccaagctctaattttcagttatttagatctgtagcatcttgcatgaagtatctgttgcatcatttataatagaaattattatttttgaaattgacttttcatgcaaagtgatttgtattagccgtcatttaaacttactcttaagatgctttttattatgtcatggagaacatccaacagatatatttgcgttctaaggatgtaaaaaataatcaaaatccatttgagatacacagtaactaagttcagcagacaaacaatgatggacggctgctgacaagtgcatctgctgcagttccactgttaggacattcctgccatgttgactgcagcatccagcatttaggtgtccagaaggtattttgctgccaccttcttaaaaattctgtacaaaggccggggcgcggtggctcacgcctgtaatcccagcactttgggaggcccaggcaagcagatcacaaggtcaggagatcgagaccatggtgaaaccccgtctctactaaaaatacaaaaaattagccaggtgtgatggcgggcacctgtagtcccagctactcgggaggctgaggcaggagaatggcgtcaacccgggaggcagagcttgcagtgagccgagatcgcaccactgcattccagcctgggtgacagatcgagactctgtctcaaataaataaataaataaataaataaatataatatctatacaaaaaggtgataatttgttgtaagaatgtatcacctttttatttacaattggtaattgtaagaattgtcaattaggagaaaaacaagaaacacatttagtttactttttaaaagtactagaattggccaggtttggtggcttacgcctgtaatcccagcagtttgggaggtcgaggtgggcagattgtttgagttcaggagttcgagaccagcctgggcaacatagtgagacctcatgttggggtaaatacaaaaattagccaggcatggtggtgcatgcctgtagtcccagctactcaggatgctgaggtgggaggattacttgagcccaggaagttgagcagtgagctctgattgtgccactgcactccaccctgggcgacagagtgaaaccctgtctccaaaaataaaaataaaaaggacagtgcaagaacaaccccgaagtgctgagagaaaattaacagtctggaattttttacttaattaacctgtcactcaagaatgagaacaaaagaaagatgttttcagatgtaaaatacaagtttacctaacagatcctcattgaaagaacttctgaaggatgtagaataaggaggagggaaatggaacacagaaggaaaaaagtgagctgtgaggaggactgtgatggtgaattctatgtttcaccttgactgggccacaggtgcccacatacttggtcagacagtatcctgagagaattcttgtgtttcggtcagggtggttttggacgaggttaacgtttgaatgggtagaccgaataaagcagattgctctccataatgtgggtgggtcttatccattccactgatggcatgaatagaacaaaaaagtgacactccctggagtcagaggggtttcctcctgcctgactgccttatggctgagacctttgactcttgtgggcgcggagcctgctggtctttggcctggaactccatcggctctgctgggtctccagcctgccagctcaccctgcagagcttgggatttgtctgtctccataattgccagagccaattccttataataaatccctttgtatctacatatctgtataaagaaataactagatagagctagacatagggagagtggccctgcctacaccttgattttggacttctggccttcagaactgtgggagaatacatttctgttgtttaagccaccatgcttgtggtactttgttctggcagccctaggaaactaagagccttgaggtattcaggaggagaatagaggtactgattaattgtagaccttttatcaggtatgcatgttaacattttaagggtaggcactaaaaaaatagaacttgaatatatagatgaggaaaagggggaaatgaaattcggtcaatatattcagaggcagaaaggagagggaaaaaaagtataaagaagcttagaaaagtagaataaataagaacacaataaaataatagagatgaatccagctatatcatatacatatgcaaatagactaagcgtggcagttgagactccttttgcagtctgatttaacctgtgggctgcttctcagaatagtgttaagtgcaggagtaaataggattaaagaaacccaagtatactgaaacaatgtatcaaagtatttaaaatacttaacatgtctgtgacatggtaatacttgtacagttaacattagggacaggattcagtggtgggcctaatcaccttatcagtattttgcagtatttgcaataactgtaatgtggttgctgctggttacagagttacagatggtttgttatctgtgtttataaataaataaaatgctagatttcagttagattttagcagaaataaagatgatttcccctcatccaaatgtcactcagccctgaattctatccccagagccttgtcaagaatgcttgctgtagctgctgatcttcaagtggggctctccactcccaaatagctcatgtttccctcgagtgagggaaggaggcagaggggtggtaccttagctgtctccctgtgtcaaagcgcttggaaaccaaagaagctttctttttgggttttgtcctttttggtgggtttgaattgccaagtgtggattctgatgaattaagagccactgtataaggttaccttgaggtttgaagtgagctgttaattgcctaccagcctctgcttatttaaaacagaaaacagaaaccttatgtaattcaggcatctgtgatcacttccatgcagccacatgctttaagtgacacctgtttgagtcccagaagagggtgtggggcacagaaggataaatgacctagggtgagctgcacagaagtgaagagcttaaattacatacctggagggttggctttttctgtctcccactgaatatgaacagggagctgtgtgacttcatttgctgctggcagtcatcttatgataaagaggggactcttaggatgaagctgaagctacagatggcaaagggaagagatgaaaaggaaccagatcctggtgacactgctgaggtgctgaattcttcaccgcaaaatacagccctgttctgagacaggataaattccctcttcccgtttttgagatagcatctctctctgcctcccagggtggagtgcagtggcgccatcccagttcactgtagctttcaactcctgggctcaagggattctcccacctcagcctcccaaagtgctgggattacaggcatgagccaccgcacctggcctcattatttttaatcaatctaagtcattgattttgttacatggaacactggttcttcctatgtgagtcaagcagaaattgcctagattcggaggttaatcctgtagcctttgataataatatcatcctctagcctagaagcagggcagagcaacctggaaacagacaaattagatacagagtgatttgccgtaaaccggactacagactcccttccgtgccccttccatgtaaaccagttgaaatcttggagaactcctattaactcatcaaggcagaggttttgcttggaatggaagggaatgaattcccttctgtgtgtgtaattttccactttcctctcccgattcttagcatgctgttgacctgatttagctgtgtctattagaaactgggttcatagaagtaaaaatgaaaaataatttctcagaagagggctgctcagcatgagatgttagtaagcattgttgttccaataaaaaaaaaaaaagtgtgctgttgacatggtgaacatgaaccctggagagtcctgggcccacgccagggaaggcagagtactcgggagcgtcagtattgaaggttcgactggaggaagaagaggcagtaaagacccaaagaatgactgtggtagtgcaggaggaaagcctggaggaagtgggacgtgggagtggagagaggagagcgcttggctggggcaggccagtttggagaacaaagagtggcctgagatttattttatttatttttttagacagagtctcactctgtcgcccaggctggagtggagtggtgcaatctcggctcactgcaacctctgcctcccaggttcaagcagttcttctgcctcagcctcccgagtagctaggattacaggcctacacaccacgccaagctaaattttgtatttttaatagagacagggtttcaccatgttggtcaggctggtcttgaactcccgacctcaggtgatctgcctgccttggcctcccaaagtgctgggatgacagctatgaaccaccacgccgggccagaaaaaaacattttcaataagactaaacacccaatgaagctaagtaataaaaagaaatgttaggtttaagtgaaagtgtagaagcagtaaaataataagttatatccatggaagtggataaagagaatgaaagctccacctaagtccagtagctgccattaaaaataaaattaagaaattgataacagaaatgatgaattgtattttttctttgaatcataaaattagaatttgacaaaggaaaataaggaaagatagggtagaagcaggaaatttaaagaataaagaaattataatctaattcaggagtaggaaagcaaccagaccatagctgacaatggaggaatctaaatccggggtaactaattagtctcatttttatttttacctcttttgtaggaagcaactgatagaacattaccgtagtcaggatattaccacgtgaaacagagaactctttgccacaaacttttttttaatgccagttttggcttaatttccctgttgtttttccccttttccttcatcaatcatgttaaacatctatgtgccagacatattcgcaggagatgctagacctcacattccggaaggaaagcctcagaagtaaacagccagttactaatacagtatgataaatgccaagatggatgtaacctaagggtgccatggcaacttgaaaaaagcacccaactcagtcttaggaggctgggaaagcgttctggagaagacattttggcagaatcctgaggctcagaaggtggtgagcaagagtggtgggactggcatttcaggaggatgaagtgacacacacaggctctgagagggagaggcacatctttgccactgtgctgtgcggccgcctgttttgaccatcactgcagaaaaatactgtccgaggctatcacttctgcccctgcagcagactgacaattctcaggggtaggaaggaaacccttagcctacacaacatggtgagtgcttcttatgtggcgtgtttacatttctaagaaatgaggttttactaaatcaaatgaatcaaagaggaggagagtttcagactggtggtgagaggtgacaacgtgctagcagcccctgctcgctctcggtgcctcctcgccttggtgtctgctctggccacgcttgaggagcccttcagcccaccactgcactgtgggagcccctctctgggctggccgaggctggccctggagttctgcgtgggtgtgagcttggcgggccctgcacctgccccggtcagtgaggggcttagcacctgggccagcagctgcggagggtgcgctgggtccctcagcactgtgggcctgcacgcgccgcggtccaccgcgcacagattctcgtggggcctcagatgcctccccatggggcagggcctgccatgcccgagccccacccccctccgtccacgccactggagcctccccggcgagcgctgccccctgctccacggggctcggtcccatccaccgcccaggggctgaggagtgtgggcatgccgcacgggatccactaggggaagccagctgggctcctgagttgggtggggtcttggagaacttttctgtctagctaaaggattgtaaatgcaccaatcagcactctgtgtctagctcaaggtttgtaaaggcaccagtcactgctctgtgtctagctaatctggtggggacttggagaacttttgtgcctagctggaggattgtaaatgcaccaattggcactctgtgtctaactcaaggtttgtaaatgcaccaatcagcactctgtgtctaactcaaggtttgtaaacgcaccagtcagcaccctgtcaaaatgggccaatcagctctctgtaaaattgaccaattaggatgtgggtggggtcagataagggaataaaagcaggctgcccgagccagcagcggcaacgtgcagaggtccacttccgcgctgtgggagctttgttctttccctgtttgagataaatcttgctgctgctcactgtttgggtccctgcggtctttatgagctgtaacactcactgagaaggtctgcagcttcactcttgaagtcagtgagaccacgaacccaccagtaagaagaaactccggacataccatctttaagaactgtaacaccgtgagggtccgcggcttccttcttgaagtcagcaagaccaagaacccacgaattccgaacacagtggggtgtggaatagagatttcattcctacagccctttaaatatttacatactattcttacctgaatattcttctccttctctcattgcaaatgagatcttttctgaacttgaccttcttaaatttgtatagtgttgtaggctctgttacatatcgtcttacttaattttgcaagagttcaagagaagagtttagtctttgctctgtgtttttatgctggcaacttgcgtatccacctccttcctggctgcgcaagtttcaggggttccatgtgggctccagctaacactaaatcttgaccatcgtcctgccctcctccctccttcagtctcttaagtgcacttcgtgttggcaccctctaacgtcagcttctgtgctggtgccaattatgatgcctcagtgaatgtggaggcttttattttttttttttgagacggagtctacttccgtcgcccaggctggagtccagtggcacaatcttggctcactgtaacctccgcctcctgggttcaagcaattctcctgcctcagccttctgagtagctgggattacaggcacccaccaccatgcccagctaatttttgtatttttagtagagatggggtttcgctgtgttggtcaggctggtctcgaactcatgaccccatgatctgtccacttcggcctcccaaagtgctgggattacaagcgtgagccaccgcgcccggccatgtggaggctctttaagagtcaagagcaaggcgtttgccacattgtatctctctttggtacttagcgtgtagctgagcacataagttactattcattgaggtgaggagcccagaattgtttggtgcctgtcaagaggtaaataagtctcattacttttaatacttttggactcagcaggaaaaagccctagaggaaaaaaaaaattaagttctgtagtaaaatattttgtattatctatcttgaaatttttatcagaacctctagtaagtttttcctggctctataattaataaatgcaaataattcagagatagtatcctcttataaaagttggcaggtaagaaaaacggaagtaccgttattctgaattttaacagaattgctattgacaaattttaaaggctcataattatatagatattttacaccataatatgtcttcacttaataaattgctcaagtgtaaacaactggtattaaattttggagtaatactacttaattatagtcatcagtcatgaaaagttgttatagaaccgttgttttcattatttatattttcttaattacaggagggaataactaggtagaatgagtatactacagtattaagttcctgtttatgaaaacctcttattttcttctgaataataaataccacttttttgaacagaagcttcctatccttgcttattttgtattgtactaccaatatgaatgttttcagagaccttttatggatgatgattagatgaattttgggaaacaggaacattcttttgcttatacaggccgttgttggatttgttttgatcatgctgttgttcatagaatctgttctcagtgggcgggattcctttagcagagttttaaagtcctcctgcagtatgtttgataacttttgctctgtggttgcaccccttgctgtgtcttttcattcttagaatattatgaatattactgaactgctgtcttctgagtggactgtgacactgtcgaaagaggtaaaaaagatgaggcttgggatctgtgagtggtggttactaagagcagaggagtgtggggtgctgctgagcgtggggtagctcacatattttggcacagaaactcccaaggggaccaaactggatcaccaagacaacataggatgaatgtcagtgaaacaaacaaagggaaagagtgttttttaagcattgaagaatgaaggaattattactgttttttagagatagagtcttgctctgtcacccaggctggagtgcagcgacatgatcatagttcactgtaatcttgaactcctgggctcaagcgatcctcccatctcagcttcctgagtagctgggactacaggtgcgtgccaccatgcctagctaatttttttgttttttattttgtgtagagatgagggtcttactatgtgcccaggctagtcttgaactcctggccttgagtggtcttcccaccttggcctcccaaagtgttgggattacaggtgtgtgccaccacgcctggccagaaagcattactcttggctttttcacgtgtaaaattctgtgagataagactatctaaatctttataaataagtacaaattaaagatgggagaatttcagtcacctgtgatagttacacagctagtaagcagttgatctagaccttggagcacagtcttgctgattccataactatgttgtttgctttttactacattgtgcatgtatgcgagaccacagggaagaagagataagtcacagacaaatgattaaatgtgttgcacagaaggcaggggtacacatcactttagatattcttgattttgcgttttcttccagggtttgtgcagcagtatgttttgaaaaataacgaacagaacacctaaaaccagttccttggttattccccgtttggatacagtattagacatttttctaagaggagattatcgtaacaggtcactgagctgcttttattttacagcataattatcggtgaaacagatagtgatgaaagtaaacaatctgtttcaggattttaaagttttatagtgcatcgtctgtgtctttcaatagttgactcctaaaatcatgacataggcttctatccccgtttaatttgattgaggaagggttaaaggttcagagtgcagaaaccttttaaggaaaagggtaggtaatggtcgtatacaatatcaatcatgaaaaattgtgaaaacattcatcttccatttcatgtattaggagacctctggtagcaaatacactcttggtgcagtctctcaccacaatagttgaaagaaaatttggggaaagatatttaagtgggaatggtagatgtaatagttctctgaagttactggcatctttacattttacaatttaagtcgtgtaagcatttagtttcttttgctaggcatgtgcttccaggtgtgtagaaagccaacattttcccactggcgtcatctctttatctactacaattaatacttcatgtttttatgatttgttttgagacaaggtcttgttctatcacccaggctggagttcagtggtgcgatcatggctcaagcagtcttcccacctcagcctccccagtagctgcgaattcagatgtgccccaccacacccagctaatttttttgtattttttgtttcactttgtcgcccagggtggtctcaaactcctgggctcaagcaatctacctgcctcggcttcccaaagtgctgggattaacaggcgtgagccaccacacctcgccttgcttttatgatttatttacttctggtgtcacctttttagatccatgcgctgtgttccctttccttacttccttcccggcacacagaggaccggcagggctgactcagggcacagggctggcaccctctgccactgtgcgccagcagtctgcagactctacctttggtgacttctctccccttctgggctgcccttctctctcatttgaacctgttataaatgtgaaagtgggagtgggaagagcagccgggggcttcttcttaagatttgcagaggatgccagaaccatgatggccatatgtgcagagtgaaaaattgaggcgcttactctgacagatttaaatgtacttatgagtattttaaataaactatcccaaaaaatccagaacagtggccatgtaatttgtagtaccaacattcttagtgtcttcttgtaacctgttagacagatggatacagtaagtgtatcttgatacggagttgtggggtgacttttgctaacataaattagaggaataatacatttattctacttagatgttattttaactacttcaactttcaaatataagccaaaaccaaacttttaaattttccttagacatttatgaagaaatttgctctaacatggttgaatttcaacaggatcacttagtaactgaaccgaggattattttggcctcctcactggcccccagtccaggctcctgttttctcactgtggggatagcggtggtggcggtgtgtggagaggctagtacatgaacaggaatgagtaagagtcagggtgtcagggttacatcagtcacctgggtttctcgtctgtgttggccttttcttcctcctccctttaccaccctgtactggatattatcagtccttttttattttttatcagtctgtaaagttaagaaattttcattgttttaatttgcattataggtaaccgtcccatggagcatctctccctataggtactgattcagcttcattgtattgtttgtggatgtattcatagctctgctggcagcgagctgcttcacgtgctttagctctgtgtggtattcagaaagcagttgacactttgataaagacttggtcagttttatttatctttaatgtgtgtatttctttttcttttcagttgctgatcatctgggctgtgatccacaaacccggttctttgtccctcctaatatcaaacagtggattgccttgctgcagaggggaaactgcacgtttaaagagaaaatatcacgggccgctttccacaatgcagttgctgtagtcatctacaataataaatccaaagaggagccagttaccatgactcatccaggtaaacaaaaatgagggttgttgattttgtttttcttcttagaaatcattgctttataggtaagcattctgcctctgctgaagccatgtaatttccaacataatcctattagtattgccatttgtttgttgggatgcatgttttttccccatagttgaatttcttcttttttgtaagtaatggtgatagcagtctgtaaagcttggacttattaaataactggctgtgattaaatccttagttgttttgcatttctacattttgcttaataactttgacaaataatgtatttgatttggaatcattcgcccaggttatgtcatggattctcaaggattgcctgtctgggaaggattctgttttcatcaggataaatgttgaaattgacttagtaattaatataatttcagtagtaacaatgcttctttatttcttctggaagcatttaggatatttctgattgtttaataacaatagttgcagtttattgagcacttactatataaatgccaggcgctgtgcgatgagtttttaaatatattttttagacagtctttacaataaccatgcatgatgtatgttctctcccatcttacagactaggaaggggactgaaagaggtaagggccaacagaagagggctcacaccctagttttgttgatgttctgttagtttcaccactctgtctccttaagttgaaatccagataaaatttagttttgcattcatgagaattttagagtttggcttatttaaagaactaacttttcatcgtgtaatttttacataattatttttagcaagtttcttgcaaagacttgcccaccttaattgagagtcgttggtacttccccacacatcttgatagaatggtgcagatggatttcaactttagtgccctctgacttgttttcttcctttcaaactaagccttttagaagtaagatatactttaggaggccaaggtgggaggatcacctgaggtcaggagtttgaaaccaccctggccgacatgctgaaacccctgtctctactaaaaataaaaaaattagctgggcacggtggagggtacctgtaatcccagctactgaggctgagacaggaaaattgtttgagcccaggaggtggaggttgcagtgagctgagatcacaccactgcactccagcctaggtgacagagcaagactccatctcaaaaaaaaaagaaaagaaaagaagtaaggtgtattttttccaattgcaaaagtaacacatgcttattgtacaaaaactgaaactaaagaaaaacacaaagaataaaataaaatgtgtgatttttcactatccggagatcactggggtcgtgtaacttttaatttattcagggaaagcaaaagaaaattaaggggcagtttaatttagctggacatctatgtggaaacacaggactcgagggtagtttttctgctaggtttcagagcaggtgccggtttgctttcctcagttgtctcagagggaagaaaaactatttaaagatgtgggcctaatgtaacttatcttcattccatgctgatttcttctttacttaaaacatgaagaaaaatgaatagggagaaattcaactgagcaaaatgtatttttctttcttattaatgttgttttacttacacaaaaccacagagaagtagctagaatgagagtcttttaataaaagtatgagatgatctgggaattatgagggaattgaaatcttaaaaaaaaattaaattacttgtatttaaaaaggatgggaagcctgtatcaatgcagcatttcccagctgtgttccttgaaatgttagtttgtttagatatgttcctagaggactcatggggaaacagtaagtttcagaaaatgcttgaaatgtagtccacatttaggggctcctaggacttattaacatttttgggtctctgagaagtcttaaagaacctgttttggctggtcgcagtggctcacacctgtaatcctataatccaagcactttgggaaatactaggttaatcaaaataaaaaaaaaaacaaaacaggctttttttttttccccctccccgagacagggtctaactctgttgcacaggatgcagtgtggtggtacgatcatggatccctgagcctggggaagccaaggtaggaggattgcttgagcccaggagttcgagaccagcctgggcaacatagggagaccccatctctacaaaaaaatacaaaaattagcaggtgtgatggtgcattcctgtagtcccagctgcttgggcggcttgggtgagaggatttcctgaacctggggaagttgagactacagtgagccgtgatcacaccactgcactgcgtcctggacaacagagttagaagctgtctcaaagacaaacacaaaactaaacaaaaaaccctgttttattttgagtaatctagtgtttcccaaacctatttgaccatgtaactctttttatcacagatgagtgtataacagcacaaattaaagaaatgcaggggtatagtttgaggatatatttaggaagtggaaggtaaggcaaacagtggaggtgtgcataagagcaataggaaacggctttatgttgtgattagattcatagacagttagaaaacataatgtgggaaagtaaattgggtaaattggaacaatactttggagagaaatttggcattatgtggtatagttaaaagaatctgcacactgcgatcattaatttcactccagatacatactctagagtacttttccatctttaaaacttgaatgtgtagctcagaatcttgttaaaatgcaaattctgattcagtaagtctggaatatgacccaagagcctgtattattaacaagtttctaggtgacactgatgttgctggcctacagatcttgatttgagaaagaaggcagtgaagaagggaaacctagttttagtcccaggttttccactgacgtgctctgtgacataggccaagctgcctcctgagtgcgggttggaggatagaggccttctgtaaggcctcttgtgactctaaatctagactctgtggagggccatggatgcctacggtggagcacaactgctgtttgcccttctctcacatttcacctccaaccgtgtgagagccagcgggcagatttcatatactcacacaagcactgatagcctctctctgtccttctttccacccttgttactctcgcacatgtgcatggacgacacgtaggagagtgttacagcattgtaacagcagattattgaaaacacctgcatctgtcataggagactggattaattgtggcacgtttatgcagcagttaactgtcagtggattaaagctacatgtatttacatgaataagtctcccaaacacagtaagttatagaagaatatttatagttggatatcatttgaatacaattaaaatgcaaaactttttaattaagtcatttaagagcatgtatataggtataaactaagaaaaacatacataagattaagaaatacaaaatttagggtaatggttgtctctggagagggaagaaaggaaataggatcagagagaagtaaatgtatctataatgttttatttcttaagctgagtgtgggggtagacagacattatattctttgtaatttttgcttatttgaagtatttcaaaataatcattagagaaaaactttgtgaaatatttataaggtaggattaaaaataacagagaagtaggggtagcacttccggttaagacgaagtgaagagatcagcaaatcctcttccaaaaaagcaactataaaactggacaaaattgacgaaacagccatttcagtgttctggatattaatgaagggacaataatctgagacacatttatgctttgaaaaacttctagacttcaggtaagagcagtggaaatttgtggtttagcagggtgctgcttcccaaactccccaagctatgctgtgtggagtttctgccagtgtggagcaggctgcaaggactggcagtttctgtttgcagtggtgaatgacaccagagtccagtgtcactgtctgtggaagtgacttcacagaggtgggctagcagaggagagccagtgactgggcagttcctaggaaaccagtcttattaaaaagaaggaggaaaaagaacatagaacaagaagaaactgagtggaaacatcatggttgcacatcacagtgaaaatagatttcatgtgtttaacccagcctgttactaaacaaaagtgaacaagcagacaaggcaacaccaccaactttaagggggaaaatatcagaatccagagttgctacaatatactgtctaaaatgttcacttttcaacagattataagacatgcaaaatatagagatgtttgactcatattcaggaaaacaaaagtctatagaaactgtctataagtgttcccagataatggatttagcagagacaaacttcaaagcaattaatataaatatgtccaaagactaaaggaaactatattaaagaaataaagtatgacaataatgaatggcagcaatgagtcaacaaatagagattctcagtaaagaacataaaaattctataaaagagccgagccagacagacatgctggaattggagagtacaattttggaaatggaaaattcactagaggccttcaacagcagattcaaaatagtagagggaagaatcaattgaaggaaaatgaacagagcctcagatgcctgtgggacactgtcagacacaccaacatatatcagagacctaagatacacaaagcaaaaactgacagaatgggaaggagaaacagacatttcaatcattatagttggagattttaacaccctactcttagtaattgatagaatagctagatagaaaattagcaagcatatagaaaccttgaccaacactattaaccaacttgacctagccaacatatgtagcacactctacatactgactagaatacacattcatttcaggcacacatggagcattctctcggatagaccatatggttggctgtaaatcaagtctgaatatattttcaaagactgaaattgtacaaagtgtattcttcaaccacaactaaagaaaagctgggaaattcccaagtctttgaaattaagcagcacacatctaaataacacacgggtccaataaaaaattcaaaaggaaattttaaaaacatttggaaccaaacgaaaatgaaaacacatccgaatttgtaggatgctgggaaagcagtacttagatgaaagttaatagctttaaatacctaggtcagtaaacaaagatacttttgcctttggaaactataaaaaagaggaacaaacaaaaccccaaaccagtagaacaaaggagttaataaagattagaggagaaataagtgagacagaaaagtcatagagaaagtcaacgaaacccaaaagttggttctttggaactatcaataaaattgacaaacctttagatagactgaccaacaataaaaaagaagacagtttaccaaaatcacaactaaaaaaggacatcactactgactctacagaaacttaaaggattataaaggaatattgtgaagaactttatggtaactatgtctggggtccccatgaccatccacaggttcagtgactcactaggaggactcacaggactcaccacatagtcacactcacagtgagtcactcttattaggtaatggtgggaatcctccccaaacccatgttcccagatgccacccaagggccaagattgtaagcaggcctttcgacggatagtagttcaaacctgctatgtttacttttttctgtatactgacaaattagacaccttagatgaacaaattcctaaaaatatacagattgtcagaattgactcaagaaaaaatagcatatctgagtagctataataagtaagaaattgaattggggattaaatatcttcccatgaaattcgctggtgcagtctatcaaatatttaaagaaaaaataatactaatccttcacaaactttcagaaaatagagaacatttctcaacttattctgtggagctggtttttaccttcatatcaaagccaaacaaagagatccatggaaactatataccaatatcccttacgaatgtaggcacaaaaattcttttaaaattattagcaaatagaatctagtaatatataaaatggattagattcattaccccaggaatgggatatatggtttttttttttacatctgaaaatcaatagaataaatgaaaaagccaactaaccattttcggtaggtgcagaaaaagcatttgacaaaatctcagtacccatcatgatttaaaaaaaaaaaagcatttaacacattaggaaatatcctcagcctgataaagggcatctgtggaaaagccacagttagcatcatatttgatagtgaaagactaactgctttctccctaagatcaggaacaagccaaggatgtccactctcattagttgtattcaacattatacttactcaacatttttcttgtggttttaaccattgtacacagggaagaaagaaataaaagacatccagttgggaaaggcagaaataaaattcattattcataggttgtgtatgtagaaaatcagatagaatttattaaaaaccactagatgtaataaacaagtcttgaaagaatgtagaatacaaagtcattatacaaaaaccaattgtatttctctctctctctcttttttttttttaaaggcagagtctcgctctgttgcccaggctggagtgcagtggtacgaccttggctcactgcaatctctgcctcctgggttcaagtgaaagtgattctcctgcctcagactcccgagcagctgggattataggcgcacaccaccatggtttcaccatgttggccgggctggtctcgaactcctgacctcaagtgacctgcccacctcagccttccaaagtgttgcgattacaggcatgagccactgggcctgcccaaaagccattgtatttctatatgctagctatgaacgttccaaaaatgaaattaagaagagttcattctcaatagcctaacaacaaaaacttgttaaaaagaaatgtaagaattgcacattgaacctacaaacattactgagagaaattcaagaaaatctcagccaagtgtggtagcacacacctgtaatcccaacactttgggaggccaaggagggaggatcacttgagcccaggagtttaaaaccagcctgggcaacatagggggaccctgtctctacaaaaaaataaaaaataaaaaaagtagccgggtgtagcagtattcacctgtggtcccagctactcgggaggctgaagtgggaggatcatttgagcccagaaggcagaggttgtggtgagcccagatggtgctgctgcattctcgccgggcaacagagcgagaccctgtctcaaaaaaaaaaaaaatctggataaatggagagacctttcatatcctttgattccattgttcagtattgtcagggtggcagttatcttaaaatggatatataaattccttgtggtatgtacctatgcaaatcacagcatgtgttttgtagaaattgataagccgatcctaaaattatatggaaatgcaaagtacctagaatagccaaagcattttggaaaaagcacagcattagaggacttacacactccgtttcacaactttagtaatcaaggcattgtggtattggtagaaggacaggcatatagatcagtggatccaaattgagaatctagaaataaatatctttacggtcaattgattttcaacaaaagtgccacgatcattcagtgagggaaggacagtctttcaacaaccagtgctgaaacaattgttatccacatgcaaatttaaaaaaagaagccgggcctcgtggctcatgctgtaattacagcactttgggaggctaaagtggtagaatcacttgagcccaggaggttgaggctgcagtgagccatgatggcaccactgcactctaaggtgagccacagagcaagattgtttcaaggaagaaggaaagaagggagggagggaggaagggatttagactatataaaaatgacttcacttggatattagacaaaatgtaagaggtaaaactgtaaacttttagaagatagtctgtgattttgaacaagaagttcttgcctataactccaaaaacactgtttataaaaaaaattagattttatcaaaattaaaaacctttgtcattgaaaagaaaccattgaaaaacaatgaaaagataagctacaaacaaaatatttttcaatcatacatctgatataggacttgcatccagaatatataaagaactcttataaatcaacaagataaacaacctagttttacaacgggcaaaaggtttaataattagacattttattgatcattagacaaatgcaatcaaaacaacagtgcaaccaaaacaatactatttcacatcctctagaatgatcataattaaaaagtcatacagtaccaagttttgttgaggatgtggataaactagaatccttatgtattgcgagtagaaatgtgaaatggtacaaccagtttggaaaatagtttggcaatttatttaaacattgaacataaaaataccatatgacccagcagtcccactcccagatatctaagagaaatgaaaacaatgaaatgtccacacaaagacttacacacaaatgctcatagcagcattgtttattatggccagaaaagtagagacaacgcagttgttcatcaactggtgaataaacaaacaagttatatgtccataaaattgaatatagtttagcaattacagttggcccttgaacagtgagaaggttagggagggacactgacccccacacagtcaaaaagctacgtataacttttgcctccccccaaatttaacttttttttttgagatggagtctcaactctgtcacccaggctggagtgcagtggtgtgatcttggttcactgcaacctccgcctcctgggttcaagcaattctcctgcctcagcttcccgagtagctgggattacaggtgcgtgccaccatgcccagctaatttttgtattttcactagagttggggtttcgccatactggccgggctggtctcaaacccctgacctcaggtgatccacccacctcagcctcccaaagtgctaggagtacaggcgtgagccaccgtgcccagccctaaatttaattactaatagcttgctgttgaccaaaagcctcactgataacatagtcgattaatacatactttgttatatatgttatatgctgttatataagaaaatgttattaaggaaatcataaggaagagaaaatatatttactgtttattaagtggaagttggtcacatcaccataatggttttcatccttatcttcttcccattgagtaggcttagggggtaggaggaagaggacggttggtcttgttatttcagggatggccaaggaggaagaaaatttgcctgtaagtggatctggacagttcacactggtggtattctcagctgtaaatggaattaactcttgacacatggataaacctcaaaagcattatgctaaacgaaagaagccagacacaaaaggctactattatatgattccatttatatgaaatgtctaagaaagtcaaacatacagagacagaaagcacattagtggctgtgtagggtagagctgggcatgaagattaattgcagtgagcatgagggagctggcatgttggcaagcatcagtaatcccagctacatcggagactgaggcaggagcacccttgaccccaggaggtcaagtctaagcctgggcaacacagcaaaacccccatcttttaaaaaacaaaaataaaacaccaaaaagggaacatgtatttttaaaaacggcgtgagtgaattttctggggggtgatggaaatgacccaaaactggatgtgatgatggttgcacatccctgtaattttactcattgtacacttacaaagatgagtcttgtaggatgtaaattatacctcattaaggctgtttttaaaaagtataatgcaaactaaagttcaaaagcaacacaaatacaagattcttaaactgaaacaggtttcagttgtatgtcctcaagtattcttacttggagagacaaagcaagtatttatgaggtgatctttttttacttttatttgtattttgagtattcaagatagaaattaaaagagcatataaggatagaatggtattaaaaagtggacagtggctgggtgtggatcacgcctgtaatcccaacgcttcaggaggccgaggtaggcggatcacctgaggtcagaagttcaagaccagcctggccaacatgatgaaacctcatctctaccaaaaatacaaaaattagccgggcgtggtggtacacacctatagtcccagctacttgggaggctgagacaggagaatccttgaacccaggaggcagaggtttcagtgagctgagattgtgccactgcgctctagcctaggcaacaaagcaagaccttgtctcaaaaaaaaaaaaaagaggtggatagtggccaggcatggtgacccacacctgtaatctcagcactttaggaggcctaagcagggtgtagcttgagtccaggagttctaggtcagcctgttctagacataacaaaaccccatctctactaaaaatacaaaaatgagctgggcgtggtagcactcacctgtagtcccagctacgttggactacatggctgtattgttcacaaaagcaatggaagtaaacccatttgtttaaaaaaattctgcaatataatattgcttttatttttaagattagtaaaaatgccattttgtttgggaatttgtgaattatctgcaaactactcatcttagtgtgtgaaaagattcttggttcttggttagagcttttatcctttttctttgagcactttctgttttccctttgaacttctaggctgttgcccattgtctcctgtttttcagacagaataaattcttggtttcatgctgttctcagtggagatgctgcctgtcacatattcatcaccttagaaaaacattattgaaatacttcatccaatttatagatcactgtttccatagctgtctcagtttcttctggttgttcatcttccaaaatcatatttaataatttatcacagattttaattttttatgacattctcaatcatttttagttatagaagaaaaaaatgttttagttggatgatatagtacctctaaaatagagaaaagaatttggcataaatgtcaaacagtcacaagattgggatttgaatcttagaccaagttgattatcagctttgtgatttcgggtaacggagtccttaaactggcatcctcgtctacctaaaagagggtgattgcaaaatttattgagctaacaaactgtaatgtataacagttgtacaatttttcttatgcctggaataagcagtagcttttataaaattatgaaatcaatttttctttcattttgagattggcactttaaaaaaatttctaagtatactttttcttcattctcctggtgtttttccatataacttaattgtttaaaatatatctagtacaaaaaaatagttaatcaacaggtatcgatttatacctgctatatgccaggcattctgtgatggacactgtagggatttgtagaaggatgtacgagtgagtgtttgccgggaacacttcctcccttagggaaacacacacgcctgaagtaattggggaaccactcagtgcataactttgcatacctacgtagcgggatcagctgtagtgttattacgaaaggggttctgacccaggtctggaagacttcatgtaggaggcattcattgtgccaggccctgcataatgaggattacttaggattcgaccagaaagagaaaatcctctcagtagacgaaccacatgaatcaaaaatctggtgagaggagagggagtcggaaggaaatggagaaaatcaggtaactgcaagtagagagagggagttggattctatatgctaattgttttttgaactcttgttagagctccaagcataaacaagacacacatggtgcctctttccatggagttataacaagcagagaagatgaacattgagtacgaagtcatgactgtgggaagtgacttaggtccaaggggtcagagaggaatgccttgaggaaacagcatccgagtcggagttgaggagttgagaagagtattctaggccaaaggccccttgtaagtgaaggatctgaggtggggaaaagcaaaacaaaagtaattttaagtacaggaaaaaaacagcacagctcaacatggtggatagggtaatagtaaattcaattcagagcagaagtgtgcctaaagcagggactgtcgcttagtaacacgggaggatttgaaagaagggaggcgtggtctcgatgaggttgatgcggcctaagctgtgctttccagcgctgcactggggtgtgcagtctcacaccggcagcagccacagagccgggcagccggagccccagtgaatgatggcagctgtctcaagcagctagcagggttcctagcttcttctctgccatctgattgggacctggaaaaccagcaggaagcattgggtgggagtgtggagggaaccagtggtggcaacagaagccccacaggtgacgtgtggagaggaagagtggagcaggaaggcacgcgtcctggctgctagggttcttaatggagtgggtgctcaggatgagagggacagtggttatagaaaggtcctgtttcagtccagcgagctgcactagctgaaagcctgtcctaagaatggggtgagaagtgcaggttaagtagcacagagaacacacacactatcagaagcttctctgagtctcgtcttttcagccaggcattcacggtaaatctccagaattatgatcctcttctgactttcgtatgccataactctctgcctttctgtttctgcttatactcagagaaggtcattatacactggcaactccttgctttccaggctcatcaatgtgttactcagttcccttcctccacagataacccttctcaccctgtagggcagtgctgtctacagaaattcaagaaccctggtgtcagaatcacataagctaattggaaagacactgattccaggatcctccccccaccccaccccagacagtctcaagggatggacccagagacccgtgctttcaccccgtcctgctcctgtgccagttttgccctcccttcatcatagggcagaagcagtggtttggcagctctctgtgctgtgcattttgatgtgaactagtaagaactggtaaaagtcaaaaggagagaaacccggatcattgcccttactgagtttacagtccaaggctcctgcagtcttcagagccctctctgtgcctccatgacagtattgtccttttcctttcatgtggtcattctttgcatactggactggcagtaaggaaaagcccagggtttcatgcagttaaagtttgtgtcatgtctttcggttctctgcagtggtcagcagaatgccctgaacaaaataaatatggcttgctctgaaatgattttattaagttatttagtttggttgttaagctttcttttcatttaaggctatgttttatacctaattttaaaattccacattggaatataagtattccctatatactgtatgtaccaatacaagtgtaagtattttgttttcttgccttgtcaaccaagagcttggtcctgtttattctaaagcatgcccttcacctggtgactgaaggacgtctgttccagtgccctgtccatgacgtcattgacaggaaaggctactcattgtgtggtttcacttgttacctctggttagcagagtgagttctttgtcatgtagttagcggatctgtggtagtatgaaggggacgttatgggttcttggatagtttacaataatgcatacttgtctgaaaattatggatttattttcctggtttttaaagatttatatagactttactgttattgtttaatcatcttaagttgtgttaaatcactgtctgatagaattagctgtagttttatctgtatgtctgtaagaattttgtggacattctttccattgttgaaaggaagatgaggtaatttagataaacatgtaaccaaataataatgttgctttttaatctttttatcaatcagcaatatcagatgcttcttactgggtttttcttttttttttttggatggttgaacaaaattagttgaatggctcttcaccttttttccatcatattctcttaaaaacgtatttagctctatatttattatctagcattgaatagaaaaatgtcacactttgtaaaatatagaaaattcactgtgaatacaaaaaatactttatgaaaacaagtaaaaagaaatcacaaacacattgtagaatacctttacgtatcagtaatttgggccacttaacgtaaatctattttctttattctaaatgcctatcaagaaaatgagtaatataagtatactattgttttaccgtttaaagttttttagcttctaattgaatatggatttaactacctcagaaaagatggagcttggaattgaagtgtactgctgtggcaggaagtaagggtttaaattgcatttatatttttgcctgagtttgcacatgcttctactgtatcttccatctggttcatacatttttttaaaaaaaattcataattatcaaaatctaaaactgaaacacttaagcagtagctttaaaaaaataaaaatagcctttaataaaataaatgcaatggttccattttaaaacttccataagctcttaattttcttttttctttaaatctgaagtggaactggagagtgccttcaccagcagatacatgagactgtcctctagccttccttgcagtctccgtgtcccaagtgggttgtttgaagttgtcacttgatttacttttttgtcttttctgtgcttctctttcctcactggcagcagaagaggaggaaggtaaaatcatataaaggatctacatgggtttgaaatactgttttagaaatcagtttcctaggttccaggacggaggatgttcttaactgatagaagttcatatgatgatggacctgaccttggagttaggatctcaagagttggtctcactggcacagctgctaaggaggatcatgcagccttaggctataggtgttagaggtctgggtgaggatctctaccccgcattgatgcttacagtgcttctcgattcaggatggaagtggaggacaaggcaggggtattttgggacagtccttttgctctgcaggtctgtcttttgtattacagagtgtttcacctcccaggtgtggacctgctaagtgctggtggcacacctctgcgcctgcgacagcatggagacccctcccacagggcttccagacacccccaggagagctttactgcccctgttgagacccactgtcagatgcttaagtttgaggagcgtttagaggaagaatgaaaagggacccctcattcgtgaagggagtgggaatggcaaaactcatgaaaaaacggtaggcttttatgtttgcctacatactaacagttctgctgttctttatttctttctgaatttccaagtttccgtttggtgtcatttccctttttttaaatcatttcatgcagcacagatctcctgatgatgaattctctcaacatttatttatccgaaagtgtctttttttggccatcatttttcaaagacaggtataaatttttgtgttgacagaattttcctttcagcacttcaaaggtgttgtttgttgttttctggcttacgtttttttctgatgagaagttgttcccttttatataatgagtctttaaaaaaaaactttactttttagaactgttttacatttatggaaaaattgggaagatagtacaaagaatgtctgcaaaccctgcacccagtttcctgttaggtaccatgtgacatgttaatttgttgtaccacagggaactaatgttggtacataattattaaccaaagtctattactttattcatatttccttagttttcacctagttttttttctgttctaggatcccacccaggacaccacattacatttagtcatcatgatccattagttttctcttggctgtgatacttttttagactttccttgtttttgatgaccttgacagctttgaggactgctggcccagcatgttgtagaatgtccttcaactgggacatgtttgatagttttcttataattaggctagggatatgggtttttgggaggaagaccacagggatttgtaaagtaccattagcatgcatcctgtcataccaagtttatgtgctatcagtgtgaagtatcaccagtgatgttgactttggtcacctggctgaggtagtgtctgtcaggttctccactgtgaagttaactcttttccccctgccatatgataacttttgacaccactgtgcacagcccacacttaataagtggggatttatgctccatctcccttagggtagagtatctacataattatttggaatttttctgcatgggtgatttgcctctgctccatttattaatttattcagtcatttatttatatcattatggacccatgggtatttattttacactctggattatagtacagtacaactctgttactcaaattatcctagctttggccactggggattctttatgttggctcctgtgtcctttgacatgcctccattgttgtgggtgttggatttttgtttttttgttttggtttagtttagtttttgagcactttcttactttctggtgctgtaagatgtgccaggctccttttgcatatattttctgccccttgagcattattgaactttatcagtaatgacacatcagtcctagaatcagccatttctccaaggaaccctggtttctgtttattggagagtggtattaaaaaccaagatccgggcattagatgtgatgttactgccgagatgcctgttgcttctgggccttctcagctgacagaacaaggaaatacatgcgtgtatcctaactcctgcatatctacatatctataaatatttctatctgtaatcatctgcattgatattaagctaacaatgagttcatacttatgtctccaattctaatatattgccacatggatcattgtagctctctctcctttcttatcactaaactcccactcctaaatgaaaaacctggctcttgccatcctacatctatttacttaattattcagctcactgaactctcagatttataaattctttaatgtaaataacagatttgaaggtcttttagagttctggtgcttggcgtgaaagcttctgtagcccactttcctcccaacctgaatctcccttggttagaatgccgaactctctacttaatgtttcttttcccacccatttaaaattcttttatcaaaagcttgtaagaaagcataaatgtaagcatcttacttgaaagaggcacaaaactagggaggtgaaatcttgaaacatagataagaggagtattccttaagtcaacctgcaaatgggttgtttaaaactagtatagcaaaggtttgtggagacgtggcttaagtggagacgtggcttaagtaacagttcaaatggagaaggagaatgcctgggaaccttcagtcacgtgagctccgtgtacattgatgtgtgccgtggcttccaaacattacattggaatcttaggctgtatccctgtggccataatcagatgtaaggagatgttagtgtcatgctactcttgatactgaaagcattgtatttgtagttcacatttacgtaagtgaagacactggaaaactgatgtccagaaaagaataagttaggaaagctctgtacacagggtcttatgaagcataatttagaatttcagcatcaaaatgaataacgttagtagctgtttcaactgattgaataaaataggaaccatgaatctgtactgatttaaaaagtaaaagtaaactgaaggtttcatgaggatggaatatttacctagcctcaaagcacctccccacagaatacatactaattacaaaggggaaaagaggaacttcacagtgcacatgcctggaggacatcacctttaccaaattatcaaagtgaactttactagtaatggcaaataaaaaaaagctctcggccgcctggtggtgtacactgaaaagagcgcagcctcacctccgtgttgttactgccagcggcacctgacctgaatctagccacagggaaataccttcgacagatcaactgggccgaatgtagtcttcgaaagtgccaaggtcacaaacaccaagaaagaccgagagacagttgcagactgacggagatggctatgacgtgacgactgagtgtagcatgtgactcggacctgggctgctgtaaaggacgttattgggaaagtcgcagaagcttggatggacttcgggattggatggcagtgacacatcagtgttaagctccttatttgggggttgtattatgtttataaattttgtttgtaggaaaataccacatattcgggggtgatgaggcatcatgccaggaacttactcttgaatggttctaggttttaaaagtttttatatgatatttcgaatttttctgtaagttttagattctttaaataataataattattattatttttaaatgaatgatttgggactctagaattagtatggaaaaaagactgaagtggggacccagggaggctgtctttgcacattttaagaattgttatgttgaagaattctcattggttctgggatgctcaacttaaagtgggaatgtttcttgtattccatgacatcttagagttgcttgacagatttttttcttcatgatacataatgatgtaccttgtggttgatggtattttatacatcaataaatgaaaaacaggtttattcagtggtgtttttccggaggagagaaccacgagccacaaacagatgtttagaaatttagattttggccaggcgcagtggctcacgcctgtaatcccagcactttgggaggccgaggcaggcggatcatgagatcaggtgatcaagaccatcctatcaggtgattgagaccattttggccaacatggtgaatccccgtctctactaaaaatacaaaaaaatgagccgggtttggtggtacgtgtctgacattgcagctacttggaaggctgaggcagtagaatcagttgaacccgcgaggcagagattgcgccactgcactccagcctggcgacagagtgagactccgtctcaaaagaaaaaaaaaattagattttaaggaaggaagacctaagacttaaatccaggtgacctgtggacagaactactcagttgagaggatcagtaatttgtgggagttcctgtgttgtgttgaaagttggcaacccctggaaattcttcactgagagtctgtggctctccactgattggtggcttgtcttcttcagtgcccaccccccttctgcctctgtgtgtgaaggaagaaagctttctgttctgggcaggtgcttgctcctgcccccttttctttctcttgacatacagtcaagagatagcataagaagaaaagctgacattcaagtgctgtactgtggccccttggccctacttgtatgtgattgaagaacttcctgttcaaggaagaaagaagagaagacccttggcttttggtgacaagctgtagcccactgtcctcaggaattatcagtgagtgactaccactcagtggcttacacattcggcttcccagcagacgcatggcaggaggttcaggttcaagcatttgcaaaattacaggttggtctttgctgtgcgtctgtgggtgctgagggatcctgtggtggtggcgtacagcacgtccacaccagtcacttccacgtggggagacttcactttcagttttgtgcagcagaccgcgttcttcctctccgtagtcacgtgcttccccgcctgtcactgctccccgttcatcagcggtcctgccaccatcctgggcaacttgagaatccacctggaaagtgaacacctaaccgaaaattccttccacaggcccgtcagtcattccacttctccaggagcctggtcccatagctgctccctgggcctcatcatctcccagaattgttacatctcgagttgcaaactcctgtgtcctgtgtcctgaccagtgcctcttccctttctccccctctcttcctgtcatttagttttgttgaagcttccagttccctggaccctttcttagttttctcccagtttccctcctggcttcacctctccgtcctgcccagattgcatgaaccactattccagtcactttgcccaacagtttcactgggtccgagagtgttcaccgttccgtgactcagttaccctcagggccatgtggctccccagtgcttgagtgtccagtgaaagagtttgcactttatttttctgacagaagggatacatcaaaggcttttgaaagcagagtgacagcaggtctatattttaggaaaactactgacaagtctcagcaggaaatctataattgatataacctccatctgtcagaattattgctatattcatttcctaaaagaatgtagaatgtatctgtttttcccccttgagttctttaagggatcagtgaagagaagaatgaagattgggtttgaagaactgaaagttgtggatgaacatttgagaaggactttcattaagtcagtggagtgagatgagaagtcttgggatcaggagccagcagtctccctgagacacaggcagccagggctctgccccatgtgcagcttgaccctgaatacacctagctgttgcctcagcagcagtccttctggaacttcaaagtgatttttttttttttttttgagacagagtctcgctctgtcgcccaggctggagtgcagtggcgtgatctcggctcactgcaagctccgcctcccgggttcatgccattctcctgcctcagcctcccgagtagctgggactacaggtgcccgccaccacgcccggctaattttttgtatttttagtagagatggggtttcaccgtgttagtcaggatggttttgatcttctggcctggtgatccacctgcctcagcctcccaaagtgctgggattacaggcgtgagccaccccgcccggcctcaaagtgattttaatctttttcacttaaagtatatggtgttctgctttacgtataataggttatataggaataactaatgccactgtgagtaaccaatagtaaaaatgcttatggtaaagccacctctctcctcttgcagcctggtgcctcagacagctcatttgttctcttcctggatcttcctttatcagctgctcagctacactgggcttgccccggggtttactcccaggaggagtggagggaagccaagagggtgagggcatagatcagactcttcccagctgggtagactcactttctaaactaaagcataaattcttttgtagctggcaggactgtgttggtcagcagatccctgggcattttctgagcagtgggcagggggcgaagagagaatgggcatccaaaaatctgtggttagaggccttttgattttcttcccacaacattttcttttgctttctgtgagtaataatacaagtaggattagctcatcatatggtttggctctgtgtccccacccaaatctcaccttgaattgcaatccctataatccccacatgtcaagggtgggaccaggcggaggtcattgaatcatggctagtgagtgagtctcatgagatctgatggttttataagcatctgacatttccccaacttgcactcgttctctctcctgctgccctgtgaagaggtgccttctgccatgattgtaagtttcctgaggcttccctagccatgtggaactgtgtgtcaattaaacctcttttctttttttcttttcttttcttttttttttttttgagatggagtctcactctgtttcccaggctggagtgcagtggcacagtctcggctcactgaaacctccaccacccttgttcaagcaattcttctgcctcagcctcccgagtagctgggattacaggcgcctgccaccacacccagctaatttttgtatttttagtagagatggggtttcgccatattggctaggctggtctcaaactcctgacctcaggtgatccatcgccttgatctcccaaagtgctgagattacaggtgtgaaccaccacgcccagcctgaacctcttctttctcaattacccagtctcaggtatttatttgtaacagtgtgagaacagactaatacagctcattacgctgcagcagttactgaacatctgctgtgaagcctgcaggtagtttgtcattttttgaaagaagaaactgaagttcaaagaggttaaagtaccatgctgggatttgaacctagaccctccgattccggagcccaaaggagcttaattctgaggttccttctgttggcctctcaaaactgattttgtagtcaggattatagcagtattatcatattttcccactttttttcctcattaaaaaatagaattgatggggatggggggctcttttccgaaaaactgcccacccagcatttctgtttttttaatgggaaacaaagataagtagaaagtgttgttaatgcctttgattatagaatcagtttacaaaatgtagaagaaatcacagcattagggaattagaattttacaaataccattgtcgtaacagattcaggcaaacaccagtggatgctgagagcattgagtgaaaggtttttggggaactggctagtcacacaatctggaagtatcagcccacagattgcttattaattaagaggaaaacatttatttacagtgaggaaacctggcagataccaaaataaccaagtcataaaatttgccaccaaaaataaaggtacaacccggcctgcacttcctgaagtgacgagctgaggagggacacgccatcaccttgtggtattcttactagaaatatttaatttggagatctaatcattaggaaacagtcaaatccagattgaggggcatggtcagaacatctggattggactctttaaaaaggtcagtgttgtgatgaatggaccggaagtgactgaggaactattctagatcaaaggagactaatgagacatgacagctaagcatgatgccgacagccccgattgaatcctggacacaaaactaaacaagttaaacagctattaaagtcatcaccacagatacctgaaaatggaccatctattaaagaacacagggttaaatttcttgaggataagtaaatgaattgtggccacgtagctagccttgttcttaggagggaccgtggaagtatttaagaataaaatgtcatgtgtttgcagtttactcttaattggttcagcaaaaataaatacatatagaaaggacaaaatgttgacaaatctaaataaaaggtccatgagtgttctcacagtattggaactgctctatgggtttgaaaattctcaggatgaaagtggaaagaatagaattgtttattaaagtagccagactcaagcagtgtggaaacagaagttcctgttaaagaataacagtgggggaagtttctcaagaaaatagttggaagcagggatcacagatgggctttcactggattgccatctctgacagttagtactggcggccagacgtggaagtgcgtgggagcgtggccgcatccgtgacttactagcagtgtttgcccagggcctgggacatgggagtggtggggcatgtcccaaatgtgctttgatatttacagcgttacagtctaattattcttcactcttttcagtcactgcctcctctgaccggccctttattgtgaagcctacatttcctttggcgtgaaactgggccagagctcctcagatccttaaaagtcaagtgtctgaggcagctttaggtcagggtctttgagccctatcaggctttaggggtggagtatggggagaaggccctttctcctaggaggggactcctatataactttcgccagattctgtaaaagatttaagacctaaaactccagtcctttgcaagttggtggcgggctttcgttctgctgtcctcctgcccgatcggcagggtcgggctcctctgcccggctcttctctgtgctggtgtaatgacgccaccgcgagcggcttctcttcctagtccaaaaggttccccctttgctcctgagggcgtgtggatttttgcatcaagagcaggtaattttctactctctttaagaggtgaaaggagcctgatcatagtatgtgctcaataaatattgttgaatggatggttgaaataattacacacttcttttcccaaacagctttcccgttgaaattagttggtgttcttatttagtgttctttgaatagaatcacatggattggtttccttggctacctgttcagctttcctttccctactcctttccctactcctttcctactccttttcctactcctttcctactcctttccctactcctttccctactcctttcctactcctttccctactcctttcctactcctttcctactcctttccctactcctttccctactcctttccctactcctttccctactcctttccctactcctttccctactcctttccctactccttccctactccttcccctactcctttcctactcctttccctactcctttcctactcctttccctactcctttcctactcctttccctactcctttccctactcctttccctactccttttccagcttgagtcttcaagagggagcctcaactgatttctaaaaccgtttgtacctggtgtgattataaagcaatgagactgattgtcatatgtcgtttgtgggatccgtctcagttactttatagccatacctggtatcttataccacagatcatggcccgttgaacaacattttaagagatttctaaagggaaatttaaagcggtttagcattattttgtgattgtctctaatttactgatcacaactcttatttcagaaaggtaattagatattaattagatgtttattgcttgctttaattttatagttttttgtagatttttaatcggtattctggtaaactgctgttctaataaagtggctgtaacaattttgagtaaggtagtaaaaaggtatatgttccattgggttacattttccataaaactccttttactgttgtatttctcttcttttttttgagggtcttgctctgtcacccaggctggcgtgcagtggcgtgatctcagctcactgcagcctcaacttcctggactccagtgatcctcccacctcagcctcctgagtatctgggaccacagacatgtgccaccatgcctagctaatgttcctgtttttgtgagagacagggtttcaccatgttgcccaggctggtcttggactcctgagctcaagcaatccacctgccctggcttcccaaagtgctgggattataggcatgagccaccacgcccagccctgttgaatttcttttcagttgcgtgtagtcttctgtgactgcatgtaacacaaagatggttcttttagctaaatatggtaaatgaaacatgtaaaaccaaatatttcaatgtgttattcattgaagaaggattgaaaaggacaagttttggggacttctgcttgattgttttgttggtttacattgatatgtacaaaccttattcaaattcaaataagtggttataattttctctttcccaaaataaaatatttatttcccttctaatgacccctagtctctctcaggggctctctggagaaggcaaatgtagaagctacatgttgccaccggcagcttcagcttatgaaaggacaatcgctgatagattgatagaagtttctctgtttccttaaaagacagtgggaagttatttcctttgtggaggaggaaagggatagcagtttcctgctgtccataggaagaggtattcaattccttcactgttactacttctggaaattatgtaggggaaaggtctaggtaactataaggcaacttaagactgtcctcgtaattaacttgcatagcctgtgcttgtgggcagacctctggacaactgttagaggctggaggtatttcgatgccaaactggtccagaatgttgaagcctggacctgtctctggaacgtttgatttccagaagagttctggggtaaactagcaaggagcctcaactccactcaagtctggacataagacccaagttagtttcagatgtcactaataaaaggtggcaccatttggcactttgtagctctgttaccagctgtgtgtcccctgtctcagtgagattagaaagcttggtatcctgtacttgtttttgttcctggcactagttctacagacagtgggtactccatgaatgttcctagattagtgcaagaagtaccaatttatgctataaaaacagcactttactccatttcttaaggaattaagactttctgaagatcattttaaaatagaaaaggttttacagtgtaaatctaccatgatgttgatacacttctcttgctgtataatgttatgttgctgtctgttgtcacatttggctggtttaataatctttttttaaaaatgtagttgtcagacaagttaatatggttcttaacactgcagtcgttctatgccttatgtctgtttaagtcttaagtaccacacaacaaattacatgttcctacttggtgccagcatacccagctgcatctacatttcagttgagaagtggagtttgcataccctttccattaccagacattatagtagttacctaagtagcgtgttgatacatttgatgtttccataagttttaaatgtcacttgagttatatatttattttatattgcaggcactggagatattattgctgtcatgataacagaattgaggggtaaggatattttgagttatctggagaaaaacatctctgtacaaatgacaatagctgttggaactcgaatgccaccgaagaacttcagccgtggctctctagtcttcgtgtcaatatcctttattgttttgatgattatttcttcagcatggctcatattctacttcattcagaagatcaggtacacaaatgcacgcgacaggaaccaggtgagctcagtactcaacagtgattggttcgtaacagccagagttcacagtcatctgtcgtgaccatgcatcttactaacatgttttttcttttaaaaaatgttgttaccctcactcagtcattttaatatgttggaaacgtctacatgagtatttaagggatatttaaaataacctaaaaggtactaaatttattgtgatcacctagaatattctagtcaggtagatagcttgatatcatagtattatctagataattctgttaatttggagaaatagcacaaagttgcatttttaaaccagtaactttggatgtttctgcaaatgggaacttggaggggggttagggagacttcactcttccccttcctatgtgaaattctttcccatgtgaattttgaactgggaaagtattatctattcagaaaatgaaatcaatgaaaaacctctgtcatctaagctcagacatggggtaagggtgagtgggggaagaccaatagaagatgtctgtctatgtagtcatcctaggagttccactgacagcgcatctattttggttgagtgaataaacctaggaaaagcagtgtgcttccccggtgtgagggcctggagatggtggccctcagttggtgactgagtttgattgatgtgctgtggacagaatacacaccctaggtgccaggttccaggtgttaggtccctctcctagactttttgtgtagaaaactaagaagtgacttgcttggagagtgatttgaagccagtttttgtataacgctgtcttctcctaacatggtacattcaaattcctgtggggatgggcacactgggatttttatccttcctctttctagcggaaaaagcgcagactttggcatggaacaggtctcagctcacatccctcctgcaccaccagttcaccatgacccctcaccctgttggacagtttcttgagcatctcagcttctttctcatctgaaagtagatataaaacacccaaacgctgactgtgaaagtagatataaaatacccaaacgctgactgtggaagtacatataaaatacccaaacactgactgcagtttattgaagctttctgtgccaggctctccctgtgcacttttaattttttttattttgaaaatttttatatttgtaattttagacttaacaaaaaatttgtaagataagtggcaagtattcccttcactcagatgctacagctgttaatgttttactgtatttccttttctatgtaactatacttttttaatttaaaaaacttttttttttttaagagacagggtcttgccctgtcacccaggctggagtgtggtggcagtcatggctcactgcagcctccagctcctgggctgaagctatcctctggcctcaatcttctgagtagctaggactgaaggtatgcaccaccatgactggctaattttttaatttttttgcacaggccaggtcttgcagtgttggccaggctggtctcaaactcttgggctcaaaggatccgcccaccttggcctcccaaagtgtcaggattatgggtgtgaacaccaccctcaacctttgtatatataccttaacaaaactatttgagagtaagtttgagatatgatgccctgttacccttaaatactttgttatatattttataaaaacaagaacattctcttacataaccatagtgtggttatcaaaatcagtaaattaacattgatataatacattatctgattgatagaccttttttgggttttgtaaaactggctcaataatgacctttatagcaaagaaaatcctggattgattggagctcattggattttgcattcagttgtctcttcttacttggttttatgacatggacgtttctgaaaagtacagatcaattattttgtatttgagtttatccgacgtgttgtgttccttcgtgattagtttcaggttatatgcgttttgtgaaaatgtagatttgcttgcatttgtaagagataatacaaatacaaagatgtctcttatccccttcactcatttctccttgtggtaacaacatgtataactgtggtcagtatcataacctggaaattggcatggatgcaatccactgatcttcctaaatacactgaaatctccccacctctccagtttaatgtgtacttatttgtgtatgtgtgtgtctgtctttagtctgtgtagttttatcgcatgtgtagattcacatgaccaacaacacggtcaggatacagaccagttccatcacaaggaacccttgtgctactcttttataaccacagccacctccctccttcccccttccctaatctaccaggaatctgtttctcatctctatagttttgtcatttcaagaatgttaaataggtggaatcatgggccaggcacggtggctcacacctgtaatcccggcactttgggaagccaaggcaggtggatcacttgaggtcaggagttcaagaccagcctggccaacatggcaaaccccatctccactaaaaatacaaaaatgtagctgggcaaggtgccatgcgcctgtagtcccatccattcaggaggctgaagcacgagaattgcttgaacttgggaggcagaggctgcagtgagccatgatcgtaccactgcactccagcctgggtgacagagtgagactctgtttcaaaaaaataaagaaaaaaatgttatataggtggaatcatatagtatgtaacctctagagtttggaattcttcacttcctcactcagcataattaccttgagatacttttttttttttttttttttttttttttgagatgtagtctcactgtcgccgaggctggagtgcagcggctggatctcagcttactgcaagctccgcctcccaggttcacgccattctcctgcctcagcctccggagtagctgggactacaggtgcctgccaccgtgcctggctaattttttgtatttttagtagagatggggtttcaccgtgttagccaggatggtctcgatctcctgaccttgtgatccgcccacctcagcctcccaaagtgctgggattacaggcgtgagccactgcgcccggccaagatactttcaagttgttatgtgtatcagtcatttattcctttttatggccgaactatatcccatggtttggatgtaccaccgtttgtttaattgctcgctcattgaaggatatctgggatgttttcagattttggctattacaaataaagcagctgtgaacaatcacatacaggttttggtgtaaacatgagttttcgtttccctgggataaatgtgtaatttctgagttcagtgtaaattccaagagtgaagtttttgggctgttaagataagtgcatatttagttctgtaggaaactgttagactcattttgcaaagtggccataccattttgcattcctgctagaaatgtatgactgatccagttcctccacactctcgacagcacttggtgttttcatctcttgtgattgttgagttgtgtagtaacatctcttgtggttttagtttgcatttctctaattagacattttttatgtgcttgtttgccatccgtatatcctcttcagtgaaatatccattcatgtcttttgcccattttctacctagattgtttttcactgttgaattttgagagctttttatgtattccagatacaagtccttcgtcaaatatgtggcttgcagagattatctcccagtctgtattttgttttgttcaacctcttaacaaggtctttgaaaagcaaaaatttctaatttttatggtttattaattttttcttttatgaattgtgcttttggtgtcaagtctaaaaattctttacttatccctagatatcccaaagattttctactatttttcctggaagttttatattatgttttacatttaagtctgtgattagtttatttgaaggctttcctgttttctaatgtaagaattaagtgctataaatttctctctcagcacttctttaaggctatgcctcacatattttgatatgctgtattttcattttcattcagtcctatgtatttttttcttttgagacttcttcttttacccatacattactgagaagtatgttattgaatttccagtagtttagatattttacttttttttttttccttttgagagagggtcttactctgtcacccaggctggagtgcagtgatacgatctcagctcactgcaacctccacctcccgggttcaagtgattctctgacctctgcctcccgagtagctgcgattacaggcgcatgccaccgtgtccggctaacttgtattttttggtagagatgaggtttcactgtgttgcccaggctggtcttgaactcctgacctcaagcgatctgtgcacctcagcctcccaaagtgctgggattacagacatgagccactgtgtcctgccaagattttactattatcttagtgttactgatttctggtttgattccattatgctcagagaaatactctatgatttcagttctcttctgtttcttgaagtttgttttatgatgtaggatgtagtttgtcttagtcagtgtttcattggtgcttagaaaaaatattctgctgttgggtggcatgttctctgggtgttaattagaccagtgggcacagcttttcttcctgaggagccgggctgggagagcctattcccactgggctctgtgagaccagggtgggaggaggattgtgattttgcccttggcgcctggctggagtagaatgaatattactgcaagtgttttctgatgttaggccatccttctcttggtactttggctagcggagttgggcttttctcggctttttctggggtcgggtggtgggctgctctggtcctgttggctgttccaggttggaggcttctgcagcacattgtcaggaatctatgggggaagtaaggaagcttggaagccaccacccgtttctcatgtcttgagggccccaggcagcccacctccttttccctcctataacatgtaatatacctgttaaaaaaaaaaaaaaaaaaaactaaaagatttgtttttaaaatatgttgacatacgaaacactgaaagtaaaatgagaaggagctgctctggagtggtgttgttgacaggcaagcctgtgttagtggactgggtgtagctcaccctgaggacgttggaacaaaggctcacggttgtcccaggagcctgctattggaagatagtgctttaattagcacccagtgtggggccggggctgatgaaggaggaaacataatcaccatctggtgcaggccacaaactgcgagcttgtttcctagcatttattttgcggctgactgcatgcaggatccttccaaagcgtctctccagatgctactgtggtggaaagtgatgttctgaccttttttcctccttccgttttccccaaggttgacaaatgcttgatgaaatttttatgtggcttaaaaagcttagcttattaaagtttaataagaaggtggcagcagctagactggttgaaacctttggctattttaaaagagaagccataatattagcaaaggaaaaccagtgagtttaaggacagactctgattttctctcacaaactgtttttgtttttgttttttgagactgggtctcactctgtcacccaggctggagtgcagtggcgcgatcttggctcactgcaacctctgcctcctcggcttaagcaattctcctgcctcagcctcacacgtagctgggactaaagatgtgtgtcaccatgcctggctaatttttgtatttttagtagagatgggatttcaccatgttggccaggctggtctcaaactccttacctcatgtgatcctcctgcctcagcctcccaaagtgctggaatgacaggcatgaacctccacacctggcccccacaaactgttatcatgaagcagttcttcctgtagaacatgctaccaaagagatccatatattgtaaataactttctaagcatagtaaaatgctcacaattgagaacattttgcatgtgatataagaatctaatgctttggcttttcagttcatgactaagtgtctgtggtttgctcttcctggaaaactgtcagaatgtatctaattactatctataggtgtagatagttcaaactaccactgatggtaaacttaaatgtcgctgtcaaattaagtcactgatagttattttacacaaaacggtagatgtttgttacctttattttgaataaatgcttaaggattttctgaaaaatgtaaaatgtttaacagttacatggttaatattgcacctttaatttcaaagtggtcaaatttaatttctaaagcagaacaatgaaattttcattttactgtttaggaacggggcagatgtaaaatattctgccacttaatggactcctgaatatttagaatgtattcttaaaacttcccagtgaaaatgcatgtgctttttaaggtatttaaaatttgtaaaagcttcttgccataacatgtgtatataatattctttgactttataagtatctcagggttgctgaaatgaaatacactcttattgcccattttcatcatgaaaggtcagtagctaattggagaatgcatttgcctgtcagaatgtggaaatatatggaacattcctgtgtcagagaaaggttaaaactttgcatgagtacagttaatctttgaaaactggtgggttcaaaaggtttttttttttcttccacattggaagagaggaagtattgtatatactgccaagatttgtcctacagaaaaggattatatggccccaaaacagacttcttttgtcattttagatggcagagtgaattttgttcattatgtttcttaaggattaacaattccagaagaactggaaaggggaaatagatgtttgagctgagaagttattatcttaccagttttaaaaaaatactgcaaatactctgataccttgtttttcatgtcctgccattttgtaaataaataacacttttcatatacagagactgtattatataccttctaaatattacatgtcaggggcttaagatctgatttttttaaagcacaaaatatgctcttaagatcatagtgtttgcaagataattcatttctatatccttggggtttagcatggggcctggcacatcacactgcctcagtaaatatttcaatgaattcaagaatgagcttaccttctgttgcaatgacagatgcagtcaaaatactgtgtggtataggagttattctttgggggcagagtgatattactctcagggagtcaaggacacttcacagagaaggtaggttgtgaccttggagctgaattttaaaggatgaattaagacttcatcagatggagatgaaggagagtcaggcaaatggatcattttccacagagagatgaaagagttgaatgactgaaacatcaggaatagtgggcaggagacttgtgagtgttgagctgatattagatgaataaattgtcactagactatgaagggcatgaatcacataagaaagttaggctttattctataatcaatatggtttctgttggtgttgttgttgttgtttttctgagacagaggcttgttctgtcgcccaggctggagtacagtggctcgattaacagctcactgcaagctccgcctcccaggttcagaccattctcctgcctcagcctcctgagtagctggaattacaggtgcccaccaccaggcccgactaatttttgtatttttagtagagacggggtttcgccatgttggccaggctggtttcaaactcctgaccataggtgatccacccgcctcggcctcccaaagtgctgggattacaggcacgagccaccacgccgggccatcagtacggttttttagcagtggagtgatatacaattcttttctggtgcgagagacttagggagaaggagctatgaaaagaggaaatattgaagagcaaaggaagatgatattaataaaataaggttatgtagagaggagaggagtgatctgggcacaggcagatggtgtcttgcaaaagagttaacagaggcttcttttgagaaaaaaaaatgggaaaaaatggtggtgaatgaatgaaggagggtgcagactacaaggcactttgcattggggaaagattttatacctagatttcaccagtgtttacaaaaagaaaaccctactctgtgcagatacagacttactctaattctgtgagagagttctgattgccgaatggcaaaacctgagatgaatttcatcaaagtgacctatcctcaatatactctgaaccatttggctttgaaccaactattcctattagattaagccgtaagaattgttttaacttgttttctgccaattcaaacattttgtcactttgctttcaaatatagaatggtgtttattgttgcagctttgaccagatgagataagataatctggcccctaacaaacccctcaagctgtatgctatagaaagtcttttcagcattttatagtggaggaagaactgaagtggaaaggagatctatggtcctagtccgaatacttttagtaacttcagacagatctcctcatctctttctggggcttggtttttctcctttgtaaaatgatgcctttctgtggttttgtcatttctaacattctgtgtgtgatgaggtgtaaatttgaggagttttattattaaaggaatagggcacagtgtgaagtacggagaatatcagtgagtgggtagcgtattacgggaaaatgctttgaaaccagggtttgtacttcatttagtgagtctcaaactttagtatacaaaagaatcatgtgagagctccttttaggggctggagcactttttaaaattgcaaatttccaagatcgttcctccccttaattcagcaagtctggatagggcctacttactagcctttgatgtgggcaaattatttaatctctgcctcaatctcctcttctgtaaaatgggatattatagttcttttctcataaaatgattgtgacgataacacgagtcagtacttgtgaagggcttagaacagtacctagcacatggtatgtaccgaataaaccttagttagtatagattttattattatatattactaagcattcaaggtagatttaatgcatctgccccatggaccacaccttgaaaaacagtgacttaatggcatggtgtttaggtgaaggtaagagactttaataaaaagtgatcttcatggaagaattttgtacctcatcgtaggtacttgagagttagccggatgcaaatagacttagaatgaaaaattttaaaaaaatagtggcttttagacagattccaggaagagatcaaattgtacacacatacatagacacttatacctgtcacaggtttacctgtcgcaaagtgatgggaaatgttaaaggactgattaaaaactcaaaggataattcagaagaaggtagtaatactgaagccaagtccaaagaaaaattacagtgaaggtattgacattaatacctaacacagagaagagatattttgtccttgtgctataagaggtgttcaaagttcagaggtggaaaatatgatctacctaaatatttgtaggtctctgattagataacctacatgcattcacgtcagcttgctgaagactggactgcttccaccagcacctgctctctgcttttggctattccataatgcagtgtgatggcaggcgctctcacacggctcatcaccgagccagaagtctgggggcacctctcctcaaacccccctcttcgtgcctccatgtcagtcatgaggttctgtcggttttacctgctaaatctttcttgactttgcgctcttctttctttacctactgctgcttgcctaattcaggcccttcttgtctctgaaatattagagaccctacctggacatcctgtggaggcaagattttaattctccaagcctcaaatagcatcaggaacttttctgttcagaactctttggtagaattctgatctgaacagaatggaagcaatgagattcttgtaaaatctcctcaaattccttaataataataataataacaacccagatctgagttaccttaggaaaatgacccattagaaatccttagaacttgtcctccttgcaaaaaaagcctgaacaataaataaacaacttaatgaaaataacagagggagagtacaggggtgcatccgaggaatgacagaagctctggagagcacagacgtttgagatagccacatagagatgggaaggaaacactgggcctccactgtcccatcctctaaccaggatcagctgggaaccaggaagagctcactgtggtgaggaggtaagtgagaggatcccagcagccccttcaacactgtggatacctacagacctcaccaccagggttcccaccagtcctcacaggcactaagcccagctgagtccacccggctatgcaccccacagagaaggagctgacactgtgcctcaatccctgtggcccacacagctgctgtgctataccatcttggaattggagctgtgactgaagtgtgtcttgctccaggggtgagtagtcatggctcccctttgtccctaaggctaagctgccaccaaaccaccccagcacagtggccccacatctccaggctgagctgggagcaactgttggctctgttcctcgggggccagcagagatggagctgctccacctgttcttcccccagctgctttggactggagctgaagcagtatcctgccttttgggaaaacagtaccttgaacactcagagcaatcatgcctccccagtgtctcagttgaagcagcgccacgcctcccaggaagtggtgcattggccatccagagtgatcacacatcccagtacctaagctgaagcagctcccagcatcacagggaaatggtgcctggcccacccaaaagagtatgctccctgggcctgagctgaagcagcacattatcctttggggagttggtgccttggccagactgagcagttgtgcatgccagggatgagctgatatagtacaccatgtcccagagaaatagagcggtgactgagctgagacaccttgcccttacaggccgtagaactctagtaccctgcttgcttgaacctgtactagtcttcaagaagctcagctgcttagataaccttcctcttggagagtggaattatcactgtgctatcctcccctcccatgctgggtccacacaacagctctgctcccctaagctaggatacttgctgtcattgcactggacttcacagatctaagatactgctgagccctgccatcccagggtctatagtcaatactgtatggtgcttcattccatgggacctaagttgccactgagccctgctgactcatgttcctgaattgcagccagacccttgacccaaacttccagaatgccccttctacctagtcaggccagtgttatgccctaattcccagggatagaatcacagctacaaagtagactcttaggtccaagctaccagtgggtacctgacagtcacagatcctgaccatgtgggtaacatatcccactttgccacaggtgccacaaatacatttgtgagactctgagcctaggacatggtcccattgtcattctgagcacctgctcctggaatccagtgctgctgcagctgcttgtgggtaacatcagacctcacaccaagagggatcactttggctaagtctcctcattgtggggaaagcaagaatagtaggtccccaaaggcctttgaaaggataacagcctacaccactgcagcagacatccacagcttataccactgaggcacccatggttattgctgatgttgaattcagctgaaactgcacagagactgtaccactgcacctatccagaaatagtcaccacacccttcccaactggcacactaagattaaactgtaggcgaaaatctttgtccaggagagccactctagaaaatttgaaagaagtgattgttccaccagatgcacagacatcaacacagggacgtgagaaacatgaaataaggaagtaggacaccatcaaaggaacgtaattccctagtaacacactccaatgggaaaaaacttaatgaattgccagaaaaggaattcaaaattatgatcgtatggaaactcagagagatacaagaaaacgtgtagacaatcaatagagttggggaaacagttcacaatataaacaggaaattgaataaaagagaagtaagaatcaaatcctgcagctgaagaattcaatgaatgaaaaaacatacagtggagaatttcagcagcaaacttgatcatatgtaagaaagaatctctcaacttgaagataggttatttgaaattaacaagtcagagacaaaaaaaaagaaataagaatgaaaaataatgaagaacgcctacaaaacttatggaacattaggcaaacaaatatttgtattatgggtgttccagaaggagagaaggggaaaggcattaaaaaatctatgtgataaaatctgaaaacttcccaagtctacggagatatatggacaacagatccaggtagcccagtggttcctaaataagagtaaatctgaaaacatcctccccgtgtcacattacagtcaaattgtcgagagtgaaagagttcacaaaacagcaagagaacagcatcaagtcacataagagaatccctattagactaaaaacagatttttccagagaaatcttacagcctaggagagaatggaatgatagaattaaagtgcttaaagcagaaaattgccagccaagaaagaatactgtgtccatcaaagccatccttcagaaatgggggtgaaatagtctttcctagacaaaaattgagaaagttatacatcttgagagagttttacattttgaaaagacagtattcactaccaggaaaacatgcaggagtatgaaagtcactggtagagagcagatacacaaaggagaaagagaagggaatcaaatcttagcactacagtaaaccgccaaaccttaatgataaacaataggagagaacaaaaataacaaaggatatataaaacaaccagaggcaattaaaaattgataggaataagtcctcacctaccagtaataaccttgaatgtaagcagattaaatttcaccacttaaaagacataaactggtgaaatgaaatttttaaaaaccgtgacacaattatatgctacctacaagaaactcacttcacttcttttttttcttttttcctttttttgagacggagtctcgcttgctcgcctaggctggagtgcagtggtgcaatcttggctcactgcaaccttcgcctcccgggttcaaacaactctcctgcctcagcctcctgaatagattacaggtgcctaccaccaagcccggctaatttttgtatttttagtagagacagggtttcaccgtgttggccaggctgatctcgaaatcctgacctcaggtgatccgcccgtcttggtttcccaaagtgctgggattacaggcgtaagccaccatggccggccaactcacttcacttctaaaggcacatataggctaaaaatgaaggggtgcaaaaaagatattccatgcaaagggaaataaaaactaagcaggagtggctgtacttgtatcagataaaacaggccaggcgtggtggctcacgcttgtaatcccagcacttcgggaggccgaggcaggtgatcacttgaggccaggagtttgagaccagcctggccaacatggtgaaaccctgtctctactaaaaatacaaaaatcagcccggcatggtgatacacacctgtaatcccagctactcgggagtctgaggcagagaatcgcttgaacctgcaaggcagaggctgcagtgagttgagatcacaccactgcactccagcctgggtgacaaagcgatattccatctcaaaaaaagaaaaaataataacaaaataaaataaaatattgaaaaataaaagacaaagaagatcataatataatgataaagagatcagttcagcaagaggatataatcattgtaaatatatatacacccaacactggagcactcagatatataaaacatatatatatatatatatatatataaaaaatactagatctaaagagagagataaactctaatacagtaatagttggggaattcaacaccccactcttagcattagacagatcatctagacagaaaataaagaaacattgggtttaaactgcactttagaccaaatggaagtaacacatttacaatatatttcatccaacagctgcaaaacacacattgttttcatcaccagtagaatattcttcaagattggccacatgttaagccacaaaacaagatttgatatcagctaggcacagttttgcttgcatgtagtcccagctacttgggaaggtgaggcagaaaggatctcatgagtccaagagttcaagaccagcctgggcaatatagtgagatggcgtttcttagttttaagaactttttaaaaattaaaatcatacaaaggatcttttctgaccacaaatgaaataaagatagaaatcagtaacaatagaaacttttggaattgtacaaatacatggaaatttacaaacgtgctcctaaacaaccagtgggtcaatgagtaaattaggaaggagactttaaaatttcttcagtaaaatgaaaagaaaataccaaaacctatgggatacagcaaaagcagtttgaagaaggaagttcatagcaattaacacctacatcaaaacaatagagatttgcaataaacaatctaatgaagcatctcaaggaactataaaagcaaaaacaggccaagcacagtggctcacgcctctaatcgcagcactttgggaggccaaggtggcggatcacgaggtcaagagatcaagaccatcctggccaacatggtgaaaccccgtctctactaaaaatacaaaaattacctgggtgtggtggcgcgcacctgtagtctcagctactcgggaggctgaggcaggagaattgcttgaacccaggaggcaaaggttgcagtgagccgagatcacaccactgtactccagtctggtgacagagcaagactctgtctcaaaaaacaagtgaaaacaaagcaaacccaaagtcagaagaagcaaaaaaaaataatgaagttcaaatcaggaataagtgaaatcaagactaaagggccaggcatggtggctcatgcttataatcccagcactttgggaggccaaggtagactgattgcttgagtccaggagttcaagactagcctgggtaacatggcaaaaccccatctctacaaataaaaatacaaacataaggccactcgcggtggctcacacctgtaatcccagcactttgggagaccgaagcaggcagatcacgaggtcaggagatcaagaccatcctggctaacacggtgaaaccccgtctctactaaaaataataataaataaattagccgggtgtggtggtgggagtctgtagtcccagctactcgggaggctgaggcaggagaatggcttgaacctgggaggcggaggttgcagtgagccgagattgcgccagtgcgctccagcctgggtgacagagcgagactccatctcaaaaaaatataatataaataaataaataaaacataagccaggcgtgttggtgtgcacctgtaatcccagctactcaggaggctgagatggaagaatcacttgagcccaggaggcagaggttgcagtgagccaagatcacgccactgcactccagcctgggcaacagagcaagaccctgtctccaaaagaaataaaattttaaaaaagactaaaaaacaatacaaatgatcagtgaaataaaaagatttgaaaaaataaaattgacaaccactagtaaattttcccagacacatataccaacatagattcaagaggaaatagaaaacctgatcaaacagaccagttatgagtaattaaagtgaatctgtaattaaaagtctcccattaaagaaaagtccagcacttgattccttcactgcagaattctgccaaacatttaaagaagagctaataccaattcttctcatactcctccagaaaactgaagagaagggaactcttctgaactcaatccacaaggccagcattaccctaatagcaataccacatgaggatacaacaaaataaagaaaaatatagacaagtatccttgatgaacataaatttttaaatccccaacgaaatactagcaaactgaatccagcaacacattgaaaagagcattcatgatgaaaaagtgggatttatcccagggatgcaagaatggttcaacatatgcaaatccataaatgcgatgcatcacatcaacagaatgaagaacaaaaaccatgtggtaatgccagtagatgcagaaaaagcatttgataagtggcttcatgatatgaactcttaacaagttaggtatagaaagaacatacttcaacacaataaaggccatatatgacttacccacaaccaacatcatactgaacgtggaaaagctgaaaacgtttccactaagatgtggaaaaacacaggatgcccactttcaccacttctatttaacatgttattactggaagtccttttaggactgataagtaaagttgcagaatacaaaattaacatacagaaatcagttctgtgtatatacaccaacaattaactcactgaaaaataaatcaagaagtccatcttatttacaatagccaccaaaaaagaataaaatacataggaataaatttagtcaaagaggtgaaacgtctgcaaggaaaactaaaacactgatgacagaaattgaagaggaaacaaaaacagacatcccatgttcatggataggaataattaatattgtgaaaatgacagtactatcagaagtgacctgcagattgaatgtaatccctatcaaaatgccagtgatattattcacagaaatagaaaacacaatctttgtatgggtttttcccccaaagacagcagattagaggcttttccagcatgcctaacccacttggaaaaagcaaaatagtgtgcagatagtcacatcattaacttttatccaagaaggaatacaggaattgaacagaacatttcagacactgggaaagagaaatttgggagacagccctcctggcagagtctggctaaaaacagaaaatccccaatacaggagatggggagtcagtgttcctctgcagtccatcttcccactggggaagtgtgcaatccaggccacaggagagcaccttgagcttcccaagccctggatcttacttagggagtagctgagagacattgagaaggaacaacctgggatgcatcccatgcattttcccagacctggtggctgataagaggactccagtctcagtcctagctcatagcaaactgtgtgggaatcctgtggcctagcagcagcagcagaagcagcatctgttagcattataaagtctcatgccaggattggaacactgggtctttggtaggaaaggggcccacacagccagaaatgataaatgagtacagcttgggcctccagctttgggcactagaattggacccctgcacccccatcatgggactggagcaggagatttgcctgagaggtgtggttttggacccaatagcaaatttgcaggctgaaggcagatatatggtctgtctgattcctgtggttgggatgaggaaatgagtcctgatggttctggagagagagagagaggcaggtcccatactgtttgcctggttttaacaatgggtttgcccttgccttcctgtgctgggacattgatgcaatgtcagttgctctcatctttgcctaggcatttctacagggtttggcaactgtccctagatccctgtcagagccagtgcttctgcctgctactgggggaccaaatggctgtcttgcccagtccagctctacccagcttcacctctccccaccagtcccctcccctcccccaaggctgagtgtaagacccaaaccactgagctttccctggcccaacccattgcgtgggacacttaagtacttctcttggttaacaaagataagtcgtaaaccctactgttagaactgtagccagctgtgacctgcaactaccacctgctggcctggaggttgacccacacagcccattacaacatctgcttacataagtgcacagcacttgggaataagaaaagcttctcatgacttcttttaccaccattgctcatgccaccccagcttctcaggaggttatgagccagctcacccacccgatacaccactactgtaaccagcatttgagaaagccaccacactaaggctgtttatatccaaggaaatcctagaatatttgctactgaacacactcagaagcaaagtcaaacaatcctactcaaattacatcatagtaacatcctcaggattaaaaaaagtccactccagaactcccattcacaattgcttcaaagagagtaaaatacataggaatccaacttacaagggatgaaggacctcttcaagaagaactacaaaccactgctcaacgaaataaaagaggacacaaacaaatggaagaacattccatgctcatggataggaagaatcaatattgtgaaaatggccatactgcccaaggtaatttatagattcaatgccatccccatcaagctaccaatgactttcttcatagaattggaaaaaaactactttaaagttcatatggaaccaaaaaagagcccgcataagccaaaagaacaaaactggaggcgtcatgctacctgacttcaaactatactacaaggctacagtaaccagaacagcatggtactggtaccaaaacagagatatagaccaatggaacagaacagagccctcagaaataataccacacatctacaactatcggatctttgacaaagctgacaaaaacaagaaatggggaaaggattccctatttaagaaatgacgctgggaaaactggctagccatatgtagaaagctgaaactggatcccttccttacaccttatacaaaaattaattcaagatggattaaagacttaaatgttagacttaaaaccataaaaaccctaaaagaaaacctaggcaataccattcaggacataggcatgggcaaggacttcatgtctaaaacaccaaaagcaatggccacaaaagccaaaattgacaaatgggatctaattaaactaaagagcttctgcacagctaaagaaactaccaatagagtgaacaggcaacctacagaatgggagaaaatttttgcaatctacccatctgacaaagggctaatatccagaatctacaaagaacttaaacaaatttgcaagaaaaaaatcaaacaaccccatcaaaaagtgggcaaaggatacagacagacacttctcaaaagaagacatttatgcagccaacagacacatgaaaaaatgctcatcatcactggccatcagagaaatgcaaatcaaaaccacaatgagataccatctcacaccagttagaatggtgattgttaaaaagttaggaaacaacaggtgctggagaggatgtggagaaataggaacacttctacactgttggtgggactgtaaactagttcaaccattgtggaagacagtgtggtgattcctcaaggatctagaactagaaataccatttgacccagccatcccattactgggtatataccaaaggactataaatcgtgctgctataaagacacatgcacacgtatgtttattgcgtcactattcacagtagcaaagacttggaaccaacccaaatgtccaacaacgatagactggattaagaaaatgtggcacatatacaccatggaatactatgcagccataaaaaaggatgtgttcatgtcctttttagggacatggatgaagctggaaaccatcattctcagcaaactattgcaaggacagaaaaccaaacaccacatgttctcactcataggtgggaattgaacaatgagaacacttggacacaggatggggaacatcacacactggggcctgtcatgggttggggggaagagggagggatagcattaggagatatacctaatgtaaatgatgagttaatgggtgcagcacaccaacatggcacatgtatacatatgtaacaaacctgcacgttgtgcacatgtaccctagaacttaaagtataataataataaataaaccataaaaaataaaaaataatcccacttcaactaaaatttaaaaataaggacaagcaactatttgtgcagatgtgaagaagtcaatataatactataggaagtatgaaaaagataatatgacacccccccaaaaaaacacagtaattctccaacaatggatccttaaatcctcaaaatgtcaagtaagataagttttttattttaaaaacagacaactcctggaaatgaaatactcattgaaggaattgcaagatacatttgaaagctttaacaatgatttagggccgggcgtggtggctcacgcctgtaatcccagcactttgggaggatgaggtgggtggatcacgaggtcaggagatcgagactcatcctggctaacatggtgaaaccccgtctctactaaaaatacaaaaaattagccgggcatggtggcgggtgcctgtagtcccagctactcgggaggctgaggcaggagaatggcgtgaactcgggaggcagagtttacagtgagccgagatcgtgccactgcactccagcctgggcaaaagagcaagactccatctcaaaacaaaaagcaaaaaacaatgatttacatcaggagttcccaacaatgatctagaccatggatacaggacacacagcaggagctgagcatcaggtgagtgactgaagcttcatttgtatttacagtcgctccccattgctagcattacttcctgagctgctcctcctctcagatcaggggtggcattaggttctcataggagtgtgaagcctactgtgaactgtacatgcaaagcatctaggttgagtgctcctcatgagaatctaatgcctaatctctcactgtctcccatctctcccagatgggaccatctgcttgcaggagaacaagctcagggctcctactgattctacgttatggtgatttgtataattatttcattatatattacaatttaataataatagaaataaagggcacaataaatgtaatgtgcttgaatcatcctgaaaccatcccctacccgccagtctgtggaaaaattgtcttccacaaaaccagtcactggtgccaaaaaggttgggggccactgatctagatcaagtggaagaaaaacatcccacaacttgacgacaagtgttttggatgaatctggtcgcacagaaatacagaaaagaaaaacttcaaaagaacaaggcctccaagaagcatggactatataaagcaactaaactgaatcattggtgtttcagaggaagaagaaaacagcaaggagtttagaaaacttacttaaggaaataattgatgaaaacaacttaactcgtttagcaagacatctagtcattcagatacaagaggcagaaagattaacaggcaaatacattgcaaaaggacttcaccatgacatatagtcatcagattgcttaaagacttcaccatgacatatagtcatcagattgcttaaagtcagtgtgaaggaaaaaattctaaaatcaacaagagaaaagcacctagtcatctataagggaagctccatcagacaaacaacagactttctcagcagatagggaaagatacactacacaagccagaagagaatgggatgctattttcaaagtgctaaaaggagaaaaattttcatccagctagaataaacttcgtaagtgaaggagaaaacgggtctttctcagacaagcaaatgtgggcaacaagccacccaggtgccgaggcaagagaccgagggcacgagctattccaatattataaaataacaagaattatactagatgtaaatcatagatatgattatatatgaatatcattaatcattagtttgtagcaattactctttattccaatattatagtaatccttactctacaattataacctaggaaaaaccaggccatacagagatagtagctgaaggggcatggtgagaagtgaccagaagacaagagtgtgagccctctgtcacgcccagacagggccaccagagggctccttggtctagcggtaacgccagtgtctgggaagacgcccattaccaagcggaccatggtctagcggtagctgtcagtgccaaggaaatgtacccgctacttagcagaccaggaaagggagtctccctttccctgggggagtttagagaagactctgctccaccacctcttgtggaaggcccgactgatgtcaggcccacccgcagttatctggaggcctaaccatctccctgtgatgctgtgcttcagcggtcacgcccctggtccgctctcatgttccatcctgtacacctggctccgccctctagatagcaatagcaaaattagtgaaagtgttaaagtctttgatctttctgaaaagagcatagaagaaatgatgacgtaagctgtcctctctctctccgcctcggctacctaacagggaagggccccctgtccagtggacatgtgactcacgtgaccttatcagtcactggaggtgactcaaactctttaccctgccccttttactttgtatccaataaataacagtgcagccaggcattcggggccactactggtctccgcatcttggtggtagtggtcccccgggcccagctatcttttcttttatctctttgtcttgtgtctttatttctgcaatctctcgtctccacacatggggagaaaaacccaccaaccccgtggggctggaccctacaagcaaacactaagagaattcatcaccactggactaatactatagtagaggctcaaaggagtcccagacatggaaacaaaaggttgatatttgccatcataaaaacacatgaaagtataaaattaataagtctcataaaacaattacacgaagaagagaaaggaatcaaatggcaccatgatagaactccatgaaaccacaaagacagaagaaaaaataaaacaaagaatttacaaaacagctagataacaatatatttcagtaacaagatgtcatatatcaatgttaaccttgaacctaaatggatcaaatgctccgcttaaaagatacagcctgactgaatagatttttttaaatgacacaactgtgtgatacctagacacacagatcgactgaaagtgaaggggtagagaaaaacatgctacacaaacagaaagcaaaagcagtaagaatagctattcttatgccagataaaacagacgttatgtaaaaaataaaaattaaaaaacgtaaatagataatagtgaagggatcaattctgcaggaggatatgacaattcaaaatatttatacacccaacaccatagcacccataaataagtaaagctaatattactaggcctcaagggatagatacactccaatacaataatggttgggaaattcagtatccggctgatacgatttggctgtgtcgccacccaaatctcatcttgaattatagttcccataatccccatgtgtcatgtgagggacccagtgggaggtaactgaatcatgagggtggttaactccatgttgttctcgtgatagagagtgagttctcacaagatctgatgggatagttttataagcgtctggcgtttctcctgctggcactcattctctctcctgctgccctgtgaagaggtgccttctgctatgattgtaagtttcctgaggccttcttagccatgcggaactgagttgattaaacctcttttctttataaattacccagtctggggtatttcctcatagcagcataaaaacggactaatacacccgctgtcaacattggacagatcatctggacagaaattaacagaatacttggatttgaactgtactatataccaaatggacgtaacagacatttacagaacactgtatcaaattgctgcagaatacacattttcctcaacatatggaacattgtttagaaacactatatattagaccacaaaacaagtctcaacaaatttttaaaaatagaaatcatatcatgcatcttagaacacagtggaataaaactcaataaccagaggaactttggaaacagtatctacgtggaaactaaacaacatgatcactgccataaggttgatgaatatattaagagatatttcttaagttcttgaaataaatgaaaatggaaataaaacataccaaaacctacaagatacagcaaaagcagtgctaagagggaagtgtttatagcaatgaatgcctaaatcagacaattagaaatatttcaaatgaagagcccagttatgcacctcaaggaactggaaaagcaagaataaaccaaacccaaaattggtagaatgaaagaaataataaagatcagcatagaactaaatgaaacagagactaaaaacacaatacaaaggatcaacacaatgaaatttggtttttcaatagataaatggctaaaagaagcctcaaataaaatcagaagtgaaaaaggagacattacaactgaaaccaacaaaatacaaaggatcattagaggtttgtgaagaattatacactaacatactggaaaacctagagaaaatggatacattcctagccacatacaacctaccaacattgaaccaagaagaaatagaaaacatgaacagaacaataaatagtaatgatccctcaacaaaaactcaggaccagatggctttactgccaaatcctatcaaatttataaaggagaattaacgtcagttcttctgaaactatttcaaaaaatgaaagaagagagaattctttctaactcattctaccagacccaaattattccaatattaaaaccagacaagggcacaacgaaataagaaaatggcaggccaatgtccttgaacatagacacaaaaagcctcaacccagtacgaagcaaagtgaatccaacaacacatcaaaaagataatacagcaatataacgtgggatttgtcccggggatagaaggatgttttggcatttgcaagtcaatagtcatgatgtttcacatcaacagaataaaggaacaacaaataccagattctcaatagacacagaaaaggcgtttgataaaattcaacactctttgcaaattaggtatagaagtaacatacttcaatatagtgaaagatacacatgacccacagctaacatcatattgattaggaaaagctgaaagactttcctttaagaactggttcaagacaaggatgcccacttctacctaccaccccctctgttccacatagtgctggaagtcatagccggagcagtcagaacatagaaataaaaggtggccaagctcggtggctcacacctgtaatcgcagcactttgggagaccaaggtaggcggatcacttgagccaagtagttcaagaccagcctgggcaatgtggggagacccctttctccacaagaaatatagaaattagccaggtgtggtggtgtgtgcctatagtcccaggtattcaggaggctgaggcaggaggatggattgagcccaggaggtccaggctgcagtgagccatgatcacaccactacactccagcctgggtgacagagcagggaccctgtctctaagaaaaaaaatagaagaaagaaaggaaggaaggaaaggaggaagggaggaaggggcatccatatcataaagagaatgttagttgtctcccttttcaggttatgtgaccatatgtagaaaaaaaacaaagagttcaccaaaaactcataaacctgataaattcagtaaagttggagaatacaaagtttgtgtacaaaagttagtatcatttctgtacaccagtaacaaactgggtaataaggaaatcaagaaagcagtcctatttgcaatagtcacataaaaataaaatacataagaataataaatttaaccaatattctcaaatactgatgaaagaaattgaagagatcacagaaaaatggagaaatatatgtcatcatgtataaaatacatgtagatactagtctatttgatcatttactatcataaaatatacaaaaatccattgtaaaaagttaaaaattattaaaacaaatacatggcaccattcacagttggaagaaatgtaaaccatgttaaatcataaccgcataaaattaacagtagtacgtactgtattaatgtaataatttcatagccacctgttgctattgtgatcaccagtgttgccagtgtccacttgaaatgtcatgtgacatacgcttatgagtagttcgtccctccattaggttgattattgcagtaaaagtgacctcttgtggttctcacatagttttcaatgtgtttagtgcagtatcatgaatcttgaatattacaccatgggacctgtatgaagtgccatagtgctgctggaaatgctcccaagaagcggagagaagtcatgacgttacaagaaaaagttgtattgcttgatttgtaccatagatagaggtcttcagctgcaggtgctgccatttcacaaagaatgacttagcatatcattgtaaaacacataaaaggacagaaaaatctattcatgaagccattgctatagctacaccaacaggcacaaaaactttatactttttgctaaataccttttgcagcctttatgtgggtgcaggatttctataaggaaggcatacctgtagtatccaatgtgatttgaggaaaagaaaagtcattatatgacaacttaaaaggaaagcaaaggatatagcactggagaatttaatggcagcaaacgttagtttgaaaagtttagaaagagatttggctttaaaaatgacaagataacaggagaagtagcttttgacgatcaagaagtagcagtcaagtcaggttcccagatttcattaagaaaatcattgaggagaaaggttatttttgtgaacggatttttaatattgatgaaagtgccctatttggggggaaagtgccacaaaggacatttattagtaaggtagagaagagagaattaagacttcaggcatttgttttgtgcaaatgcagtcaggtctatgatcaagactgcccttattgataaagctactaaacaccagcctggaagggaaattataaataccatctgccggtttttaattgcaaaacagggaggaccgaatagtgggaaccctctgaattggttttatcagtgctttgtccctgaaattaggaagtaccttgccagggtaggactgccttttaacgtttttttgatattggataatgcccctggccacccagaaccccatgaattcaatactgaaggcttcagagtggccttcttgaccccagacatgcctctaattcaacctctagagcagggggtcctaaggacccttacggcttagtatgcacagtatgctatgtaaagcatttaatgctgtagaatagaatccagataaaacatcacaaaagtctggaaagatggcactgttgaagatgtcattattattataggaaatgccatgaaagtctaaacaaaagatttctatgggagaaaactgtgtccagacgtagtacatgatttcacaggatttatgatagagccagtcaaggaaatcatgaaacagattgtggatatggcaaaaaaaaaaaaaaaaaaaaaagttagggggtaaagggtttcaagatgaggatgttgaagaaattcaagagcaaatagatactacaccagagtaattaaattaataggagatgacttgatggaaatgggtgtttccatgttgttcaaggggcagctatgataacaatatcaaacaaactataggttgagtaccctttatccaaaatgctttggaccagaaatttttcagattctggaatatttgcattatacttaccgtttgagcataccaaatccaaaattctgaaatgcaaaatgctctagtgagcatttccattgagtttcatgttggcactggaaatgtttcatacttaggagcatttcagattttaatttcaaatgcttaacttatatggaaaaggcaggaatacctccaatttcattgtatggcaccagtatcattcctaataccaaaactagacagaactactacaaaacaaaactacagaccaggacccctcttgaacatagatgcacaaattctaaaaaatttagcaaattatatttaacaatatatataaattcatcatgaccaggtgatgtttactccaggaatataagtttcatttaacattcaaaaattaatgtattattaccatattagcaggccaaaaaagctaaaactgtatgatctcaatagatggagaaaagatatttgccgaagtccaacatcgattcctgatttttaaactttcctcaaactattagggcatctatgaaaaactgacagccaccattatatttaatggtgaacgactaaattcttttttctaacattaggaacaagagaagaatgtgtcctctgatcacttctgtttctgcgttgttctttagattctagccagcacagtaagtaaaaaggaaaagacgtaaaagacatccattgtggaaatggagaagtaagctgtcttcatttacagacaacattattttctgtagaaatttcgtgtagaagatatgttggaatctatgaaaaagaccaacagtagatttaacaaggttccatgatacaagatcaatatgaaagaattaattttatttctatatatgagtaatgaataattgaattggttttaaaaaatgcattttcatcaagcagatggtgcacacctgtagttccagctacttgtgaggctgaggtaggaagattatttgaacccaggagtttgagtccagcctgggcaacataacaagaccctatctctaagaaagttaaattttaagaaatcccattttccatagcatcaacaaataggaaattcttaacaataaatctgacaaaatatgcaatatgccctatgtagtgaaaactaactattgctgaggaaattaatcaagaactaagtaggtggagagacacatacacagtgttcagtggaagacttaatgttgttaagatgccagttctccccaagtggatgtatacattcagcacaatctcattgtaaatccctgatgtcttttatcatagagatggacaaactgatcctaaagttcatatgggaatgcaaaatatcaagaaaaaccacaaggatgttagaatagaaaggaaatgtgggatggttaacaccacctaatttcagatctattacaaagcctcagaaatcaggacaggattgtatttccttaatggtaaacaaatagatgcatggtacaatagtgtccgcacatagacccacatatttatggacaactggtttttgacagatttagaaaggtaattctgtggagaatggacaaccttttcaacaaatgattctagaacaattgtatgtccatatgcaaaaaaaaaaaaaaaaaaaagttcatctgtacctgacagaatacacaaaatgagtcagaaccctaaatacaaagtacgaaactataaaatttctagaagagaaaacggggaagtctttgtaaccttgaaataggcaaagcttccttaatatgatactagagcacagtctaccaatgaaaaaatgattaatcgacttcatcaaattaaaaactgccataaagtgaggggaaatacatgcaaaaggatttttatctggaatatataatgttctctcaaaagtcaataatacaaaacaactcagaaatataggcaaaacacatgaacagacacttcaccacagacaatgtacacatataggcaaaacacatgaacagacacttcaccacagacaatgtacacatggccaataagtacatgaaaagatggtcaacatcattacaatagggaaatgcaaattaaaactgtaaggaggctgcgtgccgtggctcacacctgtaatctcagcattttgggaagccaaagtgagaggattgcttgagccaagaagtttcggaccagcctgggcaacatagtgagacctcgtctctacaaaaataaaaataaaaaatcagttggtcatggtggtgcacccctgtagttcctgctattccagaggctgaagctggagaatcacttgagtgagccccagaggtcaaggctacagtgagccgtgtttgcaccactgtactccagtttgggaagcagagcaagaccttgtcttaaaaacaaaacaaaacaaaacaaaacacaaaatctcaccataccaagtgttggtgagaatgtggaggaactataattttcatgtattgctgttgcaaatgtaaaataatatgcccagtttggaaaacactttggcagtctcttaaataaaagtcagacaactatcaggtgagcccatctttctacttgcagtatttacctcaggaaaaaagaaagcatatgtccatgcaaagaattgagaatgttgttgtcagcttttcagtacagccaaaaactggaccacagtgcagatgtcccatcaacaggtgaaaggatattgtgggccatctcttcagtgggatactagataacattagaaaggagttaactgttgaaacatgcaccaaggtggcttaatctcaagataatcatgctgagtcaaagaagccgtacacacagtagtacatactgtatctattccatttatgtaaaactcatgatgttgcagactgttacagcaaaaagtagatcatggagggatggggtggcgggaggagggaattaggaaggggcacaaagaagtttggggatgtggtagatacactgtcttgattgtagttaggttttcatgggtaatgaaaacagcgtagatttcatatgcaacttcaaactgtaactttaaatatatgtcagggtgtagattttaaatatatgcagtctattttaagtcaattatatctccataaggtggtttaaaaccagcgtgacagaagggactcatagattaggcttcaaagacggagcagccacacgcagtgtgtggattttgtatcttgattcaaacaagccagctgcttaaagacattctgtaaacacctagggaaattgtagtatagtgtgagtattggataatgttgattaatcattgttacttttgttaggaaagacagtggcatctaacaaaagcccgtgtctattagaggtgcttagtgaaaattttatgggtgaaattatgtgatgcttgccatatgcttcaaaatcatctaacacagtaaagagggaaacagatgaaaaatagaagtaaagtactggtaatggaagccggatgttagatacatagggaaggctttattaaatcattctctgttcttttgtgtgtttaaaactttcccctaaattttttcttacatgtttctatgggtttttaacattcttaaggtgtccgttgttttggtccccgccttgctccgtcaggagcggcatctgccttttcccacagtgtaaggcctggatgtgtctagagtgacgtctccctgatgtgcctgggacagtcgcggtttttgccccttgtcccagtgtgagtgttcctagggccctctgatgcacaaagctttctaatttgaacaggaaagcagatgctcaccttagttttcttcacatacctgttctttacacctatttatctttactagattattactttgcctggaacccactcctacccctacacccggaaccccctcctaaccctacgcctttcccatctaaccccttcccagtcttagtccaggcctcgactcctcaagaccttccctgacgttcctcccctgcctcgccccacccctcctagtcgcctcctctgtgctgccacctggccctgggcatgcttgagtatacaccattaacgcagctgtcccagttcagtgagcttttccagggtagggatcaccatctcttcatctgtgggttgttggtgccaagcagtgctagcagtgtctgggagaatgttgcataaatccagccttggagtttctctgccctcacccttacagataatgaaaacagctcaaccctggaaggtaagtacaccttcccaggatcccagaggatgatagtatagcgagccagaagtggagctgtgacgcattccttctcttcacacttgatgatgcgataagcaatttcaaggagcggtcaaggtttcccttaataagacggcatttacacacctaatggtgatcattcgttgagcagaatccaaaagccattggagcagcaggagtggctctggagtgtgcaagaagtaggtttgatagtgctgtgatgtttcaaatgtttattcgacacaaaatgcagcaattatgacacctaacttttttactgctggagaattgaagacctatagttctatatttctgtttgacctaacagggtgttctaacactttttacttttcaaccagaatgctgaatcttgatacagccaccattttttctattttatcattctcttatatgtaggacatggagagggatgtagtaaaatagagactttatacttttaattgcttaaaaataaagtacgtcattcagagatcttacacttagtatctgtttttatttgcaattttcatagcgtcgtctcggagatgcagccaagaaagccatcagtaaattgacaaccaggacagtaaagaagggtgacaaggtacagtcatgaaacaacttcagcaccgtaaaagtaatccagcagttttgtttttgtttggtgggagaggacacaccctaattgtttacatttcattcgttagattttctccaactacactacctaatgctttattttaaactaccttcttacagtaactctagctgtgttttcctacagaggtttcttctgctaaaacctagcatgcattttcagagaattctggtgggaccatttgtgcgttaaaaagccaggagatgtgttttcttcctatacttcctgggactttgctatgtctcttttgttgttttattttttcactagatacatggagagttgaagacctgcatttctagggagtttcacctaaaaaggtgctctctttacaatgggttgagcagtttgaaagaagagcaaagtgtgtcagggtcatccctggtggcttggaggaccaagggagagaggcagtgtcaggatgctgtggcggagacctctaactgacatcccgcctcagagctctagttatggtagagccctgcttctccgctagaaggacacagttgcatcttagtgctgcccctacattcagagtattcaaggttatctagaatgggaaaatggcatctcaaaaggcataaaacgaaaactgtctcctgccccacacccaattctaatatttaagcacagacttgtgcctggaaggataatttcatatgattctctgtcttcctaagttttaccaatttcttggactttacccattttattcccattgccttgataccaccgtatctagttgcctttgaaacagcttcagagggtggagacattcttagtgaactttattgtacaccaaagaaacagaaaagggggaaatcacttaagaaaatagaagcagcatcaaaacggcttgcatttcaatggcagaggagtggtgaccacggtgacagtgtagatgccttcttggcctggtagcctcagctgccacaatagtatgaaattccctggagcggatttaacctacccatctgactttgtatcccgggccagcacagttatttcctttaattattaaagccaattcatcttagtttgtacctcctagacctggcaagagttgtccactgagtttcagtccaagtgacagtgacacagcaaatagtctgttttcttggcttaggttcctggcatgttttgttttatgacaacttttgcaaaaccccttctcagtcctaggaggaaggaaatcaattaatctggtgtctgaatacctggctgactctttctcactcttaatgaagaccgagtattgaattgagccaatgacccttctccatcccaaatctgtgaccagattcacagctcccattcttggggtgggtttctagacagcagtctgctgggactcaactcaccatctttcctgtctgtacttaggtgtgtgtttaagtgaacatcctggtgagcttccaggctgtgtcaaacatagcagtgaaacctcttcagaccaataagtaatgcagggggaatgagggatggggagatcatgatggtccaagctgattctaacctggaaaaaattagaattccgacttaatttttgtaagacatatcataacaaaattaatatagattgttataatttttaaaacaaaatagattgacttagacataatttgggccaatatagttaggcaaataaaaacaaaataattttaatcatttttcagtttataacacttgcttaccatagtagccacagaaagattctgagctgaattgcatcccaaccatttatatacttgcagcgtgtgactttttgtttctgtacttttcattttaggaaactgacccagactttgatcattgtgcagtctgcatagagagctataagcagaatgatgtcgtccgaattctcccctgcaagtatgtcaacttcatttgtttgagaaagaatgatattaatgtgctttgtatgcctccttttcagggtgggcatctcccttgcttttgagcgccacccacctcgtggctttctggaggccaagtccgctgtgcattgctggccatggggctgaggccagcagggagtggtgctgttcagcaggtgcgggctgcacggccttccgaggtgtagccaatatgcgatgtggcacgcggcctccagactccccagacacagcctaggagtgttgaggtcgagaattcttgttctatggtttcgtttatctttttatgtttgttttcttttatttatttatttatttattttttgagacggagtctcgctctgtcaccccaggctggagtgtgcagtggcgcaatctcggctcactgcaagctccgcctcctgggttcatgccattctcctgcctcagcctcccgagtagctgggactacaggtacccaccaccatgcccagataatttttgtatttttagtagagacggggtttcatcatgttggccagttggtcttgaactcctgacctcaggtgatctgcctgcctcagcctcccaaagtcctgggattacaggcgtgagccaccgcacccggcctgttttctttaaagatggggttctcactatgttgcgcacagctgaacatgaactcctgggctcaagcagtcctcctgccttgtcctctcaaagtgttgggattacaggcatgagtcactgtgcttggcattgttttgtgattcctgtgggtttcaaaaacagccccttgttcctctccatcttagactacatctccaagcccttcagtgagacttccatcgagctcacctggctctgggtacaacaactccagggacttggattaaatctttttctaaacctggattatgcaaaatggaaagaactgatacctgctttgtgcctgctgtggttcagatgctctgctctgagcagactatactcactgtctcctataattctcccagcagtcctaagagggtgtgttttccccgttgtacagtgaaggatggtgagccgatagcaggttccagggtcgcacaattcagaaatggcagagctgtgtcaaggcctgcctttaatgtggtgctccccacatgggaccaagccttcctccatgaggaaaggactcgcctgtgcctggttgccctggaaacagcatgttggtttctcctgtggctcctctcaagctggggagcatgaaactaagatacacagttctgagtatcaattggataaataggaaatcacctgccaagaagcctaaaaccaaagagtttgcctcttcctcctcccttccctttaaaagacatccacacaactccagccttataatatggagcatgtgaattaataaaataattgtgagttgttatctccatgaggctactggtcttattttacttacaaagtaatctattttgagtctaggaagatctgtttttaaaaaaaaaaaaaaaatcaaactgaagaagaattacatgtactgaaacagaaatccaagattctggaagtccagtcattctagtttacatataaaggaaaatctataaaactaaatgtaagctgtcctctagaaaattaaactgtggaacagccagtcttccttcacatgcagtcattgacggtctaaacgtgaggctaaaggaaatgcacacgccagtgcaaatcaggagaagggccagcgggacacagggaggcgtcatccacacttgcctgcttcaacactggaatgaccaggagaagccaaggctctccaaattctgtcttgctgtttcagcccaggatcctccagaaccatatggcacctaaaactacgggcctccaaaaccattcatgggtatattactagaatgaggggatcttccctcaggggaggctcggcctaaagtagtttattctgggaacttaatcccattatcttcatcccttcagtgttgacttttccagtttcattcggagttatctttttccttttgtataatttttattttttgtagagttggggtctcactatgttgcccaggccgctctgaactcctggcctcaagtatcctcccaccctagcatcctgaagtgctgggatcacaggcatgagcctgacgtctggccctctttttaaaatttagttcattgctttccagacctgactgcatcagagtcagtgggaggctttcagaagcatcccgggtggaggccgggcatatgcgctttaattataagttcccgcccgattctcgtgctgcaaagccacgcctgccaccaaggtccaggccatggttgatctgaaccatttctgcgctgcacctgccaccatagaagtggtttgtgtttgtggtctgcttgtgaatgttagaatttttggcacggttcacggaatttcgctgcaccctctatggtactgttacttggttgtctttcagtactgggtcactgtgttactagctgtgcttactgccctggctgagtgtagagttttccctgttgctgtggaactgagcggctgtttgttcctcttacactccacgcatcaccaagctgtaactttccctgagactgcaccacacagcctgctcagcacagcacaccatctcactgccatgtagcgacagtgcagttatcaggtgtagcaaaaattaactttacacatcaagcggtacttgtgacagtctttaagctagagcagcatttctcagccttggcactgttgacatttgggaccaggtcattgtgtgggggtgtgggcctggcagtgtccttggccctctacccactaggtgtcagtagcgcccacccacacacagttgtgacaaccaaaactgcctccagatgagaaccgctgagctgaggatggctgtgcgcggctcttcaagcctcaccccagcagatgccactcgcagctgcgccttcgcgctcaccaaactgccgcttacagaattccttctgccttgggacgcctccccgcccctattgtctttgaagcccagagtcggtgttacctgctgtggctttctgtacctcatgttgctaagcggttctgttccctcaccgtcttcccacgggactctgaacagacttggcaagacagagcctccccgcctggctggcgctccgcattcggcacagcagcacctgcaggtgtgttcactctacttcaacaccttaactcacacgcttgttcttcactctcagaggaccgcttcaccattgactgcccagaggaagcaatgggtttaattccctcagcgtgctgacccgggtgcgcaggccggagaggccgtctgctgcggtccatgccgctcctccccgcgccgctgcgtgcctgctctctcccttcctcggggcctcgttctcttggctggctgctccttccagtgttctgtctccactcgccggcatctcgtgacactcgcatttcccagtccagtttttaaaactctctttcaaagccatcgccctccaagtactgccccacagcgtctgctgtcacacctgcccactgcctcttccctccgtgagggagggagatgggcctggacaccctcgtgtccatctttccttaacgattcacaagctcagctaggactttctatccagagctgtcaagccgctcatggattgcctgcttcttgccacgtgacgtttccttttcctcttctgtcgcactatttactgtggacagatggcagttggcatggcggaggggcctcctcctcggctcagtgatcacggctgattctcctttggatgttagccagcaggtcttagaaaccgaggaactgtcacctggtcttattagacctcttaaaggtcggccatcggagtgtgtagtcgttagaagtacgttttcagaagtggagttgccgcgtggatgaacgtatgtttccatgccacttcaggagctaaagcggggggccggccgctgcagatgtctgaggctccactgcagccgagggtccatagagacagagactgctgccagccccagctagcagaagagagttcttgtctgggacctttaataatcctgcatccttttatatttgccaggttcttacatggcaccaagaggctgcagagctgtgagagcaactcaccttcaatatagaggcctcccctcccgcagcactcttctgctcactctagttcatggcatgtgtgggacataggaaaggggagggcgctgaatttcatgattgctgggtttgttcctttcatgttctatttgtttctcgttctgtatccccaagtatttctcataggaataaaggactttgttggcgctcagtatgcttgtgcttttcaggtttcactgtccacgttacctgctttccgtcccgatgcaccacccaccctgtgtgtggcgggcctgttttttatttatgtgtgtttttatcacgtgagtggggaacttcttttcaaggccctacttgccccaggtgcctctttctgaggcctcctgggtgtccatggagcaccttccataatgagagcccagagccatagtgagggtgagcgcggtcaggcgtgcgggaatggccaggtggcggggccgctctgcccgtgtgatggccctgcaggtgctcagccttggcccacatgctgtgttgcattgactgctccagacacttcccaaggtagattaaacgcccctggcccagtccttagctgagacctctgcacagcagaaaggtggtttgccgagcaccagactgttgtagcagaactttgcctagaagggaagaaaaggccacagtgagttcagtgaaagttgcactgaagagactagcaggagggttagacaatgggtgatgaggagaaaaaggtgccgtgttcagggcagctgcctgtggagatcacagaagagacaggagaggagggccatgggtgaagagaacagccacccagctttgtggaagcgagggatgtgccatgggaatttgagactgaagatctctgggtgagttgcacagaagctggactagcggggaatttggaaagacaggagggaagggtgttcagtgctcagaggtagggtcaggagtaagagagggatggggtggatggagagcccaaaggaacttttttttaaagaccaaaaatatttcagattttcatttagctgaggaagggaggttttctaaatttgtcaccagagaaccagttggtcttttttgtttttcttcatagtaccccacagcctagaggagaaatttttaattgtttagtaaaacagaggggtgggcacttcttttatatcaataatcctagaaggaaacagttactcaagaacccaaacatatttataactaatttcaggttaaagaaacaggcagagaacactgtactcatgcagctttaaaaatgaaatatgaggattataccatttggttctttctggatagtaagagaaaagaaagacggaacaataagaaaagggcaaagcaaaatctggccccagtagggagcaccagagccgcacctccatccccccaggtggtgctgcggctttaccaggtccccaccaacagttcagcaagcccagccaccccccaccctcatctggatacctctcactcctgcaccagagccctgatcagaagtcaaggcacctaggcctcccccgacccccagcgggatgcctcccattcctgcaccagagccttgatcagaggtcacagcatcatatgtcttccattacctgtcagtcagccaagtcccatcgtccaccctgtgtaggcctgacctgcagcaccttcccggccaccccaccctagcgctaacccagtgcataggtccgtactcctcctgaaaatgtatgcaaggtactaggcatttgcgtccccgtgacttttcagagggaggttctgtaacttctatcagatctaagggagtttgtatgccccaaaagggttaagcctgttgtggtctttgttggtcagtagccagcattagtgcacttgacccctgctggaaagtccagctggccctggggacaccctggagtaaggaaccactccacacacagaggctacgagtaacaagacataacgccttaggtgtactgaatgtatctggggcttacctatggattggtgggtttccagcccttaagtaaaagctttaaggtttaaataaatgccttcaggggtgatggttctggttatttcattgtctgtgaatttaagactagattgataaattcattcttcaagatctttactcttgtccccaaagaagtgagtataaggccatcaaacagtgataggcagacgtgtgtgtatattgttcaggccaaagttgtaagcatgaatgtttgttccagatcccagtagaaactgagttctctagacctctttttataaatcaaaactgcatttttaaacagctgtaaataacattaacttagaaattgacaatcaaagttgtaaaggtatataccatgattcaatttggcatcttacttaaaaatttcttttatcttggccgggtgtggtggctcacgcctgtcatcccagcactttgggaggccgaggcgggcggatcacgaggtcaggagatggaaaccatcctggctaacatggtgaaaccccgtctctactaaaaatacaaaaaattggctgggcgtggtggcgggctgctgtagtcccagctgcttgtgaggctaaggcaggagaatggtgtgaacccgggaggcggagcttgcagtgagcagagattgcacgactgcacttcagcctgggcgacagagcaagactccgtctcaaaaacaaacaaacaaaaatttcttttatcttatcccaaactcagattagtgtttcttccaaagctgccctgaacgtctgtcctggcacccaccttctccctgtttggccaggactctagagcttcagaaggctgctgggccgggtgctagagcttgagaagtaatttctgcagctcttccggagggcacaagttcctttttttaagaatgcaaaaccctgtatgactgacttatttccagtcacaagactgtgactttctacttgcctgaataagagagaaaatctcccatcctcccccgttaacatttcagctgaaaattgctgagtgttacttgaatctaggcacagtttaccccttaaaatagtttcagcttccctgtagcttttataaacattcaacataagttgcttagaagtttttaaaaatgatgttttaaatgacattcaatcagggtgccaaaaaactaatcactatacagagaactcttcacttagccatgatttagtatctttttgaaactccatttttctatgttagctattgtagaaagcataactggtttataaggtgtgattattttcattcttaataaattttctaagtttccattagtcctttttggaatttggtaaaataaaaggcccaaacaaccaaatcctacttagcagttcttacacggtgttgtacatatgaggttgggctcaggagattttctgcaagttatattttaataaattcccaatatttgtctcttggggcttaaaatatgtcctgaaagggggaaaagaaaacttaactaaaaattccctttctttccattttggcctaataagtttcttggtatgtaacttgtgacataattctccattattttataggcatgttttccacaaatcctgcgtggatccctggcttagtgaacattgtacctgtcctatgtgcaaacttaatatattgaaggccctgggaattgtggtacgtttcctattttatttgttaccacttttgtatattattatatgtatgtgtaatacaatataacataattggcataataggaggcatgactaagacacagaagaaaacactggctatatttgccatgtaaccatgtaagcccaacaggacctttttaccagattactaagaagtctaatccatctcagagaactcctggaagagaaggtaaataactctactaggcctttttttttctttttttaaatttaagagacaaggattcactctgtggcccaagctggagtgtagtggtgcaatcatagcttactgtaacctcgaactcctgggttcaagcagtcctcccacctcgccttctgagtagctgggactacaggcatacaccgccatgcctggctaacttttttgtttttttgagagggagttttgctcttgttgcccaagctggagtacaatggcacgatcttggctcactgcaacctccgcctcccaggttcaagcgattctcctgcctcagccttctgagtagctgggattgcaggtgcccgtcaccacccctggctaattttttgtatttttagtagagacagggtttcaccatgttgtccaggctggtctccaactcctgacctcaggtgatccacccgcctctgcctcccaaagtgctggggttacaggcgtgagccaccgtgcctggccacttttttatgttttgaagagacaagatgttcaggcgggtctcaactcctggcctcaagtgatcctcctgcctcagcctcccaaagtgctgggattataggcgtgagtcaccacacctggcatggtccacttttaaaagggtgcttctgttggtcgatgagtatgggatgaagaaagagagaaggacatgatttttcttcattccagtacctacctttagaaggtaggctgtatgctgttgactctgttccagtcataaactcctctgtgcttggcataatataaaacgatgtcattgcttatgttctttagcctgaagtttgactttgatctcttgagggttggtaagttgcaagcagagaaggcaggcagtgactggagcccaaggagaactgttgacaaccacagcctggcaggggctgtcgccaggcgtgccagagtccagctgtggcaggtgccaggtcaacactgacttgagtaaccaaggaccttcgttagcccttgcttaagagaagcatgtatagccagggttatgctttttattggaaaataacatagtttctggtctcaaaaaagaatgaaagaatgatctccttatggaacaaaaagtttagtttgatccaacagatgaactcattttagcttgcaacccaaaggagatcgaagtcatcttattttaaatatactgtcaaacacagtttcagtgtatacagttgggcagtaatgccccatttgtcctttgtctccagagatcatgtcagtagtgatgggatttctcaaagtatcgggcattagtgacaccatggactggacaatcccttcttgtgggggctgtcctgtgcatcgtagaccgttcagcagcatctaaatgctagtagcatggcaccacagccacgacagtcagaaatgtctccagacgttgccagatgtcccccagggagcaaactcacccccatttcagactggtctaacatagagcatctgccatgatgcctagcacagtgtagaaactttctctctttttttttttttttttttttatgagacagagtctccctttgtcacccaggctggagtgcagtggtgtgatctcagctcactgcaacctccacctcccaggttcaagcagttctcatgcctcagcctcccttgtagctgggattacaggcacctgccaccacacctggctaatttttgtgtttttagtagagatggggtttccccatgttggccaggctggtctcaaactcctgacctcaagtgatctgcccttctcggcctcccacagtgccgggattacaggcgtgagccaccgtgcctggccaacagtgtagaaacttgaaaaacagtaacttaccctctgttgttaccgctagccgccgccttctttttttgtttgtttgtttgtttgttttgagacagtcttgctctgtcgcccaggctggagtgcagtggtgcgatctcggctcaccgcaagctccgcctcctgggttcatgccattctcttgcctcagcctcccgagtagctgggagtacaggcacccgccaccatgcccggctaatgttttgtattgttagtagagacggggtttcaccgtgttagccaggatggtctcgatctcctgacctcgtgatctgcccgcctcggcctcccaaagtgctgggattacaggcgtgagccaccgcgcccagcctgtttgttaagtatattaagtgctaatacttttctcctctgtttataacaaaaatcctcctaaaatgtattgcaggttatcattggatccttaaatgtaatgaacataaaaaaacctcttttaactgggtgtgagcctaagcatcacttagtacactgccttttgctgttttaaataaggctttgagatgacctgaaacagttcttttgcccaggaagccattagttccaggtttggttggctgaaacttctctctataaacatacaaacttctcacaaccacccctcccagctgtgcttctcatgtgctgcctgctgctgcctgctgagagaaccaaaggttgttaggtaaacaaatagccacattgttacaacggaagacttttggtgctcactttttaattggtagactttggccccaagcagctctatacctctccctcaggattaggtgcttaggttttgaaacagatcattttcttatagttcaaaagtcttttcaactttgacctattcttggttttatgcttttcttgtgtttaaaggcagaccatacttaaaaactgactaccagataaatggggcttttagagaagttagtaggatgaaagaggtgttttctattacctgggattcttcaacatggacatttaccatgaagcaaagtaatagtttactcttttaaactggatgtttgctatctttatgttaatgattacgactccctgtgcctgtgggccatgaccagtcttctctgatctgcaatgaattttagttttcctttgtaacatttctgagaggagatctctgtgccttttgaagaaaaactcttagggtgagagaagaaggagtaggtaggtgggcagataaatgagaggacatcacaggaaaagaacctggtaaggtctttgcaacagggcgtcaaagtttagaatcttttttagaatcttatgaaaggttgtgttttccttacaattatttttaacctggaaatattttgcagccgaatttgccatgtactgataacgtagcattcgatatggaaaggctcaccagaacccaagctgttaaccgaagatcagccctcggcgacctcgccggcgacaactcccttggccttgagccacttcgaacttcggggatctcacctcttcctcaggatggggagctcactccgagaacaggagaaatcaacattgcagtaacaagtaagtgggggcctccgctcaggcacagggcatgtggctgcctatgtgggcattcgggaccatcaggagagtcaaggcactcgcctcagcctgcaacacagactgtaaccaagaaagtgatgtgtgttgctgttaaaacaggtatttggaagaatgaaactttatttatgataagtagctggtgtgtttgtgtataattaataggaatagctgcatttgatgagtagctgttcagaggtctgtcttagtcgctgttttataaaccttgttttgaaatcattgcattacaaacaggcatttaaagggagatgttggaaggtgacacagtcccccagcagtattgctggtgtgttgtatgctgtgagcgctcgtgctctccacctccggggctacaggctacttagtgggaaactcatctagaacttgaacctaaaaattcacagttcttggaacatagcctgttgcgcactttattttacattttttatggaagtttggtctcttggcacttaactctttggtgtagttgtacatgaggtaggagaaaagccaaaggacaatctgcctgaaaaaaaaataccgtgagctagttatgaacgtcttcacattgcactgtcgactagcaggaaagaaatgctgagtgtattgatggcggtgcctcaggacggtgtgagtgagctgacagcgtgtgtgtaggcatcatagacattcagccctcaacaagccagctcttctcttcgcttccattctctacatgttcctttcatctaacaacctttcacccatcttcctggttgctgctctgctgttgcctttcccagcacctgctgctgcttgcctagcacgtcacgccctgaggctcgtgggacccttctccagtctgggagtcagtgaaatggatgacactgttacaaaatgtttctcctcacatgttaagactcgtgtggtctgttcaatcaaagtattcatgtttttaaccaaccagacattattattagaaaatgattgcccaggttgtattctgtcatctgtgtaaactcagggaggcttcattcagctatgcaatagagaaaactgtgctttgagtgtagtttggctcatttctcaccatctctcgattcgtttaatagcatttcatggttttcttactttggcgttgaggttttatggtctacagttttaaaacttgattgagtagtaataaaggacacaaaggttgttggtttattagtgagtttttcaggtccttcattgatcaaacatttattgagcacctactacttactacattaagtactgatcccattacattttatgtagaaatgtcctttcaaaatcttatactttgatgaaaaaaagttacttcatataccaaattaatcacctttagcagaatttgcacatgatgttaataaataaaacccacgtgattgaactaaaccacagctacctctgctttccctccgaagccctgggcaccgtagcaaccacagtgcctcccgctggcacccactgtgtgccaggcactgtgctaagtaggcactgggggcagaggtagccaggccggctgcaggggggcactgtggaaatgctgccagcatattgggtgttttatgatggtgtttacttccttttgttactagtttttaaaattgcaatcacacacacacaaagacatgcaaatacgggatggtagactcagaatttggaagcatagatgtgacgaagttctacaaggtagtctgcatatcatatataaaagtctccaagaagaaaaaagaggatactgtgttaagttccttgatgatgatgacattcggctcttgatttttataaatgccatatacattttccctaacttaaaacattacaggtaaaaatggtgggttttatatgtgtttttgaatgttcatgctgattaaataaaaagcttcaatctactgatgaggaagtttgtaatttgagaggccgtggctgcactggtgtctaaaagataggggtttactaagcattttaataacacaagctaaggtgggcagagaaatgctcctagagcactctctggaccggaagtccccaggagcagtgctgcgtgaccttttgaaagtcaccacctttaaaatctaacaaaagtatgtttttctagaaaaatgcctatgcacacacaattctgcatgcagggttaggatttgtggaacccagattgagaaacacacatgctgtatacagcttgtgcataaaacatttggcagtccacgtgtaaagagttctctctgccttcttgcacatatataggtaattttattgtataacattttgttaaaacagccctagtcagtgtgtactcaaagaaatattttatagttaagactttttagcaagtcagattggttcttaggttgttttagaggttctcaataaatactgtttttaaaatgttaccttgacaacataggctctgaaaaggtaaaggagaatatctggatggagagagagagacagtctagtaaacatccttattgttgtaagcaccagaggttttcagctctgtggtggccaagtacccggtcagtcgcccgcccctcctacttgtgcttgtcacagcctggacagccagtgctgctcctcggcaggggttgggaagagtagtttctactttcttgagacaccagtgagatgtcctttttacgtaaatatcctaagtaagcccatgcataagagagaagaatgtagccatggatgccatgggaggccggctcgcagacggctgggagcacccacaggacctggagaactgctgctccgtgctcctcagcctttgactaagaatgaaagccctgcagaaatgacagaatgaagaaggaaagaaggttataaatatgcttagtctactttactgtcatttacattaacaatgaaaaaaatctatgtccttgtgcaattttatatacatattttcaccgcacactttttggtggctacactcctcacagacctcaggacctaaatggaagaaatggttgagccatgctttcctttctcccttgcagctttcaccagtacttccactaaccttctccagttagtagctctctggcaaacctcctgcttcacttccttgggccaatcttggcttacacctccgttgacgtctgcttcgttgcatttgagggaaatgttggcatcgatttgacttaaaccttctccccagagtgatttcctccctttcctttgtcaacagaagaatggtttattattgccagttttggcctcctcagtgccctcacactctgctacatgatcatcagagccacagctagcttgaatgctaatgagtaagtaacaaattgtttttggattgcatgtgccagatgatcccaggaaaacacatggagcagttttcatgaaggtggtgagaactggctttctaccagtttcatacggatcctgatgggatcgtatctagcaaaatactttatttcatgagcatatatttttagtcagtaacacagattgggaattcaccttattcaacaagagcagcccgtttgagaaaagatccagaggttttcattagccacaggcttagaatgaatcagcagtgtaatgcaagtggcaaaggagcagtatagtcttagagtgtaaaaggctgtcagcatcctcatcgctgatgggaagagcccactttgcgttcatcacacacatctggagcctggcatgtctagcttctggggaagccccggcggccgtgcctgtggtcaggaccagtgccttgggtacttggcctgcaggaaagaagcagtttgaaagacccgctgtttccagatgttaggacagctgtgaggaggaagagaaaataagtctaagcgctatctccatgggcaaaatggcgaccaaagagcaggctccatgacggcaggcttcacgtcggtaaaaggaaggacgtctgtcggtggggttggttagtggcgggatggtttgctgtagggcacgctcaggactgggaatgtaggcagaggctggatgtcacttgtcaggggtgctgtagtgaggtgttttgagaggatggaggattgggctagatgactgttatggtccattttgatccaatgctgttccaagagtagctttccatagggataaggtatagaaagggtttttttatttttgctttgttttgttttgttctaaattttggacatttactgaggatatcgttcagtcctttcttttaccaatattcatgaaaactaattagagatgaaagcaaccctggggtcctgcccaaatttgaacctaggttgatatgggtggaattcacgtgatctccatattcaattacgtcctgatactttaattgatgagtaataaccaaactgattacctcatgcagttgatgtaattgactgcccattgtctggctatagaaactgtaattgacatctatagaaacaatgggcaagtggcctccacttgcagtggcatgtgttattcaatctaacctcatctggggctagatacttggaagaagtgccccctggcatctgtgagccatacatgttgaggctcacagatgtcagggtcgggtggcattccccagccttcagaggagcactgcacctcatccagcaggtgaaccactagctgctgctgttggccacccaggcagttttccttcagcatggcgcacctaattccttagactctaggtcacacacacctggatttgactctcagctcctccgtttttcagttgtaagacctgggcagttatatttatttgaagctccttgtagtcattcataaacagataatgctaggaccatatcgcagggttgttatgagaatcagcctataaaatgcttagcacagtgcctggtacataagaagtgctcaataaatgttagccaagccaatgccactgcagtgccattgaagttgtgtgagtcagatgaccatctgcctttattgtctgggaagtgaatttaatttcttctgtgaagtgggacacagtaccatagtagctctgtgagtagctgtgattcaaacctgagtttagagggaaacacttatttcacccacagccacctcttttgcttattcccatgctaacccatcaggcaagatagtaatacaagcctacttcttaaaaagttcacaaatgagtgataaccagtacaagcaaataattacactaggcacttttcgagaattattgggtagtttaatagtcacctgactgccactcagaatctgtctgatgttcagttcatgcatcagattaaaatgagagtgctcagtagacatgttacctattagaaatcatagtatgtgggccgtaatattttagttccatgcctaaatacctgcatgactcagaatctaagtcatggatcttagatccatgccttacttagttcaacccttctcccattagcagttgtagagggttgatttcacagttgctcatttggttattatttctgtgccttcagtcaaaaccaccgaaggacaatattcatgatcccatttagagagaaaaatggagagagtgtgtgtgtgcgtgcatgttgtgtatgcacgcatgtggatacgagcaaggatgctcaccagaatgtggtgattatcttactttagaatctggggcaacgtcttcttcaatttgtgcttttatgtgttgtgttttttttttttaacagtaagcatgaattacttaatctttttaaaggcagtttttattgtggcagatgataggaaagataatagtactcttacccaatgtctttttctcaaaaatatcaatgaaaaattcctactgattttattccagagaaaagtttattttagcaaacaaatttgtaattattcgttattaatgaatttttcaacatctattttatttctgtttttgcctttatctaccaataaacttacaaccaaaataagatttttttttttttcaccttaattgccctggcttaattttctgggtaacctcatccatttgtaagatagtcatatataaatagatttcatctcttggcattttaatgactgtccaaaaattgatactaaactccacctctatgcatatacctactagaatagtttacctttctggcagtgttactagtcactgttcttgtatattactgttcaagcaagtccttgaccctgtctactcactgttgaaaccctgtgggcaagatgtcagggcagtgtgtgggacccaggtggtctagggccccctgtcatgggtgggttgctaactacacaaggaggatccccacaaggggtgcaagcccccatcccttcctcaccacgctcggtgcattgaccaagggcttcgtgctgttggcttcaatcagaagtccatcaaaaagcccttgtgtttggagtcactgcccttctgttatgatgaaatactgtttatttagtactgcgactgattatacattaaatttttttaacactgcaaacagatctggtaaattttgaaactttgcaaatataaacaggatggtagtcaaagaagtgaataaatgcaaggtaaatatatttacatattggcttctcacacctcggtttcttagtacctaggtaagcgaggttactgaatttcaattcccaaaagaggtcttctgctctacttggctattcatataaaccttgtgaaatgtcaacatttaccaactgaaatttgtgtcactctagttttccctcaaaataagaaaaataaatatttttattatttttatttgaggaacatatacaaatgtgtagtagagatttgaagtttagtgggaggcgtgactaggtatcccctagagcccttttcccattgctggattctgattcatagaaatcacgttctaagatttgcagagaacggtagctcattattcaagattcaaaaaaatcttggcatgaggaaatgaatctgaagtggtaaaggtgacgaaataactagagcaaatgatccagtggcatgaccggagatcaggaagccctggcttcttgtagcaggtccaccagaaagctcccggtgatcttcctcctcttagtgtagtagtagaaatttatatatataaactcctttatttatacaaaaagaatgatgtttctattttactctcagtatttctgaattattttgctcagtactctttttttttttttgagacggagtctcgctctgttacccagactggagtacagtggcgccatctcagctcaccacaacctccacctcccgggttcaagaaattatctgcctcagtcttctgagtagctgggattacaggcacccgccaccacgcccagctaatttttttgtatttttagtagagatggggtttcactgtcttggccaggctggtcttgaactcctgaccttgtgatccacctgtctcggcctcccaaagtgctgggattacaggcttgagtgctcagtactctttttaagaggaatattgagaaactagcacactcagcataaaagggtctgaaaatttaattatttgatgtcttggggatgcttggtttggaagagaggggaccgggtaagatgagagctgtttccaggtgtttgaaggactcttaaagatgagaataacaaagatgagaataactactgtttattgaatgcctaccaagatcttagtcctgcactggtctcttttacccgtattgcctggtttaatactcaaaagagcctcatgttgactaaccagtgcatacagagtgatgcttactctgtatttctggagctctggcgatatctacagggaggcagatttccacttgatataagaaagaactttgtggcctggcgtggtagctaacacctataatcccagcgctttgggaggctgaggtgggcagatcacctgaggtcaggagttcaagacaagcctagccaacacggtgaagccccatctctactaaaaatatgaaaattagctgggtgtggtggcaggtacctgtaatcccagctaaggctgagacaggagaatcacttgaacctgggaggcgaaggttgcagtgagccgagatcgccccattgcactccagcctgggtgaccagagtgaaactctgtctcaaaaaaaaagaaagaaacaactttgtagtagttaaaattgtccgtccaaaacacgggacactttgaaagctagcgagcctgcaccaggacctgattcttcagacagaagctacaggatagacctgttcacaggccgacctcagatcaggtagaaggctctgagatgcgtcctgtgctgagggtccctcttgaattgttcctaggagggatcagaggccgaggagagctgttgggttctctttcagttacctcttttagaaccttaaatatcaaaagcagtgtttttcagactttctaaaaaccatcttcctactgtaagagatacattttgtgttgtgacccagtactcccatgtgtaactgaaacaaatttcacacacttccctgactgcatgcagtattctctgatgtagtcagtcctgtgccttgttgttaatattagtcgttaactcctaaattgatggtataaccattaataggttgtatgctttagttttgagaaacacttgtctaaagaattttgaatttggccgggcgcggtggctcacgcctataatcccagcactttgggagaccgaggcgggcggatcacgaggtcaggagatcgagaccatcccggctaaaacagtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaagaattttgaatttttagttctcaacctgataaccttttgctcacacagcccgtcttgtaacaattccagaaaagatttaaaattaacctctgtttgaggtgtattgctggatagtggatccttttctttctcttggtatttattctccttgtagccaatctgagtgtgagatatatgtacacaaaagaataaagtagggcttcgagggattgagtgactctgaagggatgccataggaagaaggccactggaattcaaacccagcacctctggttccaaccttttcctttaaactgcttgcatttgactacttcagagaggaggatagtgccaaataatgtggttgaaggagacaaatttggtttcctaaaaatgcagttgcaacatgagtattaaaggcagtgggaacttgcacttctctgctctctttggcagtggttattattttgctttattttatttatttatttgagacagggtctcgctctctcacccaggctggagtacagtggtgggatctcggctcactgcaacttctgcctcccaggttcaagcagttcttctgtctcagcttcccgagtagctgggactagaggcgcctgccagcacccctggctaatttttgcatttttagtagagatggggttttgccatgtgggccaggctggtctcaaactcctgacctcaggtgatccacccacctcagcctcccaaagtgctgggattacaggcgtgagccaccaggcccagcctataatttctttaagaggcaacaagataaagtagatttgaaaactaaattacccctaaaaattctttatatctaatatccagtttttctgaggaaatattagaaaatgtgttaccttaaataggaactacaagaaataataaggtacagaactttatgtgaagttgtgaatatcctttataccagaggtttttcaaaaaagttgacaacgccccctcattcattgagatgctgtttcccaagtaggctcccgggcttgtgccaagcacggggctcgcagtgctgaaggtaatggagacctggtctggccccgccagagctcagggctatgccctcatgtgcgtactgatgtggctggagagtgagggagtacgcaaaggcccttctgggtcatgcctgcggagctgccgccttacctttgggggagctgaaaaggctgcatggaagagtgacttaggaaccagcctgggcataattagggcacacagtgaggaccgcacagagcaggatcagcgagttgtgtggtttggtgtgtctgctgtaggtggtggtgacggtaggcaggagacagattttggacttgattcttataaagagctggtaatgggctctaaggcctttcagcagagagatattcctagtggctgcgaagttgcttgctgtggtagggcatgaaggcaggaagatagattaggtaaaaatagggagttgaaggagcaagtcagggtggcgagcaggagctgaaatcaggagttgctagagagttgtgtaataaccaaagcttatatggtttgaagcagagatctggagctcagcagaaagaaaaagatcaacgctaacagcttgatttggggaccctggaaatgagcaggaatccaaggcatcagaaagccaggacagccccacagcacagggctgcagagagggcagcaggagctcgggcagcgcaggggcttgtcaaaaggtcataggctgtttttacacctgatgcaaggacagaaacacacacaaggtctggaggattcctgtgagacagccatacatccctatcacttcaaaataagtgaggacattcttgtttgagaggtaagaggagcattttttaaagacaacagcggcagatttcagcaccctcagcattcagaacatgtgtttaaaccaggaaaaattgtaaattgtatgataattgtccctgtgtatttaaacaacacgccatgggcctgaccttttccttcatccttttgggagtattaaagcacctctaagatggatgagtcagtcaactgcagatctgaaactgctgattttgggaaaacacttaatggcttcctggccttaccagaggggttgggaactagctggggacagccaggccacccttcagttagggtcacttctctgttattttaaacatttgactactctttaatttatgacctcttttttccttttattccatagggtagaatggttttgaagaagaaaaaacctgctttctgactgattttgccttgaaggaaaaaagaacctatttttgtgcatcatttaccaatcatgccacacaagcatttatttttagtacattttattttttcataaaattgctaatgccaaagctttgtattaaaagaaataaataataaaataaaaagtctgt

SEQ ID NO: 38233 - DNA, 640227 bp, Homo sapiens
atggatgaagagaggtccagtatgcttcctaccatggcagcaggtaagcctggcccagatcagggcgccaggccttgtgacacatggcagaggggctgccttggggcagttccacagcgccatggaatgttgtgattcttctgtccctcaacaactcaatgagtcacttgctgctgtccttcttttactagcactgaatgttggtttttaaatttttatttctttaaagagagagcctcactctgtcacccaggctggagtgcagtgatgcaacctcagctcactgcaacctccgcctcctgggttcaagtcatttttctatctcaaccttccgagaagctgggattacaggcgcctgccaccacgcccagctaatttttgtattttaatagagatagagtttcactatgctggtcaagctggtctcgaactcttgggctcaagtgatccacccgccttggccttccaaagcgttgggactgcaggtgtgagccaccatgcccaaccacagtgttgggtccatttatctagaatgtgagaccctggcagagaaagcgaagatttgaaggtttttagttgggctttggagatgtaatatgcattgcggggaattggaggtgggagacctatctttgaatcctggctttactccttgctacctggtgacctggggcagatgccgtaagctttgctgccttttctttcctctctgtgaggtgggaatcatgctgtctcagcagtcatcttcatggggctgtgagagaatcatgtgagatcaggagtcgcacacacgacgaatcaacatggagagaccctgggttgatgttagtcggtggactgttacattgttcaccctttgactcaaagggtgaaggtggaatcagctggactgaagtgggcaacttgcttcctctttccaagttctttgttgcctcctttttgtttttccttgaaaatttatactaaactcatatatctgggcttatgttagtcctgtccattgatgagaaaaagaatttgaccatgatttcctttgtagatcataagatgcccagtgtaagtttctgtccacattaatgatgatgatgttaccagtgcacatttgatggtttatggagctgagtgttttgtgagagattgcctttaatacttacaatcctgtgaggaagataatattgtccccatcttacagataaggcgactggagtacagggagatgataagttgctggaccaaggtcttttttttttttttgagacggagtttcactcttgttgcccaggctggagtgcaatggcatgatcttggctcaccacaacctctgcctcctgggttcaagcgattctcctgctgcagtctcctgagtagctgggattataggcatgcaccaccacgcctggctaattttgtagttttagtagagatggggtttctccatgttggtcaggctggtctcgaactcccgacctcaggtgatccgcctgtctcagcctcccaaagtgctgggattacaggtgtgagccaccatgcccagcctggatcaaggtcttgtagctagtaggtggcagtgctgggatttacccccaggcagcctgatcccgggacttgtgcctttacctcctcccagttgaattcttattcatattcatcttcctggctgttagggagagaatgtggcatgactcaactcccatgataacggatgtctgctgaccccagtttcatgggaggttgtttttttttttttttttgaagccgagtcttgctctgtcacccaggctggagtgcagtggcacgatctcggctccctgcaacctctgtgtggcaggtatttttatacctatttaagatcaacgtgtctcctcttctgtaatctgttgtctgcagctgtcttctcttattggtggtatgactgcccatcagcaagcactccagacttttccctttttttggacaggtccgaactccatactctttgcgattaacattgacaacaaggatttgaacgggcagagtaagtttgctcccaccgtttcagacctcttaaaggagtcaacgcagaatgtgaccttgctgaaggagtccacgcaaggagtgagcagcgtgttcagggagatcacagcctcctctgccatctccatcctcatcaaacctgaacaggagaccgaccccttgcccgtcgtgtccaggaatgtcagtgctggtgagtgggaactggtgctcgaggcggagcagagggaatcagaatgtggctgatggggtggacatacctcatcatctgaaagtcattccaaggggaatggagtccagtgcacttgcgttttccatttgtgtttctgtttctcatcctcattcactctgaaagggctctgatggccttacctagatgtgagaattgctgggtggaaaaatgaacagctcaaccagagcgaatggaaagtgagggtgtgagagacaccgggagccagatgacgttgatcctcattcattcattcctttatttgttccttcatcgtattctgtgtgttaggcggtgagccgaataggaaagacagattgccagcaggtagcctgcagtctcctttgggatgggtgtgggtgggtagttcatgacaaaatatataatttaggatccttaggataaaagggatgaaagccaagcatagactgctatggggaacatctgccattgggcttgcctctgattggggatggcatttaaggcctcaggaaagagaggagttgtcaggtttgactctaggctctggggaggcaaaagagagttgattcaggctgggcatggtgtctcatgcctgtaatcctagcactttgggaggccgaggcaggaggatcacttgagttcaagggttctagaccagcctgggcaatgtagtgagaccctgtctcaattttttaactttttttttttttttttttgagacagagtctcgctctattgcccgggttggagtgcagtggcatgatctcagctcactgcaacctccacctcctgggttcaagcaattctcctgcctcaacctcccgagtagatgggactataggcatgtgccaacatgcctggtttctttttgtatttttagcagagacagggtttccccatgttggccaggctggtcttgaactcctgacctcaggtgatctgcctgccctggcctcttaaagtgctaggattacaggcgtgagccactgtgtccagcctgtttttaaaaaattttaattaaaaaattaaatataaaaaaagaaagttgattcagttaagattaatttggtgagaagttttcaataccctttgattcctttgggacattaagatgttactacagcaaaattggaaattttgttgtagtatgtatgtgtatatatgtagagacagggtcttgccatgttgcccaggctggtcttgaactcctggcctcaagtgatcctcctgccttggcctcccaaagtgctgggattacaggtgtgagccactgcatctggttgaaattggaaattttgggcttaagtacttagtattctcaaatctcttaaacaaggcagtaactgtggccatccctttggaattattgatggtgaccctgcatgaaccttgtaggagatagggctgttgacagctttgtgtaacagacactgaaatttctacacccacaggagtagcagtcccacccatttttggaactgcttttgaggtgatctcagagttgtgctataccagtgaggcctcaccacatcacacattggtttagacagattgggtttttggaattggctcaaagtgtcttacatccaagtgtgatgattaaaataggggcacaaagtgtcttctgtgagagctggtcactaaggcaagcttgatttctttttcagttagcatttgctatataacaagtgatttaaaaatgtagtggcttaaaaccaccgcagttcgttacttttttgtgtaggttggcatggtggctctgctgctgggctccttcggctcactcatgggagctcgtggttagattggaagatctaagatggccccatccacatgtctggaatcagtgctggggctgctcagattctactcatggactctcatcctccagtcggctgaactggcttctttatgtatggggtcagggccactgtccaggagagcaaaggcaaagctgagaccttttaacgcctagctactagaactcacacagtgttatttctgccactttttttttttttttttttttttgagacagagtcttgctctgtcacccagactggagtgcaatggcgcagtctcagctcactgcaacctctgcctcccatgttcaagaaattctcctgcctcagcctcccaagtagctgggattacaggcacctgccaccacgcccaactaatttttttttttttttgtatttttaatagagacggggtttcaccgtgtttgccaggctggtcttgaactcctgacctcaggtgatccacccgccttgacctcccaaagtgctgggattataggcatgagccaccgcacccggccctttctgccacattcttttggtaaaagcagggcatggtggctcatgcctataatcccagcaatttaggaggctgaggtgggagtattgcttgaggccaggagttttgagactagcttgggaagcacagcaagacctcatctctacaaataataataaaattagctgggtgttgtggcatgcacctgtagtcccagctactcgggaggctgagggcagaggattgtttgatcccaggaatttgaggttacagtgagctatgattgcaccaatatactccagcctgggcaatagagcgagatgccccaactcttaaaaaaaaaaaaaaaaaggcagagcactacgccagccagattcaagagggtgcagaaatagacatcacctctggctgggaggagccacaaagacccattgcaaaggggcatggcacaggaatggcaggaatttgaggctgctcaacacttgactacaccccccagctggttctcctggtctcatctaccagctatgagaatattttccaaagtgaagcattgaagatcattttggtaatggtagcatccttcacatcaaagtgactgcttggaaggaacagtttcaaggtgtgctctgtggtgtgtttatttaaatcagtgggagaggcctgcatccattctgctcaatcttctgtacacagattttcactgaggattttaaaaagtctgaattcatgttacagtgtatttctcactagaatagtattttccacaacctggaagtgagttggtttcatcatccttttgtcttgcctactttttcttatactgtatcttttcttttttttctttttttttttttgccagatgccaaatgcaaaaaggagcggaagaagaaaaagcaagtgaccaacattaactcatttgatgatgaggaagatgagcagaactctggggacatgtttaaaaagacacctggggcaggggagagctcagaggacaactccgaccgctcctctgtcaatatcatgtccgcctttgaaagccccttcgggccaaactccaatggaagtcagagcagcaactcgtggaaaattgattccctgtctttgaacagggagtttgggtaccagaagcttgatgtgaaaagcatcgatgatgaagatgtggatgaaaacgaagatgacgtgtatggaaactcatcaggacggaagcacaggggccactcagagtcgcccgagaagtaagttcccctcacgcttctgtgtgtgtgtgtgtgtgtgtgtgtgtgtttgtatgtaagatggagtctcaccgtcccccaggctggagtgccgtggcgtgatctcagctcactgcaacctccacctcccgggttcaagcgattctcctgcctcagcctcccgagtagctgggattgcaggcacctgacaccacacccagctaatttttgtatttttagtagagatggggtttcaccatattggccaggctggtctcaaactcctgacctcaagtgatccgcctgccttggcctcccaaagtgctaggtttacaggcatgagccaccaagcccagcctccccttgtgcttttaatgagggggttaagttcaccgttttctctttctatggtattgggtgaaataggtctgcaagttttatatttgcccagggtatcattcattcttcaggtgttgatttaggagtgttatttggaaggagtgttatttgctcttcccttgagaactgaaagaggggaagagagtacatttgagggcacttaatacaaagttaatgtcagaatgtgtgccttgaaattcttgctttatacatacatctgtaattttcatttcacagggttcacagggtttcacagtctgatgagactgtgcctgttattgttttttatttttactctggattttccttgcatctgacttgccactagcacaggaagctcaggacgaaggcagcgttaggagaatagttgtggtatggtgacttctgtgtttatctgcaggggtgtgaatagctgtaatatccactgcacctgctgccttaacagtggagttggccaggcgcagtggctcacacctgtaatcccagcactttgggacaccaagttgggtgggtcacctgaggtcaggagtttgagaccagcctgaccaatatggtgaaaccccttctctactaaaaaaatacaaaattagccaggcatggtggtgcatgcctgtaactccagatacttgggatgctgaggcaggagaatcgcttgaatatgggaggcagagccaagatgacaccattgcactccagcctgggcaacaagagagaaggtccttctcaaaaaaaaaaaaaaaaaaaaaattcccaaaataccccaaataagctagttacctcttaggctttgtggtgcacagtgccctcctaatcatgactactgcaaaatccagtccattaaagtgtaaaatgaggccaggtgcagtggttcatgcctgtaatcccagcactttgggaggctgagttgggaggattgcttaaggccaggagtttgataccagcctgggcaacatagcaagaactccgtctctacaaaaaataaaaagtgtaaaatgaatatacagaaatgtatctctctatttgacctaaatcttatggatcgcaccattgcactccagcctgggcaacaagagtgaaactccgtctcaaaaataaaaaataaaaaaaacattaaacttcaagtccgggtgcagtggctcacacccgtaatcccagcacttcaggaagctgaggggggtagatcacttgaggtcaggagtttgagaccagcctggccaacatggtgaaaccccatctctactaaaactacaaaattagccaggcatagtggcaggcacctgtaatcccagctactggggaggctgaagcaggagaatcacttgaacccaggaggtggaggttgcagtgagccgagatcacaccattgcattccagcctgggtgatagagcaaagctccatctcaaaaaattaaaataaataaaataaaataataaaataaattaaacttcagaaggaaagagagttgtagccttgattccttttttcccaagacactccttgaggcctatgcaaattttcccaactcctcagcagtcacagctaagtgggccaaagcaagggctagtggaaggagtgatcgcagaccccatgacacccttcacacagagccatagatgactactcaacttacggtcacgtcaccatgggagagtcaccaaacagcatctctctctctgaaatgtcaacatctatacacccatctagtgtctggtttagggtggaaatgtgggtgtaagaaaagtaatttagaggtaattactggcagctgaggggaggagactgttcctcacccagccttgggttagtggagatttggtgcaatggacaaaaacagaggttttgatttggaggcgaagaaagggggcaatggctccagaggccaagagcagagaaggacagccaggaagtgggctgagcatggtggactcaggagatggggagccccatcttgggatgcctcagagacattgtggagggggcctggttttcctttttgaacattttttattgttattattaattaattaatttatttattttttatttttattattattttttgagatggagtctcactctgtcatccaggctggagtgcagtggcatgatcttggctcactgcaacctccgactcctacgttcaagcaattcttctgcctcagcctcccgagtagctgggactacaggtgcacgtcaccacacccagctaatttttgtatttttagtagagacggggtttcaccatattggccaggctggtcttgaactcctgacctcgtgatccacctgcctcggcctctcaaagtgctgggattacaggcatgaactactgcacccggcccttttctttttttctttgagacagagtttcactcttgttgcccaggttggagtgcaatggcacaatctcagctcaccgcaacctccacctcttgggctcaagcgattctcctgcctcagcctcttgagtagctggaattacaggcatgtgccaccatgccctgctaattttgtatttttgtagtagagacgggtttctccatgtttgtcaggctggtctcaaactcctgacctcaggtgatctgcccgcctcagcctcccaaagtgcttggattacaggggtgagccaccgtgcctggcctacaaactggtctatcagcaaggtctttatgacctgtatcttgtgccaacctcctgtctcatcctgtgacttagaatgccttaacctcctgggaatgcagccaagcaggtcttagccttattttacccagcccctattcaagatagagtcgctcaggttcaaatgcctctgacactcctgcctcagcctttgagacagctgggactataggcacacaccaccaggcctggctaatgtcttcatttctattttgtagggacagggtcttgctatgttgcccagactagtctcaaactcctggcctcaagccatcctcccactacagccttgtagagtgctgggattacaggcatgagccaccacgccaggccttggtttttcttagtatgtgggctaaagtcattcaatgttgatggtaaaggaaaatggggccgggcaccgtggctcacacctataatcctagcactttgggaggcccaggggggcggatcacctgaggtcaggaattcaagaccagcctggccaacatgtcaaaaccccatctctgctaaaaatacaaaaattagctgaacacgttggctcatgcctgtcatcccagcactttgggaggccgagctgggtggatcacttgaggtcaggggtttgagaccagcctggctaacatgtactaaaactacaaacattagccgggcacaatggtggctgcctgtaatcccagctactcaggaggctgagacaggaaaatcacttgaacccgggaggcggaggttgtagtgagccaagatcgcaccactgcactccagcctgggcgacaatataataataataattatttttttttgacagagacaaaaaataataatgatactttttttaaaaaaaggaaaatgggaggtgattgtagaaggtagaggatttggagtgatagttcattacaattgtaataaggaccacaagatgctaagagtaatgagatgtagcggacgtctgctatttttgcctgttcagcatccactcgttctgctttgtgtgatagcaccccaagcttcctttgaaccagtccttccttcagcggaggccgaccccaccccttcactctgtggggtggccacatgacccaggtctagccaatcagcacattccatcccggagcagcagctgtgtgcccctagcccaagctaggctgctcctggctttgtgtacctattaggggaaaatgtgttctcttttcactgcagttgctaagcatgtgggatgtaagcctggacttgctggtggctgcctttgccaccgcttagggagattctggccaggcatgaagccggcacagagtaaatgaagcagggccaggagatgaggagagatggattctgattgcattatatgagtactaggatctgtgtctgaaatccaaatggctttttcttttcttttcttttctttctttttcgaaacggagcacactctgtcacccaggctggagtgcaatggcacgatctcagctcactacaacctctgcctcccgggttcaagtgattctactgcctcagcctcccgtgtagctgggattacaggcgcgcaccaacacacccgactaatttttgtatttttagtaaagacagggtttcaccatgttggccaggctggtcttgcactcctgacctcacgtgatctgccccaccttggcctcccaaagtgctgggattacaggtgtgaaccactgcgcccagccccaagtggctttttcaattacatgagccaacatattctcacaagtccattcgagtttggtgtctgttacttgcaaataagggagttctgattggttcccagtgaaacctcatctgtaagacctctgagccaccagtatccacggggcttgtcctataacagctcctgtgcaatccagtaaccttgaacactggaagccactgagcccttctgtgagtagatgcacacctctgaggctaagattactggtgtactcattgggaccagtttggtctcagtgactgaaaactcaacccaaacttgttcatttggaaaggaaaagtcaaccaggcacagtggctcatgcctgtagttccagcgctttgggaggctgaggtggacagatcgcttgagcccaggggttcaagaccaatctgggcaacatagcaaaaccctgcctctacaaaaaaaaaaaaaaattctttttttttcgagacagagtctcgcactgtcgcccaggctggagtgcagtggtgcaatcttggctcactgcaatctctgcctcccgggctcaagcgattctcctgcctcagcctcccgagtagctggactacaggcgtgcaccaacagggccagccaatttttgtatttttagtagagacagggtttcacaatgttggccaggatggtctcgatttcttgacctcgtgatctgcctgcctcggcttcccaaagtgccgggattacaggcatgagccaccggtgcctggcctctacaaaaaatattttaaattagcaggcatgatggtgcatgcctgtagtcccaaatgggcaaagttgttctctgattggctgaggtctttgtcacctgctccacccctgagctggagccccacccaaagtaattgactgaaagggggtgttctccagtgggaaattaggtaaggtttacattatttggccctaactcttcacccttccccctacccatgcccttggccatgtaattttgcagtgccctcctgtcacaggcaggatgacctgatgcctcttttttcttttttgagatggagtctcactctgtcgcccaggctggagtgcaatggtgcaatctcagctctctgcaacctccacttcctgggttcaagagattctcctgcctcagcctcccaagtagctgggattacaggcgcctgccaccacacccagctaatttttgcatttttagtagagaaagggtttcgccatgttggccaggctggtcttgaactcctgacttcaggtgatcctcctcgcctgccttgcctcccaaagtgctgggattacaggcatgagccaccacgcccggccctgcctcttgagctggggagttcaagaccagcctgggcaacataatgagatttcagctctattaaaaataataataattaaaaaaaaaaaagaatggccctacctttcactggcagggaagggtggagggccctcctgtcatctccaaatcatagtactgtccccaccagccatagctgatcattttaggagtggttccaaggagtcccaagctgggcccattacagcctctcctggagggttacaattggatgagaagccaatcgatatcctctataattaaaaatataagaacttaggagtcatggggcagctgtgtttagttgaaagcctagagaagcagagagagtccatgtgtttgttacttacggtaatgctggctgctggaacagataagccccgaaatctctgtggcttaacatcacagaagtttattacctgctcagataacagtctaaggcagatgtgccacatggcgattcagggactgctaccttgtggttctgctgtctctcggggcctcggctggtagatagcaaacaatgcagacaggagaagacagatccatgatcttaaccatctcagccccagacaggggaccgcgtcatttccacccaccttccatcagcaagaaccagtcacatgagcacatctaacagcaatgaaggctgggaaatacgtgcccaggaagggaggaatcagtttctttgcagaggagagagggaacagaagagagggaaagggggaaaatagagagacggagggagagaaagagagaagaactaatgagcacagaactaagaaagcccaggcacagtggctcacatcagtaattctagggccttgggaggcaagacaagagaatcacttgaggccatgagttcaagggcagcctaggcaacatagtgggaccctatctccacaaaaataataatattattattattaaataaaataaaaggaagagacagccatgaagataactagctgaggccaggtacagtggctcatgcctataatcccaacactttgggaggttgaggtggacagattgcttgaggtcagaagttccagaccagactgaataacatagcaaaaccccatccctactaaaaatacaaaaattagctgggcgtggtggcaggcacctgtagtcccagctactcgggaggctgaggcaggagaatcacctgaacctgggaggcggaggatgcagtgcgctgagatcatgccactgcactccagcctgggtgacagagcgagaccctgtctcaaaaaaaaaaaaaaaaaaaatcacctggcttgttaaaacagattcctggaccccaccccagaatttgattcaggttgggagtgaggcctgtgaagttgcatttctagcaaattcccaggtgatgctcatgccgctggtcccaaaccacactgtgaagtgccagttccagactaggagactccaaagagacactggagccaaccacaatgtgcaaacctgattgggtcctgatttggaaattaaacatctttaaaatgcattcagggaataattgggttcatttgaacgtggactcaatattagaaaatttctattgattttcttgggtagggtggtgacatgtggctggctataagggaagatgtctttatttttaggagattcacattgaagtcattataggggtcaagtgacatgatatctacagctaacttttatttcacttatttattattattattattttagagacagggtcttgctctgtcacccaggctggagtgcagtggcatgatcgtagctcactgcagcctcaaactcctgagatcaagcgatcctcctgcctcagcctctccaatagctgggactacaggcccacaccaccatgcctggcttacaactaacttttaaatgttggccaggcgcagtggctcacgcctgaaatccaagcactttgggaggccgaggcaggcggatcacttgaggtcaggagttcaagaccagtctcgccaacatgatgaaacctcgtctctacaaaaaatacaaaaaattagctgggcatggtggcaggtgcctataattccagctactcaagaggctgaggcaggaggatcacttgaacccaggaggcggaggttgcagtgggccaagatcatgccactgcactccagcctgagcattagagcgagactccatctcaaataaataaattaattaacatttcagcaaaatacacacatgcacacagacaaagaaaatatgacaaaatggtaattattgaatttcaggataggtgtatgagtgacaattataccactttttcaactcttctatgtttagatgctttaaatatttaaagctaggggctgggtgcagtagctcatgcttgtaatcatcatattttgaggggctgaggtgggagcatagcttgagcccagcagttcgaggctgcagtgagctatgatcacaccactgccctccgggctgggcagcagagcaagaccctgtctcaaaaaaatataaaataaaatgaaataaatctggggagcacgtgggggagggactagtgcatcacagcctaattgaacgagcaggagactgccatgggatgaggccaggcccaactgtgtcagtccctctgggtcattctaaggacttcggattctatcctgaatgcatgaggaaacccttgaaggccttaagcagagagtgacatggtctgattttcttttaagctgtagctttgtttttgagatggggtcttgctaaattgcccaggctagtctcgaactcctgggctcaagtgattctcctgccccagcctcccaagtagctgagattacagataagtgccaccacgcccagctaatttttgtatttttagtagagacggggtttcaccatgttggccagactggtctcaaactcctgacctcaagtgattcgcttgcctcagcttcccaaagtgctgggatgacaggtgagagccactgtgcccagccaattgtacatttttaaataactcaaagagtgtaattgaattgtttgtaacacaaaggataaatgcttgatgtaatggatccccatttaccctgatgtgattattatgcattgcatgcctgtattaaaacatctcatgcaccccatacatatatatgcctactatctacccacaaaaattaaaaaatgaaaacattatccttttgatgcttggccacatggaggacacagcaaacggttcatggccaagcacaagagagccactaatgtctgcaccaggaagggataattatccaattataacccagaggcagcctctggtgtcaatagctgattgttctgaacaagtccagattctatgcttccccaaagctgtgtgaaatttaaaaattcataatcattggcaaatgataatcgtaatacacatgccaaggcactacccagaccaaggaaatccaattcccttggcaccaggatcaaatccaagatccccaggggattctttctttctttattttgagacggattctgctctgtcacccaggctagagtgcagtgacgcaatctcagctcactgcaacctccacttccgggttcaagcacttctcctgcctcagcctcctgagtagctgggattacaggcacccgccaccacgcctggctaattctgtatttctagtagagacggagttttagcacgttggctaggctagtctcgaactcctggtctcaggtgatctgcccacctaagcctcccgaagtgctgggatcacaggcgtgagccaccacacctggcctcaggggattcttgattgcagccaggcagagcctgcagtcccagggtggggagttccagcagtcctatgaaggactggctccagggtccctgagcacaaggttgcaaggccatgttgtcacactctggacctcttgtttgtttgtttgttttttgagacggagtctcgctctttcgcccaggacggactgcagtggcacgatctcggctcactgcaagctccgcctcctaggttcatgccattctcatgcctcagcctcctgagtagctgggactacaggcgcccgccaccgcgcccagctaaattttttgtatttttagtagagacggggtttcaccatgttagccaggatggtctcgatctcctgacctcgtgatccacttgtctaagcctcccgaagtgctgggattacagacgtgagccactgcgcccagccaacagataggtacagtctttatctgttcgtgtggctataagaaagtaccagagactgggttatttataaaaaatggaaattttggccaggcacagtggctcacgcctttaatcccagcatgctgggaggccagggcaggtggatcgtgtgaccttaggagttcgagatcagcctgggcaacatgacgaaaccctatctgtacaacgctaagaaaaaaaaaaaaaagcagggtgtggtggtgcatacctgtaatcccagctactcgggaggctgaggtgggagaatcacttgaacccaggaggcagaggttgcagtgagctgagatcgtgccactgcactccagccgaggtgacagagaccctgtctcatacatacaaacaaacaaaacccagaaatttctttctcacagttctggaggctaggaaggccaagattaagttaccagcaggttggtatctggtgagggcatggtggccatttccaatatggcaccttgctgctatgtcctcccggggggaccagtgctgtgtcttcaagtgacagagggatgtaagggcaatgaaagggcctagctcgttcctgccaacctttttatgaggttactaatcccatgccctcatgacttaatgatgccccacctcttaatactaccagactggtggttaagttttaacatatgaatcttggggaacacattcagaccacagcagatatattgtagaaaagaatagtccgtaaattcccagcagtaacacttcgcatattttgcctcttattacttggagtatactgtgtttcatatggctttttaaactttgtaaaaactgcagcaagtgcctgattacttagggcttctttatctagtgacagactatttagtccattaattttgtgctgtacaacaggaaagagagagaaaatgacttctgcagagactgaatcatctttatgtcctctatggtagttggcacttagtagatattgaataaaaaacaggctgggcaagatggctcatgcctgtaatcccagtactttgggaggctgaagcaggtggatcacttgagctcaggagttcaagaccagcctgggcaacatggtaaaatcctatctctacaaaaactataaaaagtagcgggatgtggtggcatgtgcccatagacccagctacttggaaggctgaagtgggaggattgcttgagcccggggggtggaagttggactgagccaaggtccagctccagcctgggccacagagggagaccctgtctcaaaacaaacaaatctctttaactcccaaaatggaaagttctccaagatatatgttaagtgattaaaaaaaaaaaaaaaaaaaagggccagcctggcatgctggctcatgcctgtaatcccagcactttgggaggccgaggaaggcagatcacctgacgtcaggagttcgagactagcctgaccaacatggggaaaccccgtctctactaaaaatacaaaattagccaggtgcggtggcgcatgcctgtaatcccagctactcgggaggctgaggaggagaatcgcttgaacccaggaggcggaggctgtggtgaaccgagatagcaccactgcactccagcctaggcaacaagagcgaaactccatctcaaaaaaaaaaaaaaaaaccgcatctctactaacaatacaaaaattagctgggcaaggagctaggtgattatagtaccagctactcaagaggctgatgcaggagaatcactaaaccgcatctctactaaaaatacaaaacttagccaggcaaggagccgggtgactatagtaccagctactcaagaggctgatgcaggagaaacacttgaacccgggaggtggagtttgcagtgagttgagattgcaccactgcattccaacctgggcaacagtgcgagaccctgtctcaaaagaaaaaaataatataaagtgaccaggtgtggtgactcacacctgttatcccaccactttgggtggaagcaggaggatcactggagcccaggagtttgaaaccagcctaggcaacatagtgagaccctgtctctatattaaacacacacacacatgcacacacacacacacacacaaaggcagccagactatgcactaggaactgccctgggaatccctttgcgttctcacaacaatcccatttcacagatgaagaaaccaaggcacagaaatattaagtaatgtgtccaggtgcggtggctcacgcctataatcccagtactttgggaggctgaggcaggcagatcacgaggtcaggagttcgagaccatcctggccaacatggtgaaaccctgtctctactaaaaatacaaaaattagctggatgtggtggcaggttcctgtaattccagctactcaggaagctgaggcaggagaattgcttgaacccgggaggtggaggttgcagtgagccgagatcacaccactgcactccagcctgggtgacagagcaaaactccgtctgaaaaaaaaaaaaaaaaagaagaagaagaaatactaagtaacttgtctgaggccacttagttaccaagacgtgggagctgggacttgaacccaggcagtctgcagtctgactggattcatgcctgcagcctctgcactcctgctacttactgtgtgagaagcgcctgttctgtggaaggttgtgggctgagatctttccatgagttccactcatttacccccaaggctgttcttaaagacaggcatgacagttatgcccattttacagatgcggccctgaggctcacaagggcacgccactcgcccatttccacaaagctatagctcgttagcggagggcagaattcggccgcctctcccctagctcgaaggctgtgattgacacagaggtttttgttgttgttgctgttgtttgttcttttttctttttttttttttttttgagacagggtcttgctctgtcatcccggctggagtgcagtggtgcgatctcagctcactgcaaactctgcctccaagatgcaaatgattctcgtgcctcagcctcccaagtagctggaattacaggtgtgcactaccacgcccagccgttttttgtagagatggggttagtagagatttgtttaatagagatggggtttcaccatggtctctactaaaccctgtctctactaaaaatacaaaaattacccagacgtggtggcacatgcctgtagtcccagctactcaagaggctgaggcaggagaatcacttgaacctgggaggtggaggttgcagtgacccaaaatcatgcactctagcctggggtctcgcttttgcccaggttagagtgcagtggcacaatcacagtggctcactgcagcctcaaactcctgggctgaagggaatcctcccacctcagcctcccaagtagttaggactataggcatgtgccatcctggcgagttaattttttgtgtgtttttattctctcgagacagagtcttgctctgttgctcaggctggactgcaatggcgtgatcttggctcaccgcaacctccacctccggggttcaagcaattctcctacctcagcctcccgagtagctgggattacaggtgcgtgccaccatgcctggctaattttgtatgtttagtagagacaggtttcgccgtgttggtcaggctgctctcgaactcctgacctcgtgatccacctgcctcggcctctcaaagtgttgggattacaggcatgagccactgagcctggcctggtgagctaatttttaaatttgttatagagacaagagagacaagagtctctcttatgttgcccaggctggtctcgaccccctggcctcaagtgatcctcccacctcagcctcccaaagtgctgggattacagatgggtgtcaccgcacctggcctctgaggaggatttcattataaacctgccctgaagggagggaatccaattttacgagagggtgtagcctggtgaggcctggatgacctccggaggcaggggcttgtgcctgggctgaggcctaagggacaatgggcagacatgaagttgccccaggcagagggtacagtgtgggcaaagtcaggaagtggcagggcttggatcactccaggaagagagaggagtcatgtgtcacaggagctcgagacccagagagggaggcaggcaggcaggcagggaccaagcttgggcacagccaggaaggcaggacagggcatggtggggccaatggaatcattacccaagacggggattttcagggaaacagcttagataaggccaggcgtacagtagctcccacctgtaatcccagcatttggggaggctgaggtaggaggactgctgagcctgggagctcgagaccagcctaggcaacatagtgagaccccatatccataaaaaatttaaaaaaggagtttgtgttcctgtagtagcagacttgggaggttgaggtggcagtatcacttgagcccgggagttcaaggctaaagtgagctgattgagccattgcactccagcctgagcaacagagagatacgctgtctcaaaggaaatacaaattaaaaaaccagccgggcatgctggcgtgtgcctgtagtctcagctacttgggacactgaagtgggaggatcgcttgagcccaggagttcaaggctgccgtgagctatgattgtgcctctgcagtccagcctgggcgacagagaaagaccctgtctcttaaaaaaaaaaaaatcttagataagaggatgctgtgcctccctgggggtcttcagtcacccatagtcctggcaagagaggagggccaggagagagcttcacccacctgctgtcctgcccatatgacatccgcaggtgctgccatggccacgactgatgttacactcgagctgaggaggccggctgcagccccaagacagagcgctactcctggcagtgcgtcaatcagagcgtcctgtgcggtgagtccccagcaccaccatgccacccaccccgagtatctcctgggcatcctggcatagccagatgacttccgtgcccctgttgcaataaccactgcttccaagtctctatagaccaccccttgggtatatctaatgtaagtgatatttattttatttattttttgagtcagtctcgctctgtcacccaggctagagtgtgctgatgtgatctcggctcactacaacctctgcctcctgggttcaagcgattctcgtgcctcagcctcccaagtggctgggactacaggcatgcaccatgacgcgcagctaatttttgtatttttttcagtagaggtggggtttccccaagttggctgggctggtctcaaactccccacctcaagtgctttgcccgcctcgggctcccaaagtgctgggattacaggcatgagccgtggtgtgtggccctaatgtgagtgatctttaacactgagcacttgaaaaagaaaaccctgaagaaacctaattctttgatgtctggacgacaaggaagaagatagaaatggcatcagataataaacagtgtaaatgtttatcagaaagaggctggtggtcgggacaagtaggaggatcgcttgagtccaggagtgcatctctacaaaaaagttaaaggattttttaacattggccaggcgtggtggcacacatctgtgatcccagctacttgggaggctggggcaggaggattgcttgaagcccaggaggttgaggctgcagtgagctgtgatcgagccactgcactccagcctggatgacacagcaaaatccagtctcaaaaaaaataataataatattttacataaccaaccacttctaaagattaaaaaaaaacccctatgattaaaaacctcaggtccctcaggcaatcataccagatatcgaaacaaagcaataacataaggactgcagtatttattttatttttatattatttatttattctttgttagtttttggagtgtgggttttgttttgttttttgaattttttattttgttctactcggttttattcttattgctcaggcttgagtgcactggcctcttctcagctcaacctccgcctcttgggttcgggtaatgatggttccacgtcagcggccctccgcctcttgggtttgcgtgacggttccacgtcaccgaccctccgcctcttgggttcgggtgatgatggttccacgtcagcggccctccgcctcttgggtttgcgtgacggttccacatcaccgaccctccgcctcttgggttcgggtgatgatggttccacgtcagcggccctccgcctcttgggtttgcgtgacggttccacgtcaccgaccctccgcctcttgggttcgggaggtggttccatctcagccgccctctgcctcttgggtttgcgtggtttttctgcctcagcctcctgagtagctaagggaggtgtcttgagattatcatcggctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcagcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctccccgcagacgctcggcaggtgtcttgatattatcatctgctgagggtggagctgagggtggaaagggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatctgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctcagggtggaagcggcccccgcagacgctcagcaggtgtcttgatattatcatctgctgagggtggagctgagggtggaaggggagtgagctgacgctcggaaggtgtcttgagattatcatcggctgatggtggaagcggaatccgcagacgctcagcaggtatcttgatattatcatctgctgagggtggagctgagggtggaaggggagtgagctgacgctcggaaggtgtcttgagatcatccgctgagggtggaaggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgcctgagggtggagctgagggtggaaggggagtgagctgacgctcggaaggtgtcttgagattatcatccgctgagggtggaagcggcccccgaagacgctcggcaggtgtattgatattatcatctgctgagggtggaagggcatgatatgacgctcggaaggtgtcttgagattatcatccgctgagggtggaagcggcccccgcagacgctcggcaggtgtcttgatattatcatctgctgagggtggagctgagggtggaaggggagtacggacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaaggggatggagcagacactcggcacgtgtcttgagattatcatccgctgagggtggagctgagggtagagctgagggtggaaggggagtgagtagacactcgggaggtgtcttgagattatcatccgctgagggtggaaggggagtgagcagacactcaggaggtgtcttgagattatcatccgctgagggtggaaggggagtgagcacacactcgggaggtgtcttgagattatcatccgctgagggtggaaggggagtgagcacacactcgggaggtgtcttgagattatcatccgctgagggtggaaggggagtgagcagacactcgggaggtgtcttgaggctcagggagttatcagttatagaatgttgttgagttggaggaggtggctggtggcccatcctgttttttaaagtttcagctgtgaggtagggccagtagggcaatcctgaagaatgacgatgctccgctgccgccattctgacctgtagggccaaaggagggaatgttttcacacatattcatttgatggacaaaattaccgccaccaacacagtctgcaccttctgttgctggtgatagatttttgcacctttccatcctccaggtttcaaaatagcagtatcagtgtcataatatcacccttccactgagtactgccgacagctggagggtaaaggaaagtcattgggacacactgttgtctccacatgccactgtgtctgtctgcaaatgtaggcaggctggggtcctgccccagggaagacagagtcataacagagtaataaagaagcatgtttgagacacaggagtgtctatgtctatcctcattcctccctcacagccatcaccagagcatgtttcttgcaccaggtcaacagacagtaagagacagtaagagaggcatgaaaagcccactgtccacacatgttgcagcttctttttggagaatgttttccaggccttttatgttctgtctctgattctcagaactctgcaaggtcagtgtgaccaccctgctccaaatctaagaaaacagaggtttccagaggaaggagaaattgtgcccagggtcacacagcttgcaagaggcagagtggaagttgattccagctctgcctgcaggaccctctcatttcccctctgtttcccttcttgacaaaggatcttcttcactctggaggtgccacccatgagaacaaagagctctggagagatgtggattcctgaagagctgcaggggaactgggagagggttttctgacagaacaatctcacctcaagaagtcacttaggcatggctgtaatatttcttttcactcccaggtaataccaaattgtaagtgcactaggacataaagaatacttttgtccatggaaaaatgaggtgggaattctaaacaaagcaagttttaaaactgtgtttcacttcaagtgtacaagtcccatcacgtgtaatcataggactcggcagcttttgaaggtacagaggccacacaagaaccagcttagctgagcatcatttaaggccttcatttggaattgtccctgtgggtaataagttacattcactcttcactagtttacagtcagggcccatctgctattacaaatacggaacctctgacacttagaatattagatcaggggccccactgggtggggatgaaggtgtttttgcgcaacacggttaccaacagggatgggactgtgatgcttgtaggcagcctttctctctgccatctccctctgcagggcttgagcacagagctgtagggagaaaaatgtatccatgtcctgacctggcagactatgtccaaaagcaaggaaaacaagcaaacttacccagttgcaaagagcctttcttgcagaaggggggatctgaaaaagccaacacatgagaaattgaatgttgagagagtctaagggccgtggcatcatctgcatcagcactgaactatcctgcaactgcagggaggaagctccttactttgcatttgtggtagtcctctgctcgccgccgcaactcttgcgcacgttgaaacattttcctatggattacaatcactttcatcagataaagcaccactttcaggatgattttaaataatctgccatgtttctgttatcctcacaactgtacccttacacaatctatctctacctagaaaacgtatttcagatggctagaagagtacagtctgagccggtcacggtggctgacgcctgtaatcccagcactctgggagggcggggcggatggatcacgaggtcaggagattgagaccattgtggctaatatggtgaaaccccttctctactaaaaatacaaaaaattagccaggcgtggtggcaggcacctgtaatcccagctactcgggaggctgaggcaggggaatcacttgaacctgggaggcggaggttgcagtgagccaagatcacgtcattgcactccagcctgggtgacacagcgagactccatctcagaaaaacaaaaacaaaaacaaaaaaactgtacagtctgatccaaactgttgctgtattgattcctcctcttgcttactgcctgctgacttctgagatgatagtttccttccccattctcagtacatccctaattcatccttcattgagcatcttttatcataaagctgtattctctttgtattaatatccttaccgtgtttcacagggcagaaacagctgggcttataaacaggcatagtccttttgaaggatgtggttgatcctacaacaacacactttcctaaggatgacaacaactcaccccacccctagaatggctggtatgaaccgagtttccacacagtctagctggcaatggggtcaggagacgttttgctacttcacatcttttggtcactggtaaatattaaggtactttgttttctgttttgtgaactctctctcgctctctctcacgatatgtcttctgaccgtttgtttctatttctgcatttactgggtctaaatactgtacaaaggttaaaaacaacactccaatgggcgtttcccaagagggtggggtacagtttctgaactcacttgtaggtgtgtatttctttcatatccaatttcccattttcctctgcctctgatacctgcctctccttttctgcatgctcacattctttcacgcttagtttcctcagattagaagggagagaaatgcacacacatgatccaccagcccgtgtgggattccctctgcccttctggcatctgaaggctgtgattcaaagatcccccctgcaaccttcccacaaatgaaccaactgattctcacaaccgaagggagaattgacacctcccattgagggacaaaaaaaagtcacactctggcctgctggcaagtcacctgtcatttccagctcatcttcatagttccatagttagtcctattctttagtaaatataaagactattaaaagcttctatgaggtgcactatgtgtgtctctggggtcagtcttgtgcttgacacagcgaaagctcattttagttcagtgtgaaaaaccagacctcaccaattcatcacaactaactccatcggaagcagaggattgctcctcatctgactcctcctgtgtgagacctgattctcagtcagaggctgatgccggaactgagaccatcagccatagagagatccttccagaataaccccgcagttcactactgcactttgccatgattcaggactggaactcttgtcatcgactttaaagatcctggttgagagaaaaggcaatctgaatgctgggcgcatctattgaattagaaatgatcggaatggctcctaagtcagggtgttatgtcctgaaaataggtgacaacggcaaaccatccaccctggtgttgactgactttaacaaggttcagttcacagagattgagggcagaaaaaggaaacggcctcaaaagggtaagtttgctgtgttgccctcacaccacttgattcatggtcctgatcctaaggatctcacctgatacttggctttataggaaggatgtgtaaaattcccagaacgctaggaaacaggggcgaaaacacttcaaagagaaagttaatgaacttgtttctgaccacaaggcatccttcagcacatgctgtctggagtggcctcaaacaaggagtgtgtggtgtggtgctgagaatgcaatgggagcagggtcctgtccccacgctaaagaagctcacagcttaatgcaaatgagaagccagtgaggacatcactactcctgctgtgcacttgggaactagaaacacaaaacctgactctggagggaagctaaggaagcattctactcttgagttgacataagtgcatctgaagcttctgatctccgatgagaacaatgggggacaccaaacagaatataaaacccatgattgaatacatcaaattgctaacatggcagtaaacagacatgaggtgaagatggagaagaaggaaacccaggacgaaagtcagcctcgcatttggaacccatttccctgagtttcattgctgaattccagaaggaactactgagatgcaaagaagcacagcagcttttgcacacatgcgtgggattagatggaaaacaagtggattgagggtctgccaatgaaagcgacccatactgaagtccactggctctggttgagacccagaagagtcatgcatcagaataaaggtggacaggaaataccctggcctttgtagggactgagcctgcaccgatgacttcaattgcagcctgtatggaggacccctgaccatcccccagaagtagactcccatctcttctgcagcaagataacatgctactaggcctcaattcattgctaaacattttttaacaagtatctcacatttaacaaaaaaagatcagtcatatggcagcaaaatacaatgtcatatgaccaaaacatgaaagactgtgaaaatgaatctggaggtgacccaagcattgaattcaacaatccaggctgggtgcggtggctcacactgggaggctgaggtaggcagatcacctgaggtcaggagttcaagactagcctggccaacatggtgaacccctgtctctactaaaaatacaaaaattgggccgggcacggtggctcacgcctgtaatcccagcacattgggaggccgaggtgtgcggatcatgtcaggagttctagaccagcttggccaatatggtgaaaccccgcctctactaaaaatacaaaaattatccgggcatggtggcatatgcctgtagtcccagctactcaagaggctgagggataagaatcgcttgaacctgggaggtggaggttgcagtgagccaagatcatgccactgcactctagcctgggtgacagagtgagactctgtctcaaaaaaaaaaaaaaaaaaaaaattggtcaaatgtggtggcacacacctgtaatccaagctactcgggaagctgaggcagaattgcttcaaactgggaggcagaggttgcagtgagccaagattgcaccatagcactccagcctgggcgacagagcgagactctatcgcaaaattaaaaaaaaaaaaaaaaaaaaaaaggctggctgtggtggctcacgcctctaatcccagcactttgggaggctgaggcaggtggattacctgaggtcagaagttcgagaccagcctggacaacatggtgaaaccccatctctagtaaaaatacaaaaattagctgggcgtggtggtgggcacctgtaatcccagctacttgggaggctgaggcaggagaattgcttgaacccaaaaggcagtgagctgagattgtgccattgcactacagcctgggcaacaacagcaaagctccatctcaggaaaaaaaaaaaaaaaaaaaaagagaaaggaaaaccaatgccagtactagcaactcctcttcctccgaaaaaatgaaaacaagaatgtaggaagggaaaggaattatacagcttaaactaatgaagcagaaaggacaaactcaattttgaacccactgaatttgccacaaatattgtagaaaatattctcaaggactttacagttgtctactttgattggcacatggttcatacaacagtatttgtgtcaaggcacatcttactgttttctggcggtcttcctctttccattgattttgtcatgatggttgattttcgttgtcaccttcctcttacggattttagctctaacttttgtttccacatgtctccgtagagtaatgacgtctttcaggccaattttatttcctcgaaaggaagaaactcttttctttgtgtgcatacaaatggacctcagcccttggtgagagtgaggagaggagaaggtgagaaacctgagggcaagaagctgttctttccctttccagggcaaactcatttccacactatgcggattccaacagagccataccttcctgtctacggcggttggacctccaggctctctgctgtacatccgtggatccatcatgtccatttcgagaccagaagatagtcttcaggagagacacctaggaaataataatataagaatgacggctgggcacggtggctcatgcgtataatcccagtacttcgggaggccgaggcaggtggatcacggggtcaggagttcaagaccagcctggccaagatggtgaaaccccgtctctactaaaaatacaaaaattagccgggcatggcagcgggcgcctgtaatccaagctactcgggaggctgaggcagagaaccgtttgaagctgggaggcggaggttgcagtgagccgagatcacaccactgcactccagcctgagcgacagaatgagactctgtcacatacacacacacacacacaagaatgacatgaggctggcacggtggctcactcctgtaatcccagcactttgggaggccgaggcaggcggatcacctgaggtcgggagtttgagaccagcctcaccaacatggagaaacgctgtctctgctaaaaatacaaaattagccaggcatggtggtgcatgcctgtaatcccagctagtcgggaggctgaggcaggagaatcacttgaacccagcaggaaaagcttgtggtgagctgagattgtgccattgcactccaacctgggcaacaaaattgaaactctgtctcaaaaaaaaaaaaaaaaaaaaaaaaaaaataggccagatgcggtagctcacgcctgtaatcccagcactttgggaggccgaggcgggtgaatcacaaggtcaagagatggagaccatcctgggcaacatggtgaaaccccgtctctactaaaaatacaaaaattagctgagcatggtgatgcacgcctgtagtcccagctactcgggaggctgaggcaggagaactgcttgaacccaggaggcagaggttgcagtgagccaagatcccaccactgcactccagcctggtgacagagtgagacttcgtctcaaaaaaaaaaaaaaaaaaaaaatgacatgaatatacttcacacaactgaactgtacacttcaacacggttagatggtaattatcatcttataagtattttaccacaggttaacatgtttcacaacttgaaaaggaagtaattaccttcagctctctgagttctagaatttgtaacatttcatcccctgctccttcctgatctgcactggagcatcttccttctgtccctgctctactcagagttcactttcccttccctcacatcagcttcattgaggctggtttgaacttaacgcaaaacattctcactaatgactgaattcccaccaagatttccatattatcacagtatgcttttaatcttctaagatattaaatatttcttctcatcatagctaaaatgcaatgcaaatcccatctcagatgtgggtcagatacctatgaatctcctgaggtggtcattgaaatgacttttttcttgagacagagtgtcactctcaaccgtgctgaagtgcagtggcgctaccttggctcacggcaacctccacctcccagattcaagcgattcttgtgcctcagcctcccaagtagctgggattacaggtgcctgctaccatgcctggctaatttttgtctttttagtagagatggggtgtcaccatgttggcccatctggtcttgaactcctgacctcaaatgatccatctgcttcagcctcccaaagtgctgggattacaggcatgagccaccacacctggcctgaaataatatctttcaaattctttgtagaatttgttttttcctgatttctgcacataggataaaaaaaaaatcatgtactaggatttcgagagaagcaatgggtaatctaaaaagatgaaaagagcaaccacgtcaatcccacagctactgctagatttcataggaaaggtagctggcccagtttggagctaggggaaatgtcaaacacatgaagaaatgagaagccaagaaatgccatcacgcatgaatgcttcatggcacccatgatgtccctgctaaggaggtaatggtatagatgactagatgacaaggacaaagatgagaggtgcgaagttgtccaagtccaacagctcaactgaactttcctaagtggaattgttaaaaagtggtaaatttaaaaacttcccctggctcacgtggtggctcacgcttgtaatcccagcactttgggaggctgaggtgggtggatcatttgaggtcgggttttgagactagcctggccaacatggtaaaaccccgactctactaaaaatacaaaaattagctgggcatggtggtgggcacctgtaatcccagctacttgagaggctgaggcaggggaatcacttgaagccaggaggtggaggttgcagtgagccgaggtcacaccattatactccagcctgggcaacagaaggagactcgtcttcggggtgagaaaagaaaaaaaaaaaagaaaaaagcttcctccaatttataccgaaaattctctgttcaggactaagtggcatagagaatgttaaatgtgcctagatatcttcataactcatatattttctgttttctacatatcttgaaaggcagtgccaaatgacgtgtaattatctaggtggtaaaactgaaacatacttcctcttcccttgaatataaaaaagcattgtggtattagtacttttatcttggatcattgttcagaaggaggttcagcccccagacaaccacatttttactgtcatgaatggcaagacaaaatgtagagctcaacttacccaaaggaaaaaaggctcaaaagacaaattatggcacaacttagcagccaaattcttaccaagtacagacttttgacatactgatctctctccagttccaagtcggaacatgcactttgaatgatgtcattcaaaattaccctgcccagacacacttttcattgattctcttggagggcagttctaagagtctctggggctttctctgcatcatgagacgcagtgcagttctgcccttcaccttccggcagtttgtcacctcgtccctatgacctcacaggaactttgtctcaggccaattgtttgttccttggcctctttcatttcccctaaaaatcatttgctgcccctctaaatggcctacatctccatctatctccctctcccctcagaagagggtgctctttaagcatcagccatccggcccttctagcagtctcatttttcagctggttcccatgtttatgcctgttctatgtttttcttttcctgttaagctgtctgttgtcagctcatttctgcagtgaatcttcagagaggagattggaagctttccttccacccatacgatagaactataaagcagaagagtttagaaagaatttcctatttaagtgacgaaacctcatactccatttgtgataaatagcacaaaggttaaaaaaacttatttttgaccaaaagctctgttgacattctattaaacaaacaccgacctatttaattttcataatgcaaatggcagatgttttcataattcttatactaataaatcatttccctgattttttgggtaaaaccacatattcataatgaagtccagaaatgtgaattgttttatataatttattcttatttgtgattacaagtatacctctacagaaagttagtatactcacccaaaggtaaactatccagagggtaatgacaactttataacttgtcggaaacgcaataatgacatgtaaccaaggacttccaccaaagtcagtcccacgatgatgatggtcagccagagtattgataacctggaataataatagttgaaataatgaaaaggtcaatgacactgacaatatttcactcagaaagaatcatccttagaaaccgtcaacctcctccaaaaggtaaccacatccctcagatatcaccgtgggattccactgctacaaaaaagaacagaagttagaagtcacatgtttttcagatggctggtagtgttttcaggcattgcaaatgtggggtgttgtctttcttggtataaagcagggatatccaatcttttgacttccctgcctatattaaaagaagcaaagttgtcttgagccacacataacatacactaacactaacaatagctgatgatctaaaaaaaacctcttttttttttttgagacagagttccgctccactcagtcgcccaggctggagtgcagtggtgcaatctcggctcactgcaacctccagctcctgggctcaagccattctcctgcctcagcctcccgagtagctgagattacaggtctctgccaccatgcccgactcatttttgtatttttagtagagatgaggtttcaccacgttggccagtctggccttgaactcctgacaggcgatctgcctacctcggcctcccaaagtgctgggattacaggtgtgagccaccgtgcccagccatttttttgtttttgtttttgtttgttgtttttgagatggggtctcactctgtcacccaggctggagtgcagtggtgtgctcccggctcactgcaacctctgcctctcaggttcaagtgattctcctgcctcagcctcctgagtagctgggagtacaggtgcctgacagtgcactcagcaaatttttgtattttttgtggagatggggttttgccatgttggtcagggtggtctcgaactcctgacctcaggtaatctgcccgcctcagcctcccaaagtgctgggattacacgcatgagccactgtacctggccaaaatctcctaatgttttaagaaagtttacaaatttgtgttgaactgcattcaaaactgtcctgggccacatgcagcccgtcactcatgggtaagacaagctaagtataaagtaattatcttatcttttcttttctttttgttttgagacaaagttttgctctgtcacccaggctagattgcagtggcatgatctcaactcactgcaacctccgcctcccgggttcaagcgattctcctgcctcagctactgagtaactgggattacaggcgcctgccaccacgctcggctaatttttgtatttttagtagaaacagggtttcaccatcttggccaggctggtctccaactcctgacctcatgatccacctgccttggcctcccaaagtgctgggaatacaggtgtgagccactgcacctggccagtagttatcttttctttaaagttatttacttgttttttaaattgatgtataacattggatgcatttattatatatcacatggtaaaagaatccctctaaataatacttctctcttggattatatgaatctttgtcatttaaatctcagcataagtaaaaaaaaaaaaaatacaatgaagagattacttcattcacaaataagtatcaaattttagtgcttaaaaattaacaaggtgggctgggcgtggtggctcacgcctgcaatcccagcactttgggaagccgaggtgggtggaccacgagatcaggagattgagaccatcctagctaacacggtgaaacccgtctctactaaaaatacaaaaaattagcagggcatggtggcacgtgcctatagttccagctacttgggaggctgaggcagaagaatcacttgaacccgggaggcagaggttgcagtgagccgagatcgcaccactgcacttcagcctgggtgacagagcgagactctgtctcaaaaaaaaaaaaaaaaaaaaaaaaaaaaaaaaaaaaaaattatcaaggtggagatcatgaaaatggcatgaatagtgtgggatttctctaagattgttgatattaattccattagactcttatgtgagtgaagacgaagacttcccctgagtaagttcagacagcttgtgataacatttctacgtcgattcctcaggatttaactatatattcttgaaaacatctcaattttaaatgtttctttcaagatggtgaattaaacagagatagcccttcaacaggttgaactcagcatatgctgagtctgaaatggaaatgatgaagttagagaaccatacaacaatggtaatgatttcagaaacatggtgttgagcagaacaaagcagacacaaaagagtacctatggcatggcatgcatctgtatacgcgaaattccagaataagcaagctaacctatgataagaaagagactggctgggaagactgagagttcactttctggggtgacataatagtgtagatcttggctgggcatggtggttcacgcctgtaatcccaacgctttgggaggccgaggcgggcggatcacctgaggtcgggagttcaaaaccagcctgaccaacatggagaaaccctatctctactaaaaatacaaaattagctgggagtggtgccacatgtctgtaatcccagccactcgggaggctgaggcaggagaatcgctcgaacctgggaagcagaggttgcggtgagctgatattgccccattgcactccagcctgggcaacaagggagaaactgtctcaaaataaataaataaataaataaataaataaataaaataatgtagatcttgaaagggggttggtttatgctggtgtatgtactttccaaagttagtaaacttacacttaaggttatatattttggccaggcgcggtggctcacgcctgtaatcccagcactgggaggctgaggcaggcagatcacgaggtcaagagatggagactatcctggcgaacatggtgaaaccccgtctctactaaaaatacaaaaaattagccgggcgtagtggcgggcgcctatagtcccagctacttgggaggctgaggcaggagaatggcgtgaacccgggaggcggagcttgcagtgagccgaggtcccgccactgcactccagcctgggcgacagagcgagactccgtctcaaaaaaaaaaaaaaaaaaaaaaaaaaaaaaaattagccaggcgtggtggtctactaaaaatacaaaaattagccaggcgttgtaatctgagctactcaggaggctgaggcaggacaattgcttgaaccccagaagcggaggttgcagtgagccgagatcttgccactgcactccagcctgggcgacagagtgagactctgtctaaaaaaaaaaaaaaaaaaaaaaaaagtcatcaaaccagatgacacaaatcaaatgacatttcactttgttttggtccattttctttgttaaaaacaagagtgcagcggggccatctcggctcactgcaacgtccagctcctgggcccaagcgatcctcccacctcagcctctccagtaactgggataacaggtacgcaccaccaggcccgactaatctttattggaattttttgtagagatggggtttcgctatgatgccctggctagtcttcaactcctggactcaagtgatctgcccacctcggccccctaaagtgctgggattacaggcctgagctgtgtaatttcatgccacgtgatacagcccagtaaaaaggaagaaaccccacgggtccagcgtctactcacagagatgcactgatggctgataaattccagtaggagcccaaagaggagccaaaagagcatccaccgcacccgcatgtcctggtcctttcagggcgccctgaggcggccaggacagaggtggaggtggcttagggcaggggggagggaaggggacggggaccggggccggatctgagttggggagggggagggggaggggagggggaggggaaggggaggggaaggggggaagtaagggaagggaaaggaggagaagggggctgttgggcacctggaggaggtggaggaggaggaggagaagaagaaaggggtctgggaaaggatccggttcaaattaagttctcaagcgctggtggaaggtttagctacaggtcacggagaagatcagggaagcaacaggacacgcggggcaagggagcgtgaggcttaggagcaatcagagggagacaaaaaggttctgctatccaccaaaccttcttcggtctgggccctcccttaccaaccctggggctttatactccctctccaccaatccctgatgaccccggtggtgcctcacaatggacagtgcctcacaatggacaatgccaagtagcgcccgcatcattccaatgacccctcccccatctcagtctcccacactcctcccaaagacaggtcctctctggaaccttcacaaacctgatttctggtcctccccaaccagctccctgtccctgcttctgggcgctccttccttcctgagctcccagggttcctcaaggtcacttatggcgacaaaacataaaaaacaaatgatggcaggatggcaggaagaacctcatacccaagcagagtgccaggttttacagcctccgctcagccattcatatcctaagcaacaaaacatcagcagggtgcggaaggtcccgatagtaaaccatctccatcacatccatgtagccatccgtccatcaacctgtatctcaggaacaaatgtagatacattcattttaagcatgcctggtacatttacaaaaattaacctgacttattttgttccagcaaatctcaatatatttgagagcaatcaaatcacacagcatgtttctgatcatataactgtgctagaagtcaatgattaaaagctaattcaaaattattatttgcttggaaattcaaagtgcccttataagacataaacataagaaagaatccaaaatgaaacaagattgcctttcaactcaataatgagatcataacatggcaataaaatgtctccctctggcctgggaattcctctttgtggcacaaggttgtgtgatctcaaatcaccgctaacccacctagacattttaacatccgaaaccgagtgatgacgtccttatctatatcatcttactgcctgtgtgtgtggactttaaattctgaacccaaatgagggggagaaaaccaagttgactttcatgactgagctctcagggacgtccaaggaatctgtgcatttcaagaaacaaagttcatcagcttctctcctaaggtatttgcccacaatacccagagggcttggcagcatcatgtgtgatgggtggggagctccaagcaggtgggcaggacccaggggcctggtgaccaggacagacccccactgtccatcacctttcctggccctgtcctctgctaaacttcccacaggccttctgcccgatcacacagagtatgcccaaactctctcaggcctctggcagctgaaaaccactgctttaaatccctttaccatttactatgacataaggttattgtaaacaggaaatattctattgatgctacaaatggaaagccaatgcctttaccataaatagaaaaacaaccctaagaagcaagcaaaacaaaaacaaaacaggggctgggtgtggtggctcacgcctgtaatcccagcactttgggaggccgaggtgggcggatcacaaggtcaggagttccagaccagcctggccaatatggtgaaaccctgtctctaataaaatacaaaaattagccgggtgtggtggtgggcgcctgtagtcccacctacttgggaggctgaggcaggagaatagtttgaacccgggaggcagagtctgcagtgagccgagattgcaccactgcactccagcctaggcgacagagcgagactctgtctcaaaaacagcaacaactacaaacaaacaaaaaacagggttaacaaaagtatggaattcaattctttttatatgctgcagccatgttcctgccctagatttggctgggcatggtggctcacgcctgtaatcccagcactttgggaggctgaggcaggcggatcacgaggttaggagttcgagaccagcctgaccaacatggtgaaaccccgtctctactaaaaatacaaaaattagccaggcatggtggcacacgcctgtaatcccagctactcaggaggctgaggcaggacaatcccttggacccgggaggcggaggttgcagtgagccgagatcgtaccattgcactccagcctgggtgacagaatggaatgagactctgtctcaaaaaaaaaaaaaaaaaaaaaagcagccctagatttcggttgtggtggttgtaaaaggagagaccaagtaagtgggggttgaagtcagattagagcaaaagtgaatggcagagagtactataatgtccatgaagggctgctagagtcaccgtgatcatagcccaagcagagatagggaaaggaagatgtgagcagagtttggggtctcgaacaatggaggttattcgtgcagcccaggaaaggctccccaaagccaggatcaacctcccttggaggcggtccctcatggaggcatggtcaggcaccttagatttgagaccagctatgttgctgctgaccagctgtgtgaccctgggctggtttccttccacacaatgggagtgccaatggctgcatgcatgcaaagaccgtctgaggataggaggaagcaatctgctgagcacccgtgtacctgagtgtcatcacctcccaagggcatccttcgttccagagctggcaccttggaaggcccttggtcactgaaggcagtgatgatggtaacagcagtaaatcatcatttacggctgatgagggaaggccaggggtagggctcctaggtcctggataagaatgagggtctgggcactcctggggacagctgagtggtaggactcctgggtccccagggggcaggtccatcttcagtggcattgggcctaggctgggatgctgagttatccactggagcatcagcagtacaggcaggcacagaggcagtggatccatcggaggtggcaggtgtaggatcgtctggtgagcaagtagagtcaccaaatctggctgaccactacccccactacccccactatccccacagacgatgccctgtcccttgcctcatgctccggcagggtacaggctcgcacctggggcctcaaggagcatctctctaagacctctgtgtcctggtcattgaatgggcacttgagtcacccagggccattggaacaaagaggaagaatcaggccccacgatgttttgggagagtgtttagcacaggaaaatgcgcagaatacacgcacgacacgggggcactgtcagtgtgggagcaatggtttacaacctccagccctaatctgagcactctcacctgtgcaatctgaaaggaacaggagacttgcaggaaagacagtgcctggatttaacttaaaggaactaaaaatgttggaatttttactcttgatatccttccaaatcaactctctcaatgttcccatcctcaaaactatcatatggggtaactgaggcagtcagagatttactgactcaatgtcactcaattgattctgagttcactgctgattacatccgaccaaactgctttttctgaagtctactccgtttaatcatgctggtgatgattttgtgcggctctgggacaaactccacctggctgaagataaagcaaatctgcggtgacttagtcctcctgtcatttcccatcagttccccactctcctcctctgcccctccacagtctcccatgcaggctgacaccatatgacggccttaatggagtccaccgagtatttcaggttctctcctgggccacttgaaagtggatgtacccatgggatttgctttgacccaggagatgtgcgtggaagtgaagcgtgtcacctcgaggcagaagagttgggagccattgagacgggccactctctccttcatctcttagagcagctgacagctcccatatggaggctgctcctttattctcgtggcaggatgagggcatgtggggcacagggcacaggagagccatggaggatgtgcagcatgggcaggaaaagagccttcagtggtgtacatttccatagtttggggctgtttcttacctacagtgatacctagcccatcctagcaggcatgcaccatctactccacactctgtgatgcagactagcctgccgtcagaacacgaactggtggtcagacacaggtaggtttcagttccagctctgcctcttattgactgcaacctcaggcttaactttcagtctctgagcctcagtttcaactctgtaaaatgaggtggctataccatctcaggttgcagagagaattaaatgaaatataagtgcatgtagagcattgaacccagggcctggcacacacagtgagtacacaatgttagccaggtagcttcataatgcatactgattgtcaatattcagacaatgcagtaaagtgttaccaaaaataaaagtaaacttatttgcatatgtattctttcaatctttatttttaaacagggtaaaactatgcatattctttcatagccagtgtttttctcttcatagtatattgttaaaataattttacttggaccgggtgcagcggctcacacctatagtcccagcactttgggaggccgcggtgggcagatcacgaggtcaggagttgacacgagcctggccaatatggtgaaaccccatctctactaagaatacaaaaattagctgggcatggtggcacacacctgtagtcccagctactcagaggctgaggcagaggaattgcttgaacccgggagacagaggttgcagtgagccaagattgtgccattgcactccagcctgggggacagagtgaaactctgtctcaaaaaatatgtgtgtgtgtgtgtgtgtgtgtgtgtgtgtgtgtgtgtgtgtgtgtgtgtgtgtgtatctatataaatctcaaaaataaaagatcatttttgagattatcattttaaaagacaagataatgttcaacttaatgactaatttaattattactattggactttttgtagactgcacagagcattcaaaacaaatgaaggagaataaaaaatatgtattacatgttataaaataaatgtgatgtggttaactcttttattcaaagttatagaacatacatatgtactatagaatgtattattatgagtcatgttaaaaagtagtttagaagctgttgatttgaatttccttttcaaattttgcaggataattttttttttttttttttgacagagtctcgctctgtcgcacagtctggagtgcaatggcgtgatctcggcccactaaaacccccacctcctgaatctaagcaattctcctgtctcagcctcctgagtagctgggactacaggctcacaccaccatgcccggctaatttttgtatttttagtagggacgaggttttgccatattggtcaggctggtctcaaagtcctggcctccggtgatccaccagcctcagcctcccaaaatgctgggattagaggcatgagtcaccatgcccagcctaaacttggcaagctaataaatcacctttttaagtgtcgttgggcacttgtctggttgtttttctttaggttaccatgccagcaatgattccttttgagtttctgacagaagatagtggttttcatccaaataagtcaactactctaccccatccctaagccacttgtatggaaagaaaaagaggaagaagccagtactgtgactgcgtaagcttcccccagcatcaccggctatgagatgtgtggcagctgagacccgggaactgctcaagggcaccaggccccatctgtctgcactcactcaccttcctcaggtactcgcatgggcatgtcactgactttacatgctgctgcagctccttggtgagctggccctggtcatgggacaggaactgtggggtcaggacaatagagagcttcaccatttgcagaatgagaacaggggctcatgatgagtgccaacctattagataatttaaaaaaaaaagtgttgaatgagtggaaaaacaaggtgatgtttgagtctatagtggtcaagggcttcagaaaaggacagaaccaagttcaaattcctgtactttgaatttctacttcatgccatgcaaaattactttaccccttttaacctcagttttcttctgtgtgaaacaggaacaatagtttcattcgtcattcagtttctctcaagatttcacgagatcatacctataaaacatccaagtcatttaaatgtatcatcatttctgtcataattagtgggatccatttcactattattggatatacagttctgtgcctgaaacctacaaaaaaacaaaatgttaagtctaaaaagcattagtgatttctcatttttatattactaattataaccctatttaatcacacaaggccttgtccgcggcaggtgctcaataaacacttgtcgaatcaatgcatgtgggctccggagccacactgtttagattctattctgcctccaccacttatcagctgtgtgatctgggtaagataattcacctctttatgtctgcacttccctctccataaactatatataatgagaatccttagctcattcggttgtggtgaggggtgaatgatttggcacacaggaggggcttgttaaacattagctgtgatgatctccttccaaatcttcattttcagagccacagatgaggccatagtgcaaccaggtgaccttagagtgtaagtacacatgatcgccagctatgctctatctccaccataggtccaagactgggtagttctggcctggaggtttctgctgcatctgccttctcagtgttcacctaaggacttttgtattttcctcctcgcatccccacagatggggttcaggctgccggacacagctgggtgatgccagggcagtggtcacctgtgccagccccgtgaggtagctggaggatcattgttccttccttctcgggctctgggcagatgccagggctggggtgacccatgccctcaagtttcttgctttggtgggccacattttcccttggcaaagagggtaaaggtcacaggatgccggagagctgtgacttctctgtgccctgggcccaaactatgaagacctgacacactatgctaaaagtccaacgctgggtgctccccagagcttcttgcctcaccgcttctgctgagggaggaatgaatactatgtcctcccagagctttgggagcttgtagcaagcagcctccccagcgcaaaatctcttggaaacctctaactgtgtctgaaacattagtgcaaatgttgcatcctatttcccatatgtccgcatgttttagaaaaaaaccctcaatttcctaaatatgcaagaaaaatcggtattgtaggacaatgtgactttttaaaaaatgttatttaaaaatcttccccacctccttttctgccctccaagactgccaaatacttgttgaacatatattattaaatgcctactacatgccagccatgattcatggtcttggggacacagcagagaacgaactgacaggactcctctcttatgtaactcacattcttatatgataatgataagggttaacattaattaagctgtcactgcatgttagtcacggtgcagtcattcccacacattattacacttaaacctgctagcaagcttgcaaggtagttagttgtttttcctttaaaaactgagtctcggaatgatgaagcactctgtccaatgtcacacagctagtaagtgtggagaccttgcatccaatcaatgcccgtctcattctaaaggccatgttatgtgttctccagcccatggagaataattttaacacagtcaatgaaatttctacacaacaatgttcttgtctcaagtccaagaatgcctcctacacctcctataatactggctttctggtgagtaaagatgccattctcatgtgtaatcaggtggcaaatggagatatgaccaaagtaaccacctgcctacactcataaccctgtacacactcttcctgtgtcgattcaattcaagtaccccttttgatcacttagcaaatctgacctttaaaagggttagggtttttatatccatgtaagtttctgtattgctttggaagtctctggttaaattaatactcttttaatagtgacctgtgattctgttttgatcaagtgttttcaaacttgacatctttgatgggtttctccagtgtcaaaatcctaaatcaagtctttttggcttaaaactaactttgggatttttttcagctgcatcccttggggagtctaaagaatgtatctctcatcttgtagaggtattaagtgattcgatttatttggtagattaaatgggcaggcattgtcaaatgtggcgatactgcatgggagggcactgtcaagtgaggtgacattagatctcatctcagttatatttatgggtatgttgttgatatgcgtgttccaaaaattgcatacatttatacaaatttaatatgatttgtaattttgatagttatgctaaatatttgctaaagttatatttgtataaacatgtcacgaatggctgggcaccgtcactcatgcctgtaatcccagcactttgggagacaaaggcacgtggatcacctgaggtcgggagttccagaccagcctaatagagtgaaaccctgtctccactaaaaatacaaaaattagccatgcctggtggcacatgcctgtaatctcagctactcgggaggctgagacaggagaactgcttgaacccaggatgcggaggttgtagtgagccgagatcatgccactgcactcccgcctgggtgacaaaggtagaatctatccaaaaaaaaaaaaaaaagttattatttctgaagattgtatgaaatttataaaagtctgctggccctgatatgatgctgtcagtcatgattctgattactgtcttaaaatgctgcacataagtaattaaatttccttgtgaactgggaagtttcatcagacttttatcataactattgtttccatcatccacagttactgttttgaattcttctctaaaaatatttgtaattggcaatagtccaaattttcttttgttttctttcctgtttttgagacacagtctggctctgtcgcctaagctggagtgcagtggtgggatctcggctcactgcaaactctgcctcccgggttcacgccattctcctgcctcagccacccaagtagctgggactacaagtgctgccaccacatccagctaattttttgtatttttagtagagacagggtttcactgtgttagccaggatggtctcaatctcctgatctcgtgatctccgcgcctcggcctcccaaagtgctgggattacaggtgtgagccaccgtgcccagcctaatttttgcatttttagtagagaggaggtttcaccatgttggccagggtggtctcgatctcctgaccttgtaatccgcctgcctcagcctcccaaagtgctgggattacaggcgtgagccactgcaactgactttttttctttttcttttttttttttttttgagacagagactcactctgtcacccaggctggagtgcagtggcatgattttggctcactgcaacctccacctcctgagttcaaacaattatcctgcctcatccttcggagtacctgggattacaggtgcgtgccaccgtgcccggctcatttttgtattcttagtagagacggcatttcaccatgttggccaggctggtctcaaactcctggcctcaactgatccactctcattggccttccaaggtgctgggattataggcgtgagccaccacaactggctcagtaaatacattttttattatcaaaaaagagtagtgtatggttggcgtattctgtgtagaatgtattttattgatgtctgctatttttataatttctgagttaagtactttttaattaatgctttttagttttgggcagattcagttgactaaagcacctcatttcccagatacatgaaataaaatatttggcttcttttccaatttcacactgatgttattttgtgaaaatcagtgctttaagataaatcgttatacgttaagataaacatgagaaacttgatctaatatttaatatttattcagttctacactttattaacttctacaccagcagatttagacattatgtaaccatctcaagaagtttcacttggatgtaatgcttcacgcttgtaatcccagcactttaggaggctgaggtgggaggactgcttaaggcaaggagtctgagaccagcctgggcaatacagcaagatcccatctctattttaaagaaaagtttcactttgggaggccaaggcgggtggatcacaaggtcaggagatcgagaccatcctggctaacatagtaaaaccccatctctactaaaaatataaaaaattagccgggcgtggcggtgggcgcctgtagtcccagctactcgggaggctgaggcagaagaatggcgtgaacccgggaggcagagcttgcagtgagctgagattgcgccactgcactccagcctgggcgacagagcgacactccatctcaaaaaaaaaaaaaaaaaaagtttcggcaaattccatctaagaattccaccagagttctgttgtctccaatgtcatcttccacagatttcaagttgtgaagccctgaactgttaatttatcttgagaatgtatatttaagcttaatttaagactatatacctaaaaattgagcatataatttctataatttgtttatgtaagtttctgtaagtcataagtatgtggtttccaagtgtataatttatctgaatgtaataggcattaatatatttttacattactgggaccatagtacagaaatttctaaatggtttgtaaaataacttgttatttgtgttgttgtaaaagcagttaatacaatggaaaaactcgtaataagaagatacagtttaacatcaaaaagtttacccaaggtaattatgagtactacctggcaaaacttcacggaagctgtggtatcacttttatgatggaagaatggtgtttgcattttgtgtaaaagtacttgcggctgggcgtggtggctcatgtcccagtgctttgggaggcgaaggcaggtggatcatctgagcccaggagtttgagaccagcctaggcaacgtggcaagagcctgtctctccaaaacctacaaaatttagccaagcttggtggtgtgagcctgtagtcccagctacttgggagactcacgctggaggatctctcgagcccaggaggcagaagatgaataaataaatggaagcaactgaatgggatgaggtctctcttgaaggagagagcaaaagagatttaaatagtaacaattataataaggctgggcgctgtggctcacgcttgtaatcccagaactttgggaggccaaggcaggcggatcggttgaggtcaggagttcaagaccagcatggccaacacggtgaaaccctgtctctattaaaaatacaaaattagccggacatggtagtgcgtgcctgtggtctcggctactcaggtggctgagacaggagaatcgcttgaacctggtaggcacaggttgtagtgagccgataaatataaaaagtattagagtactaacagaggaaagtttccactgatcaccttttagctttaaataatgcagaagcatttgcccagtttacttgtaattaaaaatcatgcatcattcacaatttatatcttttttgtttgtacaaaaatgaacacaagttattctcttttatctgtattgtgattggtttggtgagagggaattaggccacttgagagtttgtgtgtgtttacaattttctggccaggcacggtggctcatgcctgtaatcccagcactttgggaggccaaggcgggcggatcacttgagctcaggagttcgagaccaaattgggcaacatggtgaaaccctatctctacgaaaaatacaaaaattagctgagtgccgtggcttgcgcctgtcctcccagctacttggggggctgaggcagtaggatcgctcaagcccaggaggtggaggttgcagtgagccaagatcacgtcactgcactccaggaagggcaacagagcaagactccttctaaaaaaaaaaaaaaagaaagaaagaaaagaaaattaactttggtatttcaggttgtatttaaatggagacttaacatgaactatgttcataacacttgaccaaattaagtgtagatcgtctctttaataaagagatcatctggaactgcaatttctaactcatacatcattgctacaaaccttatttgtttactgtttctcttccaaggaccatcagtcatcctttaaaattcatttcaagctctgaaaagatattttttgttacatgggcaatttacttttagtacagtaaaatgttatgtgaatttctacagtatgtttgccaaaatgaattatatctagaatacgcttaacaatatattctggaggcagctttcatttgaaattaggttcaccttctgagagtatgaaaaagttaatgggtttttgtgcctgaagattttgatgttgcatttggctacatttaatccactttcacccataagttttagcatctaaaaaaattaaatcactgctaatgcaattaaaatgcattatgaaatgcatttctgtccaggctggagtgcagtggcacaatctcggctcactgcaagctccgcctccctggttcacaccattctcctgcctcagcctccctagtagctgggactacatgtgcccgccaccacgcccggctaatttttttttttttttttttttttaatgaggcggagtctcgctctgttgaccaggctggagtgcaatggcatgatcctggctcactgcaacctctgcttcctgggttcaagtgattcgcctgccttgctgggatgacagacgtgcaccacaatgtccggctaattttgtatttttagtagagacatggcttcaccatactggccaggctggtcttgaacttctgacctcaggtgatcccaccttggcctcccaaagtgctgggattataggcatgagccactgtgcccagcttaagatctctgttttaatgttaatgctggtcagttgtgtctggattccagagggaggaaggtagaatgaggcatgttgacacctccccttcccatcatggcctaagctggtcttttcagtttactttggaatgtccttgctcaacaggaagggtccattcagtcggactgggtggcttagaattttatttttggtttacatctcaactatcacagcagccgggcgcggtggcttcacagctgtaatcccagcacattgggaggctgaggcaggggtatcacctgaggtctggagttctagaccagcctgaccaacatggagaaaccccccgtctctactaaaaatacaaaattacccgggcgtggtggtacatgcctgtaatcccagctactcgggaggctgaggcaggagaatcgcttgaacctgggaggcggaggttgtggtgagctgagatcgtgccactgcactccagcctgggcaacaagagcgaaactctgtcttaaataaataaataaataaacaaacaaacaaacaaacaaactatcacagcataaagtaggaatatttcgttactgtctagttaaactggttaatgcagaaaggaagtctggtaattccagttttaaagtaaaattttggacattgtaggattgattatttggcatagttgtgatgtttgttcctgcgttatggttttgttggcagggcagcctttaaggacctgtatattttcttctagactctatatattccctgtgagtattagttgtatggtcaaactggcaaattttaccataggtataaataatagagaatgtggaagaatagtgaatagtgtcagagatagttaaaagtccatacaatagtagagaaggtagtaagtaatagtggcttggactaaatatttgttgaataaatgttttaaaaaacaggctacctacaatttgtgttgaagatatgaatgaatgaagtttccacacctttatgtggagacctgataagtaagcaacaataaggaagggtccccaggttggggagagccccaagttgagaacaataatgaacaattattgtatgaacaattgttagagacagctaatcacaaacaacctgcgggcacaatgacctcattccacacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctaggttgttgctacccgatatggtttggctgcgtccccacccaaatttcatcttgaattgtagttcccataatccccatgtgtcgtgggagggacccggtaggaggtaatcgaatcatgggggcaggtttttcccatactgttctcgtgatagtgaatacatctcactaaatctgatggttttataaagggcagtttccctgcacgtgctctcttgcctgctgccatggaagacatacctttttgctccttctttgccttccaccatgattctgaggcctctccagccttgtggaactgtgagtacattaaacctctttttctttataaattacccagtttccagtatttcttcatagcagtatgaaaagtaactaatacactacccgagacatcttaggagatttgtaatagctgtaatgccaggtccaccatatttttagcataaagcaaatgtttacgcgtgatatgactgcacgggctttctttcagctggagccatagcaactcaagtagtaaccctatcttagtctgattaaaagtaaatattagtctgggcatggtgggacatgcctgtaatcccagtactttgggaggctgagacagaaggattgcttgagcccaggagtttgagaccagcctgggcaacatggaaaaacaccatctctacaaaaaatacaaaaattagctgagctggtggcacacacctgtagtcccagcaccttgggagggtgaggcaggaggatctcttgaacccgggaggtggaagccgcagtgggcaatgatcatgtcagaggtgtgtgaaccagagcaactccatcttaaataggagccgggaaaaatgaggctgaaactactgggctgcattccctgatggttaaggcattctaagtcacaggatgacatagaaggtcagcacaaaataccagtcataaagaccttgctgataaaacaggttgcagtgaaggagctggccaaaacccaccaaaaccaaaatagagacaagactgacctcccatcatcctccctgctacactcctaccagcaccatgacagtttacaaatgccacggcaacatcaagaagttaccctatatggtctaaaaagaggaggcatgaaaaatccactccttgtttagcatatcatcaacaaataaccataaaaatgggcaaccagcagccctcacggctgctccgtctatggggtagccattcttttattcctttactttctctcttttttttttgagatggagtctccctctgtcacccaggctggagtgcagtggcgcgatctcggcttactgcaagcttcgcctcccgggttcatcccattctcctgcctcagcctccagagtaggtgggactacaggcacccgccaccacacttggctaatttttttgtatttttagtagagatgaggtttcaccgtgttaaccaggatggtcttgatctcctgacctcgtgatccacctgtctcggcctcccaaagtgctgcgattacaggagtgagccaccgtgcccctcctcctttactttcttaataaacttgctttcacttcacactgtggcatcaccctgaattctttcttgcacaagatccaagaaccctctcttggggtctagattgggacccctttcctgtaactatcatgctactgcactccagcctgggcaacagagcaaggccctgtctcaaaaaaaaaaaaaaaaaaaaaaaaggaacatgacttaatacattcattttggagggtaagtctctcaaaataggcctttcactgggggaaaatggtaaaaatactccctggtaattcaagaattggagactcctgagatgctgctcatattagctgagcacttatcaatacttcacttttttccatatatactcaaggaacaagtgctatttaaagtgtttcactccactgtgctaggtgcaagactataaagaggtgtgaggatcaacacttttatgaaaaccagtgtcattctggatatagtttcagatgctagtgcaaaggaagctcttggtatacggaaaaagtattcaacaataaattaggcatggttgcttccattttctgcctcacatactttttttttcgtggttgaagtgatataatgtctatgatattttagattggcagttgcaaactagtggtcctcagcgtgctttttatgacacctacaaggtctgaagactttgatttcatattaaaaatctgggtttcaggctgggtgtggtgttgcatgcctgtaatcccagcactttgggaggctgaggcaggagaatcgcttgaaccagggaggtggaggttgcagtgagccaagatcgcgccactgcactcaagcttaggcaatagagcaagactccatctcaaaaaatgaataaataaataaataaaatctgggtttcaggccaggtgtggtggtgcactcctgcaatcccagcactttgggaggctgagatgggcagacagcttgacctcaggaattccagactagcctgggcaacatggcgaaaccccatgtctacaaataatacaaaaaaattagctgggtgtagtggagtgtgcctgtaatcccagcaacgtgggaggctgaagtgagaggattgcttgagcctgggaggttgatgttacagtgagctgagatcgccctcctacactccaacctgggcaacagagccagaccttgtcttaaaaaaaaaaaaaaaaaaaaaaaaaaaaaaaaattctgggtttctggcatctcaaaaaaaaaaaaaaaaaaaaaaaaaaggaaaggtcagggcacatggctgctacagtcctctattaagcaatgtgccacagcaggggtgcctgacccctgggccatggacatgtactggtctgtggcctgttaggaactgggccacagagcaggaggtgaatggtgggtaacaattgaagcttcgtctgtatttctggctgctccccattgcttgcattgctgcctgagctctgcctcctgtcagatcagcagcatcattagattcttacaggagcatgaaccctgttgtgaattgcacacacgagggatccaggttgcatattccttatgagaatctaattcctgatgatttgtggtggaacagtttcatcccaagaccattaccatcctgcgccccatcccttgccgcctgtggaaaaattgtcttccacaaagccggtccctggtgccaaaaatgttggggactgctgtgctttagaatctgccatgaatctgcagcctctattatatagctccctatagactttgcttcctaccgtcttacgttctgccttataggcatttgactttgcaacccttgtttttgttagtatgctacgctggtgacattgaccaaattgaccacacattaattataagcttagttggtgatgacctcaacggaataacgtgacataagtattgtgacaatacttcttgcatgtatctgcaggtggaattgtaaacctggtggtccgagatggtctaattccatcttcctatgtatctccttatattaatagtggtaacatttgtggtggtgattcagcatttcaatgcctcttctcatggcaacaacaaacgttttccttctgaatcaacattaacctagatgttactgcggatcaaaattagactctacattttcaaccacagaaataccgggcagtaaaaatttttcttaatattgattgcctacataggttgtgtaattagcatatgtttacagttctatgatttctgcgtggctgctacagagctggagggggtaaagcaacagtattttctcagttgtgcgagcagcattacattataataaataggtaatattaaactgggctgatgagagttgcaaaagactactttaatgttcatatggaaccaaaaaagagcccgcattgccaagacaatcctaagcccaatgaacaaagctggaggcatcatgctacctgacttcaaactatactacaaggctacagtaaccaaaacagcctggtactggtaccaaaacagacatatagaccaatggaacagaacagagccctcagaaataataccacacatctacaaccatctgatctttgacaaacctgacaaaaacaagaaatgcggaaaggattccctacttaataaatagtgctgggaaaactggctagccctatgtagaaagctgaaactggatcccttccttacaccttatacaaaaattaattcaagatggattaaagacttaaatgttagacctaaagccgtgaaaaccctagaagaaaacctaggcaataccattcaggacatagggatgggcaaggacttcatgtctaaaacaccaaaagcaatggcaacagaagccaaaactgacaaatgggatctaattaaactaaagagcttctgcacagcaaaagaaactaggatcagtgtgaacaggcaacctagagaatgggagaaaatttttgccatctacttatctgacaaaaggctaatatccagaatctacaaagaacaccaacaaatttacaagaaaaaaaacaaaccccatcaaaaagtgggcaaagcatatgaacagacacttctcaaaagaagacatttatgcagccaacagacacatgaaaaaatgctcatcatcactggccatcagagaaatgcaaatcaaaaccgcaatgagatatcatctcacaccagttagaatggcgatcattaaaaagtcaggaaacaacaggtgctggagaggatgtggagaaataggaacacttttacactgttggtgggactgtaaactggttcaaccattgtggaagacagtgtggcgattcctcagggatctagaactagaaataccatttgacccagccatcccattactggatacatacccaaaggattataaatcatgctgctataaagacacatgcacacatatgtttatcgcggcaatattcacgatagtgaagacttggaaccaacacaaatgtccatcaatgatagactggattaagaaaatgtggcacagatacaccatggagtactatgcagccataaaaaaggatgagttcatgtcctttgtagagacatggatgaagctggaaacgatcactctcagcaaactatcacaaggacaaaaaaccaaacaccgcatgttctcactcacagatgggaattgaacaatgagaacacttggacacaggaaggggaacatcacacactggggcctcttgtgtggtgggggagggggaagggatagcagtaggagatacacctaatgtaaatgacgagttaatgggtgcagtacaccaacatggcacatgtatacatatgtaacaaacctgcacattgtgtacatgtaccctataacttaaagtataatttaaaaaaataagtaaataaataaataaaaaaagaaacaattgctggctttgcaattctctttcctccaaaatcgccaaggcctcaatttactcattgctgaaaaaggacgactctgtatatttttaaatgaagagtgttgtttttacctaaatcaatctggcctggtatatgacaacataaaaaaactcaaggatagagtccaaaaacttgccaaccaagcaaataattatgctgaacccccttgggcactctcttaattggatgtcctgggtcctcccaattcttagtcctttaatacctgtttttctccttctcttattcggaccgtgtgtcttctgtttagtttctcaattcatacaaaaccatattcaggccatcaccaataattctatatgacaaatgctccttctaacaaccccacagtatcagcccttaccccaaaatctttcttcagttgaatctctcccactgtaggttcccatgccgcccctaatcccactcgaagcagccctgagaaacatcgcccattatctctccatatcacccccaaaaattttcgccaccccaacactttaccactattttgttttatttttcttattaacataagaagacaggaatgtcaggcctctgagtccaagctaagccatcatatcccagtgacctgcacgtatacatccagatggcctgaagcaactgaagatccacagaagtgaaaacagccttaactgaagacattccaccattgtcatttgtttctgccccaccctaactgatcaatgtactttgtaatctgccccactcttaagaaggttctttatcatctcccccacccttaagaagtttctttgtaattctcctcacctttgacaatgtactttatgagatccacctcctgcccccaaaacactgctcttaactccaccgcctatccccaaatctataagaaccagtgataatcacaccaccctttgttgactcctttttcggactcagcccgcctgcacccaggtgaaataaacagccatgttgctcacacaaagcatgtttggtggtctcttcacacagacacgtgagacaggagttcgagaccagcctggccaatctggtgaaactctatgtctctactaaaaatacaaaaattagctgggcatggtggcgggcacctgtaatcccagctactcgggaagctgaggcacaaaaattgcttgaacccaggaggcagagtttgcagtgagccaagatcacactgtcaggcctctgagcccaagccaagccattgcatcccctgtgacttgcacgtatacatccagatggcctgaagtaactgaagatccacacaagaagtaaaaatagccttaactgatgacattccaccattgtgatttgtttctgccccaccctaactcttcaatgtactttgtaatctcccccacccttaagaaggtactttgtaatctccccaacccttaagaaggttctttgtaattctccccacccttgagaatgtactttgtgagatccacccctgcctgcaaaacatggctcttcaccccctatcccaaaacctgtaagaactaatgataatccaccaccctttgctgactctcttttcggactcagcccgcctgcacccaggtgaaataaacagccatgttgctcacacaaagcctgtttggtggtctcttcacacggacgcgcatgaaacacacgactgcacttcaggctgggcgacagagctagattccatctcaaaaaaaataaaataaaaaggagtcacctcccccgagaggcctctggaccaccccatctgagcaggccactcttccttctctatcttaccatcttgtttctgtcccagtagttagggctacctccagtaatcctatttgtccctttactgtttagtgcgtctcgcttgactagaagctccatgaaagcaagagaccctacctgcctccttcgccactagacccccagggcctggtatgtggtgatcgctcagggcccattttcttcctttcctcctcctccaagggtggggaaagagcatcagaaggtctaggtggccccaggcccaaacaatgctcctttaaaaggaaactagattgttacaaaggtcagaggctgaaaagttatttccgccttttatccctctaaattcttcacttcctgaaaaaacaaacaaacaaaaaagccactgagggcccttggactaaatccaggcctgagttgctgggcagaggtcagtcttgtccagacatgggaaaaaaataactcgagtcagacaggtgggtcaccacagaactaatccagcctgcaaatggcctgtgcaatcttcagctctgtccagacctgcctccctctggggatgcctttaaaggtgatgaatgatctggatgaatgggcttagaagataagagggaaaaacaaatatcacaggtcaaatcgttatttgtcttcaagtttaacaccgtctactggactaaaagatgtccaaagaatagttgttcaactatgtaaattccttttttttttttttttgagacagagtctcgctctgttgcccaggctgcagtgcaatggtatgatcttggctcactgcaagcaacctctgattttagtattattagtagagacagggtttcaccatgttgaccaggctggtctcgaactcctgacctcaggtgatccacctgcctcggcatcccagagtgctgggattacaggcgtgagccaccgtgcccggccaactacataaattcctaacaacgtatctccagaaagtataggcacaacagcacatgcagtcattcctgtaattaagtgctccgggaggccaaggcaagaagatcccttgagcccaggagtttgagaccagcctggacaacatagcaagactgtgtctctacaaaatatacaaaaattgggctggggatggtggctcacgcctgtaggcccagcactttgggagaccaaggcaggaagatcgattgaactcaggagctcgggaccagcctggacaacataacgagacccagtctctactaaaactcaagaaaattagccagacgtggttgcatgtgcctgtagtcccagcactttgggaggccaaggtgggtggatcacctgaggtcaggaggtcgagaccagcctggccaacatggtgaagtctcatccctactaaaaatacaaaaattagccaggcacggtggcacacacctgtagtcccagctacttgggaggctgaggcaggagaatggattgaacccgggaggcagaggttgcagtgagccgagatggcaccattgcactccagcctgggcaacagaacaagactccatcaaaaaaaaaaaaaagaaaagaaagaagagaagaaaattagccaggtgtggttgcatgcacctgtagtcccagcactttgggaggccaaggcaggaggatcaatcaaggctaggagattgagactgcagaaggaaaccctgtctctaaaaacaaggtccagctaaaatcagggtccagctccaccacaagcgcagctccaggggctgttgagttttgcctctaccattccaagtagtctctgctccagaccaagtcccaccatctggcagtcatgtcagtccaaccacagtcatatcagggcacttccagtcattgagtgccccttgaggaggctggaggagaggccaatgacatttgcacttgagactccagagtctagatttataaccactatgttacggctgccagtgtggctgcaaggacacttctttcattcattcatttacaatagatgtagcatctgctgtgtgccagatgccattctaggttctagggaaacaaggcagagcccctgttttccaaggcatccacattctaggaaagactgctaccagcctggcgtggtggctcatgcctgtaatcccagtactttgggaggccgaggtgggcggatcacttgatgtcaggagttcaagaccagccaacatagtgaaaccccgtttctactaaaagtacaaaaatcagctgggcatggtggcacgtgcctgtagtcccagctactcaggaagctaaggcaggagaatcgcttgaacctgggaggcagaggttctggtgagccgagatcatgctactgcactccagcctgggcaacagagtgagactccatcaaaaaataataatgataataaaataaagactgctactaaacaataaaataaccaaaccagatagatgacttcaggtggtggtaagagctttgaaagaataagcaaggtaactaactggtcagaggaagggagatgggtgcattccctcagatagaccgccccagaggtctgcctctctgacatgacatttgagcagagacccaacaggaaaaggaagaggctgctctatggccgggtacggtggctcacacctgtaatcccagcactttgggaggcccaggcgggcggatcacgaggtcaggagatcgagaccatcctggctaagacggtgaaaccgtctctactaaaaatacaaaaaaattagccgggcgtggtggcggatgcctgtagtcccagctactcggaaggctgaggcaggagaatggcatgaacctgggagacggagcttgcagtgagccgagatcgcgccactgcacttcagcctgggcgacagagtgagactccatctcaaagaacaaaaaaaaaaagaaccaagaggtgtccaggcgaagagaacagcagatgcaaaggccctgtggcagaaacaatcttggtatgctggaggaataggaaggcagccagtgcagctggagcaggataggttaagggaggatcaaggtgatgagggcctggaaagaggggctggggtcgaatcaccagatcctgttggttgcaatggaagagcctggagtttattctcagagcagtgagaagccactggaaagttgtttttttgtttttctgtttttgagacagagtctagctctgtcacccaggcagactgcagtggtgcaatcttggctcactgtaacctctgcctcccaggttcaagcgattctcctgcctcaggctccccagtagctgggattacaggcacatgccaccacacccatctaatttttctttttctttttttttttttttttgagacagagtctctgtcacccaggctggagtgcagtggcgcaatctcagctcactgcaacctccacctccctggttcaagcgattctcctgcctcagcctcccgagtagctgggactacaggtgcatgccaccatacctgggttaattttttgtgtttttagtagagacaagatttcaccacgttagccaggatggtctcgatttcctgacctcgtgatctgcccaccacggcctcccaaagtgctgggattacaggcgtgagccaccgtgcctggccagccaccggaaagttttatgtaagcaggggagtgatctgttttatcatttagaaggatacacacctcttcttctttttttagagacagggtctagttctgtcacccaggctggagcccagtggcacaatcatagcttactgtaacctcaaactcctgggctcaagtgatcctcctgcctcagcatcccaaagtgctggattacaggcatgagtcaccatgcctggtcacacttctcattctttaaaccagacctcatttgtccatctcccccatcccccgccccaccccacggactgtcctataatgcccatacaacaggtcactgtttagaaagtgctacaaagttacaaacacagtcccttctgagcctcccaccaatgttggtgggtacaaggtcaaaaaaaaaaatctcatctatctaaggggcataggagactttttagttagagggcccaattatagtcctcctgaaaagatgccaaaagtccccttcaacacttagcaaagattcaagaaagatgaatctcacattctttgtatgggaaatgaggaacttgacatcttcaatataatggattccactaaaataagatgacgatcaataggaaccaactaaaaaaatacttgactagctgttattgaaaggctgaaattcagctgacataagcagtattaatattgagctagaaaataattcgcattgaattcagcccaacttttgttttctgatttgggtctcttctaaattttttttttcttctggacattgagaacaatccaatttgaaggcctcaatgcccaaatctacactcttgttttattctatatccttggtttcttctttttttttgagatggagtctcattctgtcgcccaggctggagtgcagtggcgtgatcttggctcaatgcaagatccgcctcccgggttcatgccattctcctgctgcagcctcccgagtaattgggactacagatgcccgcccccacgcccggctaatttttttgtatttttagtagagacggggtttctccgtgttatccaggatggtctcgatctcctgacctcgtgatccacctgcctcagcatctcaaagtgctgggattacaggcgttagccaccgtgcccggcccacacctaggtgatttttaaagttcttctagtagagacagggtctcactatgtcgggtcgccgtgtttgatgtcagttttccctgccagaatctacaatctccttgatcaccattatatcccaacgaagagctcagtacctggtacaaagcacatttgatcaatacttgctgaataaagaaataaaaatgaagaggcactccagcctgggcaacagagtgagatggtctcaaaaaaacaaaaacaaaaacaaaaaacgactggaaaggagatgagggtacttgtgaagccatattatatgacacgctctgtgctaggacttttatataccttgtctcatctcttcatctcatataatccttacaaggatctcaaaagtggggaaatccccatataactgaagacgaaggcagttcagaagttcactgatttgccctaaggttcctcaatttgcaaacgtcaggccaatgatccaaccccaggtatgtttggcagtgaaggaccagttgagtcacagctgcaagtaaccaccctgcagtggtccctatcttggccgttagcttacattgacatttaacactcaaatttactcagtaacaccagctatcatgttttccactaaaactccacagcattctggcaacttttctattttagagcaataaagtaaattgttagcatccctttgacatataaatatttctacaaatagtaattctctagccattcatttggagtatttaaaactcaacattcatagcacattttatgtgacaaagaacttatgttcagaacacaaaaataagtcgtacgtcttcattaaaaacaggtgaagaatttgaacaaacatttgcaaactaaaatacaaatgaaatacactcaacatcattaaacaagaaaataaaattatgagataatcactaataatcactacatatgcaccacagtgattaaaatttttttaagttaagccacgtgacccaacaaggtgcattcactcaagagaaacgcaaatatatgtccactcaaagacttgcacatgaatgttgagagcaggtttatactgaatagcgcaatgtgaaaaaaccccaaaatctagcaaaggatgaagggagaaataaactgtggtatatacatacaatagaacactactcaataataaaaaggattatattcctgatacatgcaatatgggtgaaccgtaaaaatatcatgctgagcaagagaagccaaacacaagagaacatgttgttatgatttcacgtacatgaaactttagtaaagacaagtctaatccatagtgacagaaagcaaatcagtaactgctgacaggggcaaatgaggagatgatcccaagggaaccttctggggtaagacgctgttctctatctcgatcgtattggtggtcacacaagtgaagacatgttagaactcatcaaaccatacacttagaatgtgtaatataaacctcaataaagcaaaatttaaaaaaaaaaaaccacctttaattttctcttacaaaaaaaaaaaaaggaaaaccacttaactttaattttctccaacaactgattctggtacacagtataccttaatgcctgcatccacggcctcacgtcatgctgtttacatgaacgtaaagcttcgccgaagagtggaataagacagtcctgccagagaaaaaccaaaattactcaacgtaaaacaggctgttgatatgtttgcagatatatagcaagtcttaagtccaagactgcaatatagtttggctacttcagattgattgcagtagttttatctattacactatacccttacatcatttatcttctactcacaagaggcaagcacacagtaagagaaagccttttgttttgaagggaaatcttcttcagaatattaagtctaatttatcaatatacttaataaagcacattacaaaaaaaaaagtcacagcacatttactataaagcagactgcagaaaaacattacaactaatgctttattatgaagttctcgaagatcaccattcattcagaagcccccatctctggtcgaactttaccccatttaggatgaagaggagagatctttgtttgcagcaaatctaaaatttacgtgatctgcctaaaggaactgtctttacatacaccacctcccaccccaaaaatagaagaaaaaactgagcaatttgccatccttgcgattatctcaggttcttccatctgccccatgtacttcccaaatgaaagactgcctgaaaacagcatgttagatttctggatttaccagcttgcccaactacaaatcctattccaaaaaactcaaaaaataaggtctttgttctacagtaatgaccattaatagtcataagagtgtgcttgtaaaaatatacagacctctgttgaaagtctgttagaaactgtggtctccaaagcagacgagcaatacagctgcaaggtacttagaactggcaaagactgtgaaactgttaaagtagaaagtctcagaggtccaatagcgatgcgggatgtttgcttcaagtactttaccacatttctgaaacaaaatatttactgtcaattaataaaaattacaattcataaccactcaaagaataaagcaattgataagatgctatcaaattgacatccaaagttagggggcagtaagaggagcagcctgctctataataaaatggtatcagcaagtcaagacatttgcttttggggatttttacattttatttcatttcaacctcagtttttgttggcaagcagcattcatatatcatatgacttctacaactaaaatgaagctattagcactagtatttagtaatctagtaactctccttccagccctcttcaccccatgtatgtttatcacatgatatacacaatgtacatttacctccgtaagagtaaacttactcagttatagactgccacttctgatcttgttctatcgggtttaaagcagttgccaaacaaacagaacttcttaacaatggaacttcaatggatttctgaggttcccttggatctggacttcacatgttacgaagcagttttttcatgtctacagaagttaaatgaaatgtcattaagttaatgtgcttttattataaattttgatttatgtttggcattattaaaaactaatcaccaatgaacagctcctttaatatttcaggcagttaaacactataagcattactgagagctatataaaaatcatacttcatacaaaattactgtacctcagacccctaaaaagcagttgccttcaaaggctcaaaaatcagtaagtcgaggtcaggcgtggtggctcacgcctgtaatcccggcactttgggaggccaaggtgggtggatcacgaagtcaggagttcaagaccagcctggccacgatgatgaaaccccgtctctactaaaaatacaaaaaattagctgggcacggtggcagacacctgtaatcccagctactcaggaggctgaggcaggagaatcgcttgaactcagagggcggcggaggttgcagtgagccgaaatcgcgccactgcactccagcctgggcaacagagtgagactctgtctcaacaaaaaagaaaatcggtaagtcaatctactatttaaggggacaaatctagacctgcattagcaaatcttgctcaatccagaatactcattaaactttttaataacatcttatcaagtgttccatttgtgataaagaacttaattaacgagccacatcaagatgaaaatcaagaaaaatatttagctgaaacactactttgtcctttatcaaacaaaatggctagataaatctcaaagtattaaggtggtcattttttttatttgacttaattttaagtgcttttcatttcccaaatcaaacataaatagggcagccctaaatttgttgcttcacatgggattctgcccccacaaaaatgtaaaataacttccagattttccagtaaaatatactaagccaaacattttgagcaacttgtccactaaaataactttaaaactattttctcaaatacctacctattttttcttttgatcctccagcaagtagattgatattttctcctggtaacaattctaattgctcggtacattcgacaaattttccagactcaaagctgcttaatgatctgtaattaaaatattggttagcttgtattcctatgcagcctgtggaaccattaaaaaaaacaaacaaacaaaaacagaacaaatcctaggaagacagcaaagtacacagcacttttctgacaaaattccttccacgaggatgccattattttggtttttatgttgaagatgtgactaccacttaattagtactcaaattggagtggcaaaccagaaagtcacagctacagactttcagtggagctgactcgcccctgtgtctccttcctgttttcatgtgttgcagcctgttctcttcagagcctgacacactgacagtagacctctgcaggacaactttgacacccagttctctccaagctgccagtgagctccctgtgcagcctcactcctcacctacagcatgagcccttgcacagctctcccagcatcacaatcttgtatctcagtcctggcttctttcactgctggcatccctccgtctctccctttttcacctacttttcttttttcaaagaattcttctctttcatctgcttatatgaaaaataatgacacctctgaaattctttcctgtagttctgcagcatcaatgccaggaagacaggcctcatcctcccagcttctatgctgctcctttcagatcccttaccctgtccccattttcatgacacgggctctccagccaggaagaagacactgtttctcactctctctcttttccatctttgcctgtccctctcgctgtgtaacttcccttataactcagcctgaggccagtgctagaaaggcacatcacctgacttattctgtgcctgattctacctagatcagtgcaaccactggcttctcagggggacccttgagtactgggcactgatgaactgctgccaacacagtcatcatttctgccattaaaaggtcctaagtcctctccagtggcaggttccccaagtccccactatgctctataatgccctatgctttcagctaatgactcagtcctcagaaaaaacaaacaaataaacaaaaaaacacaggctttaatttcctctacccctacccccaatccaccatacactgccgaaattctgtctataccaactttgactgctttccttgaggcagagaaaaggtgagggccagttaatctatcaatgttctttctcctgtttcttcaacctctgctttctagtggctccttccccttggccaaaagaacataatctctccaacatttaaaataaacatctcatatttccctccagcaacagcttcctatcctcgacttcaagaaaaactcactgaccaaataacttacctcaagcttttcattttcaaatgtctctaccactcaatactattcaatctagcttcttctgtctctctacaaaactctttttccttataatccctagagcatctgacaaggctgactactcccatctggatgtcctatatctagggcacttcccttctcaatgtccctgtatttttttgaatggcttcctcttctatcctttcacaaaaatgctaaactaggattctgacccaggccttccttcctcttcactcactattctccagaggcttctctctggtttggttgcttacaaaggctctagagtatagagactgaaaaggaaagagggccttttctgtgtactaatcatctgcaaatctctcaagcttagactgtctccttagttcaaaatccaattcttaacagcttacccaacaatctcatctgcacatttcattagaaatcttaaaacatggcttgttctctgtgtgctcctactccagttaatagcattgtttctcttccctctaccattgcccccataaattaatggtctccatgcttccatacttgccccgcacctccagtctcttcaccacagcagaatgaaccaagtcagatcacaacacaactctgttcaaatcccacctgaaattttcagtcttactagaataacagccaaagttcttttctcagttcccagctacttctctgcccttatatcctactgtttaaggcgctcctaaacacacaggcctcccagctatttccagaacactccaagcccatcattctcacatcaggtctaggcccaaagggcatcctgatgggcatgtcttgaccttgtgtcttccctccaaagaaggtcagctttacctaactgctttccttatggcacagaaaaggtgagtgaggtccaattagtccttctatcaataatctttatctaatctttgctttaaaaggttggaatttgtgtctgttttatgtgctgcctgggtcacagcacatgctcagtgaagcaattacacattaacccatttagcagtagaaggcaagggtatcagacaaagtctaatgacctttatcttcccagccaagtgtctgcaacagagtgagtgctcagttttgaattacagaattaataaaagcacagaggaatgagaagaaagtttaatttacagatgttcacaaactctgtcctcattagaataaatgtttttgatatattcagacctcatttcgaaacaaagccatcaaatgtgattctttctaaagcagtacaaatttttctttatattcactctggcataatcttcaaactgtattaaggttttagaacgacaggttctgaaaattaataccaaatgactatctcagcagtgttttcccattatacaaataccttccctcatctctgatgtcagtttcctgttgtcattttcataatggcagtaagttagaaatataaccattttgagtattactgcatatgaccaattttaatattttttttgccataggaaaaacatcatagttattggaaatttgttttataactggaaacagaaagccttactttatatagttgaagtcagctttcaggttgagggaagtgctactggtactctttttcaagtcatggatagcgttctgccattcctgcacagcagcccaatcggcagttgagatgtagcactcacatgctttgtttcctaaataatttataacctcaggggaagagtcagtcggtttggacagcacactttttctggattcacctgaaagtattttataaaataagaagagagagattcagatcaattagaaatatttcaaagagcacagaaacctaaaaacatgataagatcatcagtacgaaatatattactataacttttgctttatttaaaaatgctgaacgctcaccattcagacaatgtttcaggctggcactcttacacccagcactggctaaggtgagcaccgatttgtcaaagctggagatgcagcaatcaacacctgtcatggcacacaggtgttcctggtactccacagaggccttttcaaacctgaaaagcaaattgaagcagtcttatttctttatttatctaactacttacttttttttttgagatgaagttttgctcttcttgcccaggctggagtgcaatggcactgtctcagctcagtgcaacctctgcctcccgtgtacaagcgattctcctgcctcagcctcctgagtagctgggattacaggcactcgccaccatgcccggctaattttcttgtatttttagtagagacggggtttcaccatgttggccaggctggtcttgaactcctgacctcaggtgatccgcctgcctcggcctcccaaagtgctgggaatacagatgtaagccaccgaacccagcctacctaacatggcaaattttgtttttttaaatattgagtgggaaaaacagatcataaaaccatgtgcctatgtacgctgatgttttggtgaagaatggagaaaacgacatgaaagaaaaaagaattacaaagcgtatggatatggaaatatgggactacaaaaggacacacaacagaagttactacaaagatatggaagtatgagcagttcttttattttcctaagttcgcaagatttcattaaactaacataaatggacacagaatattatggtacaagctcctctacccggaggaagcaatgagtctgaatgtagagttcacaggactaacgagcaaatactctgacaataaagggtaatttgtatcagactctgagggggaaggagctcaactagggatcaagttcaaaagcatttataaaacaactgacaggtcttgttttacagtgtgatttgccactaattcttaaataagaaaggcactccagtattgctgctaactgaagaacaaactgaagatgcctcctggtgaagggatttatagcaagcttcaatgctgaaagcaaacaaagctgttttaagatttggctacaatgtcagtgagtaatacaaagaacttaaacataaagtaattctatcacccatttccttccctccaacctacctcccttcagcctgttgagccactgagttaatccacagaagatgttttccaacaatagatgatgaccagacagcaattccctgtatagcttcaggacaatgaagttcacatagtgcttctaccaccatcataatgcttacttccaattcattcccctgaaaacgcattcagaaaagttagtcacccaataccattaaaacataaatccctataaaatttacaactgatcacagtctgtgcctgcttaaagccaaatgtatttaacaattattgtcacaattttcacattatttagctcagaattctttaaaatgttacatataaaatagccacaaagggtgactaacagaaccttagcagcacatggatgtttgtacccccaccccaaagttacccaaaaacatttaacctgtgacctctgtaggaataacacatggagtaaaaagaaagcaaaaatgaaatataaataaacaggaattaaggaatgattaacttcatgtgtttgaatactgcttgacattacctgaattgctaaacattttgttatttttggattccagttatttattgtgagcccactttcaatccaggaattactcaagcatttgtcatacgttataaaaacaatttctcctggccaggtgcaatggctcatgcctgtaatcccagcactttggaaggccgaggtgggcggatcacttgtggtcaggagttcgagaccagcctggccaacatggtgaaaccctgtctctactaaaaatacaaaacttagccgggtatggtggtgggtgcctgtaatcccagggactgaggcaagaagaggcttgaacccgagaggcggagcttacagtgagccgagatcgcacaactgcactccagcctgggcgacagagtgaaactgtgtctcaaaaaaataaataaataaataaaaattttcccccataaacaaattttcagaattacctttaaagttctaaactttgcacggaagaaatagagttttaacgtgttctaacatgaatattgttttaacatgaacaaaaacatgaacattattttgacttctaacactgttttaacacgaataaaataggtaactctggcagttgttgcttttacaaaatacaggatcaaaacctttgaaaatgaatccaagctttaacttattttatccatagattaaatcataccaaaggaattaaaccatgtttttcttattaacagacttaaaatgaatttcaaacacaccactttacctgagataggctggttgttttcatctctgtaagcaagtcaaagccatgtctcactgtcactgcaggctggcctgccaacaatcctaccctcatgatggagagtcgaatccgcgttagccagtcctgacaagtttggcgattggtatacaaaaaagttctaatgacctttacgataagagaaagaaaagctcaggactggttcaatttgtaggtaaggatgtctcacctatatataaaccaaatacacaagtctattgtgatttcagctctgcacatactgccagctgtgaccattaaactgctataaaacaacactatctcccggaaaccaaccttgggaggtgaagttaaggcattagcacatccctcgtatgcattatacattaatttctccagattttccagatactgcagaagaagaacaagtctaagttggttgttaccatggccttcatcactgtctgcagttgtccactgactaacatcctgatcagggtttaatgtgtgacctgcgagacttcgaatgatacctgaaagcaaagacaacattctgaatttttaaaaatcttaaaagttcctagaataagtgtgagttttttatgaccaattcacatttatcaagtatcctctgtctacccatcatttaaaaataaaaaatcccaacatgaaagatctttcattttaggggaaaaaaatatatattttttccacacaactcccataagttttggaaaaaaaacaaacatatttccaatgcaattattcaatgaaagcttattctaacaaacaaacctgaaaattattgacttttttcaaaaaaaatcatataccctcaaatctttaacaaagatttaaaaatccattatttctcaataaggctttgaaagtattcacatcataaagcttgagcgagttaccttcaattgtctggaaggtgtcttgagctctgcccagtggggttctcagcttagaaagaacagtgaattgtgcagcttcccatatggcccactgccaaaggatagcatctgtcttcaggagattgcgtggaattgttgactggtcacgcttatccagtctctggcagctatagaacagtctttccaaccaattgtccttcctgggaaaagtagtttcatatttaaaagacaatgacaacttcattttaataatgaaaaaaaaatgcaaggggaatgggaataaggaactgtaattttccctactccaaaaaaaggcaaaacctatgaaattgagaagcattatgtccccccctctcattttgaggtcttgtatagttaacaggatgaggtacagtgtggaaggatgattagggtaaacggctcatgccagtcaggaatgaaactcattcaatgcaactaagcatctctagaatatctccacccccaccccactccccaaagtgttaatgacatcacatcagttaactgttaaccacatttcattactcaatttcaaagcccatttttgtttctacagatgctatcttcaaagcaattttcctattgatgaaaactgaaataacccatatgagaagaatgttacttgatactctgccacccccaaacatattttctcttcaaaactgcatgtaaagtcaagggaatcttaaaattttctttcccagataaaatagtcaaagaaatgtcttaccctgttctatgagagttcccatacaaaataaaactaataacatcagagaaatcttgggggtggaatgtattacttggtgctttactcatgtgacttcttaatgctaaagaaatttcttgaatttctgtgtgattgttatcgctgtagacagaaaataaagttgttgttatgcaaaatattttagcttaaaaggttagcacatactgtaagtggattatttacttattaactcactggaggtaaaaatatagtaaaattgagactttcaaatggatacagagatgtgattacaactttagatcctttttttattcacctcagatgggtcatgtgccgacatcataagaggatttgagggaggcatatcaaacatgtgaacataaaaacccaatcattatgcttatctattacaaaaggatcaagtttaggctcttaaaagctcccaaatcaacttgatcaaaaacaataaaagattactgtttagtttttcaaatatctgagctactaagaaacatattttggcactacatgagttattctatactaattattgtgagcctataaagctcattaaaaatttttaattttcttgcagacctgcaaaatttggttatttgacatcacttcaatcactgacaagcagggccataaaagatgtgtcattaatgctctaataggtgatctgtcttctcctaaagtagacaaccagtagaggctgtaaatatcacagaacgtctttgcttcaaaacaactgttataccttaggaaaacacctaaaggaattgatttcaacagttttccaaatgcttgtcgaatacaagttccacggtgcactagttggacacggcaaacatcaacacatctatgaaagaacgaaatagacaaagcaggtgtgttaacagttccaggttattagggttaatgtcaaaagacatgatcttaatttcatacctctgtaaaagatcatctggcaaggaagaggatagagcatgtagactgctgcatgcctgcagacagatattcacatcttcaacgagagctattaaacattaaaagacagttactttcagctggccaaaagaaattatatcccagtttgtcataattatctgaatccattcattcattcaacaaagagtgagtgcctactatagactaggcactgttcttgtccagaatcctcattgactgtcacatttggaaaaatgacacattcaacaaaacccacgtaatgtaactgatgggtcatcacacaaaactttttctgagagaaaatgtaaaagtatatgtaaactataaacattcacgttagcttaaaaatgtgacaatcacttcaaaacatttttctaatactaagaatgaaaaaaaatcaagactgtgtatctgtcattaaaatgaggattacacatcttcaggtcaggaaaagagctcgattcatgaccatctcccattaccaaagacccttttaaggactgataaacaaaatagaaaaaaaaaaccagagtcttactgtcggctaaaaggcctttgcaaaatttatggaaagacggaagacagaataaaggtgcatatgtttcggacttcttcattacaacagctacttccaaagcccaagtcattaacagtttcctgaaacacaaaatatacagttgactgtacattaaaaaaaaaaaacaacaaaaacaaaaaaaagttaaaagcctagtcttcttacattggttttctcttggtttttcaaacatctcaaacaataaaaaataaaaataaaaaatgaaactatagaaattactgtcaaaattgttgtgtgccttttaagaaaacctcccaacgcagcatgataatagcaaagaggccgggcgtggtggcttacctgaggtcaggagttcaagaccagcctggccaacaacatggtgaaacaccatctctactaaaaatacaaaaattattgaggaactgccaaactgttttccacatcagctgcaccatttcacattcctattgctaacttataaagatttcaatttccccatatcctcaacaacacttgttattttccattttttaataatagtcatcatagtaagtgtgaagtgatagcttggagttttaatttgtatgtctccattgactaatgatgttgacatcttttcaagtgcttattggccatttgtttatcttctttggagaaatgtttattcaagccttttgtccattgtaagatggacaaaaatggttgtctttttgttgtttgtttacaaccattttgttttaaaatgttttgtctttttgttgttgaattgtagaagttttttatatactttgggtattaaaccttaacatatatacaaaaaaaaaaaaaaaaaaaatacaaaaattagccaggtgtggtggcgggcacctgtaatcgcggctacttgggaggctgaggcaggagaattgcttgaacctgggaggcagaggttacagtgagcaaaactccgtcttaaaaaaaaaaaagcaaagaatattaaaaatctatatatattcttctatgaaacactgggcgtgggggattgaggtttttcatgtatttcttttcagaaagaataagaaagcctagattaaataataaaaccaaattataaggtgtttgacaataaagaagctgctctacctcacctctataatccacatttttttaaattttttgtaatccacatttcttcttctcaaattataaaggcaaattaacaaagttaggaatggttaatactatataatatctgttacctcgtgtcctggttatctttcttaagtaacattcccagaagatttaatataattgagaaatgtttctttgtggccatagttacagtgccaatcacagctccatcaaacaaagaaggagaggaagaactgaggctactaaagataaagtgatcatgcctgaaagacaaagcatagattatcttttcatctttaatcaaagaaagcaagcaagtccaaagttaaatcaacatacatcttcaaaatctatccattaaaaaaataaaatgttttgtggggttcttttcttaagaaaaatttgtgaatacagtacctggtacaatgaggatacaatgtgtagagcacagcatactgaatggcagggaagtgaacagccaggtcactgtgcacaatcatcagattcttactcagaagtgcaaagacagttggagatagcgcccacatctgatcatgtacaaaacaaagtaagtttatggcttctccaaaataagcacaagcatacagagtttatccttcaaaacaggggtatttggacatttttaaattaaaattacagattggaagggatctagtacactacacctgggacaaatacttttttgtgaagtcagtaaagcctttgcgtgcaatatagcatctctatgcaatgcagcaactcctcgtctatcgctacagtaagaaaacagccacaggtcaggtgttgtggctcacacctgtaatcctagcactttgggaggctaaggtgggcagatcacttgagcccaggagtttgaaaccagcctgggcaacacagcgggaccccatctctactaaaattacaaaaagtagctgggcatggtggcgcacacttgtaatcccagctactcgggaggctgaggcaggagaatcgcttgaacctgggaggcagaggttgcagtgacccgagatcataccaatgcactccagcctagatgacaaagttaagactctctctctcaaaacaaaacaccagccacacacaaaacacaggaatgagagtacctgtgttccaagaaaactttcttgagtcggagtctctcgctctgtcgcccaggctggagtgcaatggggcgatctcagctcactgcaacctctacctccggggttcaagcaattctccctgcctcagtctcccaagtagctgagattacaggtgcccatcaccacgccctgctaacttttgtatttttttagtagagatagggtttcaccatgttggccaggctggtcttgaactcctgagcttgggtgatctgcctgtctcagtctcccgagggattacaggcgtgaaccactgcgcccagcccaacaagaactttctttacaaaaacaggcactagtgttgtgatggttgtacacttctgtgaatatagtaaaaatcagtgaattatacacttaaaataacagacaaaaaacaggtgctgggctgtatttggcccacagaccatagtttgctgatctctggtctaaacagagccctttgtatgtgccttttgcggaagtagactgtatttcctcaattttccatatactgcaaatggcaaggtgccctgttcaataaggaaacagaggcacaccctgccaccctacaccttttccatccatctttttcctttacactgccaagacactccactccacctgactgccccatccccacccactttctccttatttctagagtacaggacataaacatctttgaatctgtaaataatgtgaataattttcctcaaaaatcaagctttcatgtttgaagaagagtttattgtgacttcaaacataaactgtaactggtaataagcgaagcagctatggaattatacaaggcaatccaatcaaacaacacggagcacattgaagcgcaaacatcaaattttaccttcttcctcctaaaaactttattccctaattacatccatttctttctttgtttctttctttttttttttttttcttttgagacagagtctggctctgtagcccaggctggagtgcggtggtgtgatctcagctcactgcaacctccacttcctgggttcaagcaattctcctacctcaccctccaaagtagctaggattacaggtgtgcaccaccacccctggctaatttttctatttttagtagaggcgagctttcaccatgttggccaggctggtctcaaactcctgaccacaggtgatcagcctgacttggcctcccagagtgctgggtttacaggtgtcagcaaccgtgcccagcctacacctattattttctattaaaaatgatgtttttcaactctgtgtggtccaataggaagaagaaatacacaaaccataaacaataaatacaaatcaagagcagggccatgtcgaattacttaaaaaaaaaaaaaccacacgggctgggcgcggtggctcatgcctgtaattccagcactttgggaggctgaggcaggtggatcacctgaggtcaggagtttgagaccagcctgaccaacatggtgaaaccaagtctctactaaaaatacaaaaattagcccgtcgtagtggcaagtgtctgtaatcttagctactcgggaggctgaggcaggagaattgctggaacccgggaggcagaggtggcagtgagccgagattgcaccactgcactccagcccagttgacaacagcatgactctgtctcccccccaaaaaaaaaaaaaaaaaaaaaaaaaaaaaaaaaaagtccccccaccaccaccaaaaggaagactacaggttcagtatcccttattcaaaatgcttgggaccagaagtgtttcagactttgtatatgtttggatttgagaatacttgcatatatataaaatgagatatgtgggggatgggacccaagtctaaagacgaaattcacttatgtttcatagacaccttctattcatagcctgaaggtcattttatgcaatattttaaataattttgggcatacaacagtttggactcatcacatgaggtcgggtgtgggattttccacttggggcatcatactggtgctcaaaaagtttcaaattttggagcattttagatttaggattttcagattagggatgctcaccagtaagtgttatgaaaatattccaaactccggctgggcatggtggtgcccacctgtaatcccagcattttgggaggccaaggcaggtggatcacctgaggtcaggagttcacaaccagcctggctaacatggtgaaaacccatctctactaaatacaaaaaaattagccaggggtggtggtgcatgcctgtaatccgagctacctgggaggctgaaacaggagaatcgcttgtacccgggaggcggaggttgcagcgagccaagatcgcgccattgcactccagcctgggcaacaagagtaaaaacactatctccaaaaaaaaaaaaaaagtattccaaaatccaaaatcgaaaacacttccagtcccaagtatttcagataaggaatattcaacctgtatgaatgttcctagggaaaaacagacagccaaaatataagaccatgtataagaactaacttcagtacacagaaagaaaaaagtaccaggggaagaagaaagagaccgcattttaaaacaactatacaaatttgagctgtaagaaacactgacattttctgtaagcatgctagagcaaataggagaaattcataagacattttctagaaaataaaactaatataaaaaaacttatcaagatttgtcaaggaaaaagaagaaaagttaaatataatggcaagaaaacattcctaccaattttatttatccaggcatgtcttaaatatggctgtttgttacatacagtgattctgcagacatgttgacataacagtgaaatacataaatatgtaatgtggataaaacaaagtcattacaattaaagactcacccctattagtgagtttttggcatttccaattgtagtcaaatttaactacaaattttgtagtcaattgaggtcaaatttaactacaaattttgcattgtctacattgaacacatgattcttaaaagcctcatgttttatttcagaacaggactcaggaagctgcagactgtgcaggaggttgtttagggcacaagtcatttctcccaatattaacttataggcagtctccaaaacaggaatattcttcaagctgagcactgcttgataaacagcacgggctacagcaacaacctgaaaaacaaaaaattcaaggaagtgataaatggaaaataaatcttctaaaattatatggaaaataaatcactatctgtattagtgctgatgatacaaataaatttaagatcgatcaattcactgtctgtagcatttaatattttaattttttaaaaaccaatcagaaaactgacacagatcagtatgctatttcaaatctattaagttttatcacaaataaagagtactataaatgaaaactgtcaataggaaatttccaaaatggccgtttttgttttttttttttaataatcaacatcaaaagacatatgcaaacagcagtttaagactgggtttcttaaatctaccaggaaagtctgtggtggatttgactagggggtggttgaaaagccagtcatttttgtttaccaaatatacagtacttcttaatttataactttataaatgtgtcaacttgttttacccttatgaaaatttaataaatttaataacagcaaaagatgcatagtctgaaaagagtatctggcacaccattcatgaaagtattcagtatgattatcaagaaatataaatttaaaagaacaaatacaatcactatattctaaatcaaacatttcacatttcactcaatttcacttatatagcctggggtaagcaacattaggtccaactcttcagtgactcaagttgtcaaaattcattatcagtgtattacttacctctttttctttatgataacgcaagaatagtagtttagatgatggtataaacagtttttctacaaatgatgatggcagtttcgtatttatctgttcaacaatctaaaagaataaaatttttaaaaaatgagcttctcaaattacaaaaagacatggagaaaccttaaaggcacactggtaagtgaaagaagccaactgaaaaggctacatactatatgactccaactacatggcattctggaaaaggcaaaacgatggagacagtaaaaagatcaggggttgccatgggcttaagatggggggagggaggagtggggagagggaacgaggaaggagtgggtagaacataaaagatttttagggaagtgaaactatcctgtatgatactggtaataggggaaacatgtcattacacatgttaaagtccatagaatacataacacaaagtaaactataaaattagttaataataatatatcaatattcactcctttgtaataaatgtaccacactaacacaatatgttaatgagggggaaactgttgggatgaagaaggtatatgggaactcactgttttctgctcaattttctgtatatctaaaaaatgaagtcttttaatttagaaaaatatatctaagctatattttaaggccttaatactgtgacattaaagtgtttagacacctaaataggacacacgtattttacagttatcatgggcattttttcacattagcaaagagaggtgtaattctggcagaaatgctcagcagaatgtcatctagaatttgctttaaaataatccagttggagatgaaaggatagcaaagaggcctagatgaaaccagatgggccatttgtttctaattatagaagctgagtgttaaatatgtacaaatttattatactatgctccctatttttatgtgcttcagaacgtccataataaaagtggggggaggatatttatggttaagaaattaaaggaggccggccgggcgcggtggctcacgcctgtaatcccagcactttgggaggccaaggcaggcagatcacgaggtcaggagatcgagaccatcctggctaacatggtgaaaccccgtctctactaaaaatacaattgtgccactgcactccagcctgggcaaaagagcgagactccgtctcaaaaaaaaaaaaaaaaaaaaaaaaaaaaaattaaaggaggccaggcatgattgctcacacctgtaatcccagcactttgggagggcaaggcaggaggattacttgagaccaagaatttaaggccagcctagacaatgtagcgagaccccttctctccaaaaaatataaaggttagccaggcatggtggcatgcatctgtagtcccagatagtcgggaggctgagtgggaggatcacttgagcccaggagtttgaggctgcagtgagctctgattgtaccgctgcactccagccaggggaatacagcaagatcctgtgaccaaaaaaaaaagaaagaaaagaaaagaaaaaaagaaagaatctggtgcgtagagcaatgtttcctcagaaaaaacgagtaaagctacaatgagactagctatcaaccactaaaaatagaggcctggcagagtggctcatgcctataatcccagtactttgggaggccaaggcaggtggattgcttgagcccaagaattcaagaccagcctgggcaacatggcaaaactccatctctacaaaataatataaaaaattagccaggtgtggtggtgcacgcctgtagtcctagctacctggggggctgaggtgggaggatcacctgaacccaagaggtcaaggctacagtgagccaaaatcatgccactgcacttcatcctgtgcaacggagtgagaccctgtctcaaaaaaaaaattgcattaaaaataaaagtaaatagacactaaaatgaaagcacagattataagactgatgaatgtactctaaaaaaattatataataaagcaaagcccttattttttttcttttttggagacaggtccttttttgtcaccttggctgagtgcagtggcacaatcagagctcacttcaacctcaagttcctgggcttaatcgatcctcctccatcagcctcccgagtagctaggactgcaggtgcacaccactacaccaagctaatttttgactttttgtacagatggggtctcactacattgcccaagctgtgccagaattcctggatgcaagcaacccttctgctttggcctcccaaagcgctgggattacaagcatgagccaccatacccagacaaagcccttaatttcttacatatccatttaagggcctgaataaaccaacacattaaaaaggaaaagaataattcacataccagcgtgagtaaattcaagactgagatgatataatcggtaccacaagtctggcaattctccagttggtctaatccatatgtaatgaccatgtcacaatgtatagtcatgctaggatccaagctgccgagcaaaacaccaacacgctcattagcagctgtcaacacagcctcagaaaaaaacacctggtttgcagccgtcacacatctcattactctgtacagaacctgtaaatggggaaaaccagcagctttttaaaaaaattcacgtgcttccacaaagcaagaaaatactttctatttaatgcaatttcaactgaaaattaactgcttgccttgccagcagtctcttaatattctagttctcagtagctgaataataatgatgcctttactacaatatgtaaacatgatcttggctaaaaaatcctaaagtgctactatgacaggaaatggaagctgccatcctctatttcccacatacccaacttcgtttctcccaatgtcactaaatggctgaagctcagaatctttatcatgaaatacaccacgacagtaatggtattgacagcatgggaatagcctgcccacacatactacaagctagctcttgggcttttgggaatcaatctttcaaaactgaacatacaagtcactttaagcttattaaagtttctatctactgatggtctcttttgaaagataagcactctcatgcttgccacataatatcttcaaaaatcatattatttccaatacacacacacacaaaatcccccacttaactataatggccaataattgtgtactaaatttctaataaaataggggagaaaacagagcaaatgttaaaaaatatttctataatatttaacaaccaatacatacaggattttatttagtctacccatagttttcattaaaagtatccttagaggttgggcatagtgactcacatctatcatcctagcactttgagaggattagctggaaggttctcttgagtccaggagtttgagaccagccatgtcaacataacaacacctcatctctaccaaatttgtttctaaattagttgggtgtggtggctcacaccagtagtcccaccaactacttgagaggctgaggtgggaggatcacttaagcctgggaggtcaaggctgcagtgagccaagatcgtgccactgcactccagcctgggcaacagagaccatgtctccaaaaaaaaaagagtgggggggagagggcggagggggaagcattcttggccatgcatgcacagtggctcatgtctataatcccaacactttgggaggctgaggtgggaagactgcttgaggccaaaagttcaagaccagcctgggaaacactgagaccccatctctacaaaaataaaaaattagcaggagctatgctgggaggatcacttgagcccaagagatagaggctgcactgagtcgtgatggcaccaccccactttaaaaaggaaaaaaaaaaaaaagctgggtatggtgacacccgcttgtagggctgagtgaggtgggaagttcacctgggcccaagagttcaagactacagtgagctatgattgaactactacactccagcctgggtgacagagtgaggttccagctccaaaaataaataaaaaaaataaaaaccccaccattctaccattctcaaaggcctaaaagatcctcataaatcaatatacacctatcctataaattatgtcccctttattttatgtctgaattaacggctttttatttcaactctgtacagtcttcaaacaaccaccttttagacattaaaaatgaagcaaagatattaaaccattttgaaaccatattggtttaaaataccgatatgctggtttcatttatctttaagttctgacatttctgctcaagtacacaacttactatataatcagtatcctattttatttagcaacatgttcagcaaaagtatatgctcctaaaagcaagttttatcctaacggtaaaattttcatcagttagattaaattttttatgacggtatcacacatgcttctttctccttattcaaagcagagtacaatgcctggggttcatttcttgtgtcttttccactgaaccctcactggatgtgctatatacagtgcagctaatgtctgaggctgctgaagtgtggcaatctagctacctcatttttaatttgtttatgttctttgatatcaggctatcaaagaatataaagatacacaagttttcatatgagttccatcttatgctcagagaagattactttctgaggcttctcctatagtgtgctattcgtaatatgttgaaaaactaaaaggaaacccaataatttaaaagtaaaattataagaaatattatttaaaaatgaaagaatgagatttaaaaattcagagtggccttttgtcatgggagggtaggggagttggatgaaaggaggatgagctataacaggattccctgcttttctggttgtttaagaaagcagtcagacaatatatacatatatacatacatacatacatgctaaacaaatgaaggattaataacagttcacctggtaaagagaagcatttacaatgtaaaacaattttatttttgaatgacacttcaaatgcccaaaagcacttacatctgttacgtatgcctcagtaattggagggcccgaattgggctgaggctttccccagtgctcctcaccacagtactaaatacccggagaagcgcagccagctttggtaatgacactgatggaggagggacgtcttcatccactgattccccagaggccacatggctgaggtcctagatgtgaattcacagcattcttaataagtagtacattgtttaaaaaaacaaaacaaaaaaaaaaaaaactctaaaatatttcaatcaattcattttagaatagatttttaggcttttagaaagagaactgtggcccatgagaatattcatgactctgaatataaaaatgggttttacctaattatttcaaaaagccaacattaaacccaatagacaacaaattaaggaaataatctcttaaatcaactcagaaagctgttggggaaaaataaattctagcacatatgctctagttatatgtaggtataaatgaagacggaagcttttgccactcctgaattagtttttggctaaaaatctcattctaggtattctttgagccactcagctcaacagtaagtcctccaaaccaagagcatgcacatgaagagcaaagggagattacaagacctggtctacagatgtgtaactgaagaagtacgatatatgaaaaggacaagattcgcaaaaactaggataccagaaccaatgtatacatctacctaaaattaagcaccaaaataacagaagagaatgagatcttaaggataacaaggggaagcatctctacaaactagaatgtgtggcttatgagaggtagatcagctttaaacgtgggctgtgaaaaaagacattctaggtgtgggggcaaagaaaaaacaacgcagaagcaaaacatttccttgcttttctaggaaagagtaaacacatcagtacagctaaaggtactgaattcctgttgactacaagcagcaaagatgaaaaaaacaagatgaggccaaaatctttatgggagccttgactggttgatctgaataggggagaaacacaaagagattcagataagagatggcacagagttaagccatgacagtggggccagaaaagccaagtaccagtaacagaggcttcagcagcgctcttaaagctcctatgctatattcgtacagccacaaaagctggctgaagccaaggcttgtcctccaaagtacgattcaagatctcctgtacatatgtaagaggaaaatctttaggagcttttggtgttttgtgtttttttataacacaacatcaatttgctttaagactctgaagactgggaacaaaaaataaaaataaataacaaaatatgtctttagaaaaataccagctaccgagagtatgtaaagctttgcgaaatacgaagcttgcaacgtttcttttagtctctccagtaattctcctggtaacttaaacacatctgaaataaatgtttaaaatactgactgggcacgggggctcatgcctataatcccagcactttgggaggccgacgcggctggatcaccagtggtcaggagtttgagaccagcctggccaacatggtgaaaccccgtctctactaaaaatacaaaaattagctgggcgtagtggcgggcacctgtaattccagctactcgggaggctgaggcaggagaatcatttgaacccaggaggtggaggttgcagtgagctgagatcgtgccattgcactccagcctgagtgacagagcgagactccgtctcaaaaagaaaaaatttttcaaaatattgcaatgggcttgtaatttctgcttaaatgtcaggaggtctgagccattttaaaataaatctagcacaatttaagattttttcttaaccaaaattttaagaaacagctttctatatactcacctcagcatatgcttccatgtcttctagaaactgaccaagtagaggcgtagaaaatgcaagatcagctacccaaaatggctccaaactctgcaaccacccttggaatcgcgtaagaaattgtgaaagggtaggggggagaaaaaacaccaaaaaatccaaattaaaaaaaataagaggcttcttttaaaaagtatctggttttcaagcagcataccctaaaacatgtcctatatcataaaattaagactgctaaacatgctgatcacgattaaccaatacctctttaattaatacctccttaatttctgcagaaattaacaggtaaatgttatttccttactttttcagtaaatttcatatctatattgtcactacacatgacttaagactaaaatgccacaatctaccattggcccggctaatcccagggccacatctaaccattaaaggtgtatactcatctcctcagtgaaaatgaaacagaccactatcacctgaatatcttattttcaaaagtttattacaccaagtaagttacgagaaactatgacacttgaaacaagctgaaatgtgcaaatgagccacgctagtcattcacttaactccaaaaaagtgggaaacaaaaccacttctcatttatgacaattctccaaattaaccctatatttccttttttaaaaaaataaccagaaaaacaataaaatgtgacaaataacttggatcttccattgtccacttcagggtattgccactgcaatatattcttaccatatactttcctaccagtacaaactacaaataacttgggtaagtcctgtctgtacttactctacccacctactagtaatttcctctgaaaatatatatttagctaacaagtcatgttcatttacaataaaacatttctctgaattagttttcttgcattattaaagaaatggtattgatagatggtcactgggggaccactgctcctccccgacagtatttaaataactggtataggctgcaagacttaccagatacctgctgcgtgagcgaaggtttctgagtatgatctctatgccatccaactaatataccaactgtatccttgatggaaacaaagagagagggggccaatcattttaagatattactgcaatccacctgtggaccatttcacagcaaaagatcctaaaaggagcatctatgttctacctacttgacattctagaaacttagaaaggggagaggggcaggaaaataaaagaactacatttctgacaacaatgaaatagtttattttcttcaaatattttaaggtacgaacgtcagaaagaaaaatgcggcatttaaccctggaacctcaaatatcactgattatattcaaaggagcagaggcactgttttccatctgattcctcagttcctcacacacacaaccatccccctcaccccatgatctgaacagcggaatgaggaactcaccctaaaattagtgctgaaaatatgagggtaacatcgagccaccaaaagaatgcacttaacacatttgcaaagcaattctggtgtatccacattttcaagaattgactgcaggctggtcattacaagcttaaaaataaaagttacaaaccgtgaacattcaacaaaatagggagaaaacaagcaaattaggttcattatttacgaagtgcctacataaaaacctgagtatgagaccaagaaaaatagattctgtagttttagttaaaaaaaaaaagaattgacttgtaaatcccaactgcttgggaggctgagacacaagaattgcttgaacccaggaggcagaggttgcagtgagctgagattgcaccgctgcactccagcctgggaaatacagccagactccatctcaaaaaaaaaaaaaaaaattaataaataaataaaataaataaactgaaaatatttcgctccactaagctgttaagctaaaaacagatactgttttctcttcttcaatgtttgttaatattagtcctttgacatcagttaacattagtccttaataacatctgtttacaatatccctaaatgctctctttaagattctacctgtgattaaatttcaaatacaaaaaagtaaaatggatttgggaaacttttctataaagtacaacaattactttgcaatccaaaatataaagcaaattttatataatttatgctttagtatattagtacttgcttcatattaaaattaaggaagatcagtatggcaccacacatgaataacatgcaggctcaggttaccattatacataaatttttaaaataaatatatggcaaaaataaaataataaataactatttgtcattccattgaaagaatatttattttgcagctgttaaaaaacatttttccctaaaaaaggaaaagctgtgctttacatagcaatcttatcaaagaaatgctagaatcagaaaaccatcattttaggctgggtgcagtggctcacacctgtaaccccagcactttgggaggacgaggcaggtggatcacctgaggtcaggagttcaagaccagcctggccagcatgatgaaactccgtctctactaaaaatataaaaattagcagagcacagtggcacatgcctgtaatcccagctactcaggaggctgaagcaagagaactgcttgaacctgggaggcggaggttgcagtgagccgagatcgtgccactgccctccagcttggacaacagagcaagattacgtctcaaaaaaaaaaaaagagaaaaagaaaaccattattttgcaatagccaatgttataatctacacaggcacagactatcaatgctaaaaatcatttaaaagacatcttggggtaattacagaaatttgaatatagaacacatatgtaataaaattcattttcttaggtatgattacaatattcttgttatacagaagaaaaaccttattcttgggagatgcatactaaaacattatggggtgaactgtcatcatgtgtatggttttcagatgctcaacaaaagtgtgtgagaaaataaaactgtggcaaaatattagtaactggtaaatctaggtgaagcatatattgtgaaattattatcgtatttacaggtatttattttactggtgcatctatctttctatgaatgtgagaattttcacaagagctgggaaaatgttcataattatgcatgcagaataagcccaagctggtggcattctgttcagttacaggtaattttctgaatcttccctcaaatttttctcaaacctctataatcaaggggaaaatgtttcattttgttttgcttttttgagacagggttgcctataatggagtgcagtagcttgaccatagctcactgtagcttcaacctcccaggcacaagcgatcctcctgcctcagcctccaagtagctgcgattacaggtgcatgccaccatgcccaacttattttttttccttttttttttttttttgtttgatagaaacagggtttcaccatgttgctcaggctggtctcaaactcctggactcaggcaattcaccagcctcagcctcccacagtgctggggttacaggagtgagccaccatgcccagttaaaaatacattttttattaaaaaaaaaaaaaaagaatattccttatatttcctttatattttttaaactacatacccaaaataaagcatatcaaaaactgtaaaaaaaaaaaaaaaaaaaaaaaaaaaaaaccctaatatcagatattccaaacacaacaataccataatttaatcacttaaaatcttactcaaaactaaatcaatgatcttttaggccaggtgtggtgactcatgacactaatcacagtactttgggaggccgaggcaggaggatcacttgaggtcaggagttgaagaccagcatggccaacacaatgaaaccccatctctactaaaaatacaaaaattagccaggctaatggcacactcctgcaataccagctactcgggaggctgaggcaggagaatcacttgaacctgggaggcagaggttgcagtgagccgagattatgccactgcactccaggctggacaacagagcaagacactgcataaaaaaaaaaaaaagaatgatattttaatatattcagatacacaaatatgaaatacaactaagtagagccggtattcatttacacataattatcttataccatttggaataagaatttggggcacgttagcaaaccaaaaggctcagaaagaagttgtgatatttagttcttgtctccctctacaaatgtgaagcactcttctatccggcattactagtggagttcctattttcaactttgcaaattctggtcctaagcaatctcaaaaaaaacatttctaaaaaccaaaggggaaaaaaatctttttttttttttttttttttttgagacagagtctggctctgtctcccaggcaatggtgcgatctcggctcactgcaacctcggcctcccaggttcaagccattctcctgcctcagcctcctgagtagctgggactacaggcgcgtgccaccacgctcggctaatttttgtattgttagtagagacggggtttcaccatgttggccaggatggtttcgatctcttgacctcatgatccgcctgcctcagcctcccaaagtgctgggattacaggcgtgagccaccacgcctggcgtgtaagccaattttttagaagaaatctctccctctctctccacatatatgcatatatgtatgtagcactgatccttgaacagtgtatcctttactcaaactgagaaagaggaatttttaaaacatatttcctatcagtagataacccctattctatgattcccttcttcaagctcccctccaaggacatgtgttaaagggacaattttcttcccaagtatatcatgcattttttcccccttcattcttacctgcattacagatgaaaaggctttcttttctcctacagtctctagtgctttgtaggtggcacataagtagaggagtttaacttcatcttttgcagatgagctaaatttgctaaaaatccacttgaagatcttctcagcctcatagctcagagaagcacaaagaaggccgagacagcaagctccctcctgtctcaactcctgaagcaatttgctactgtgtttattttaatgcaaacaaaaaacacacacaaaaggcttaagttttctatgatgacacgagtaatacatcttacaaaagaatgtcttaagtggttttttaaatttctattcaaactacataaaaggttgaaattttctccactctaaatactacattctgtctagcctgcattgccctcaagtatctgtctgacatcactttctttttacaaaatcaattatttacaaacagtgagggaaggcccaaaaatgctaaattccatctcaaactgtattaaataactctcagaaaagggcagcaacaaataagtagataaaacactctatacataactacattctacataatatccaatatgtaatgactataaaataaaaaatggtaatagttaaatacagaaacttaaaaggataacagtaatgatttacatagaactttaataagtaactctataaaacaaaaccatcaaaaggcactaaggtttatgaccagctgagataaattttgggtacttgccaacactgcaaatctttgggaatcaccataacaaaaaatgaccacacacctctggagactctaatagccagagaatatatggtttggatccactcttacccaaagaaggaaattcctttttacctctattctctaagcagtttcaaattctcttgtttacaaaaactaattttattcttcatgcctgcatcaagagtttatgccattccataagtcaagactcagttatccagtgagactagcaaattaaaaaaataaaatattccagccaggcacggtggctcatgcctgtaatcccaacactttggaaggctaaggtgggtggatcacctgaggtcaggagttccagaccagcctggccaacatggtgaaaccctgtctctactaaaaatacaaaaattagctggcagttgtggtgcacgcctgtagtcccagctactcgggaggctgaggcaggagaatcacttgaacccgggaggtggaggttgcagtgagctgagatcgcaccactgcactccagcctgagcgacagggtgagactccggctcaaaaaataaatattcttttcaagtggattccatttgtattcaaccgtaattaacacataattaatgcagataaaaatgacaagacccactgtaatgtcaataaatgttcataaacaaagccagtgggtttgtcttcttgtgtattgttaagtaatttctaaaaatatattttaaagtcatttaaaccgaaccattattagttacttacctttcattaagcacatcatgtacagcagccaagatatccaattgtttaactagtacctttaaaagaaaacacatttataaaaacttcaaattcctatacttttaagaatagcattgtgtacttttttatttgtcttccctccaaattctaattcaacagtactttactttctttattattcccactccccaatgagcatgtatcaggaatgtcatgtttcctttcagcctatgaaagaaattcacccactggaaacatagagctgtgatcatcaacaaaaaaataaactcaaaaagcttgtttcatttactttgaaatccatttgaaaaattgactgacggatggagggatagatggagagatatgtgacaaggcagtatttagggtaaaatgttaacgacaaaaattagatgatgggtttaacagattcaatgtcaaattctttcaacttgctatatatttgaaactactcataataaaatttggaaggaggagaaacttgctttgatccaagtgtcatctgcctcactagaccattttcattaattttctcctgctcattgtcaagttctttttttttttttaagatggagtttcactcttttcgcccaggctggagtgcaatggcgtgatctcagctcactgcaacctccgtctcctgggttcaagcgattctcctgccacagcctcccatgtagctggaattacggtcatgtgccaccacacccagctaattttgtatttttagtagagatgggggcttcactatgttgggcaggctggtatcgaactcctgaactcaggtgatccacccaccttggcctcccaaaatgctgggattacatgcatgagccaccacacctggcccatatcaagttcttaattggtgtaaagaaagtgaagaaaaaaatttaacccttcctatactttgttacatttctgttgttgttttaagagacaaggactccctctgtcgcccaggttgacatgcagaggtgtgatcatatctcactgcaaccctgaattcctgggctcaagtgattcttccacctcagccaggtgtagtggcacatgcctgaagtcccagctactcaggaggccacagcgggaggatagcttgaatccaggagtttgagactgcagtgagctatgattgtgccactgcactccagcctgggcgacagagcaagatcttgtctttaagaagaaaaagaaattacatattagagagcattaagttcttgatcatcataatacagactttccccattcttaaactactcaaggtagcattacctagtttattatggaaacacaaaaatcctcatatttccaaacatactatacttaccagcttattttctggttgctgaataaattctttcaactgctttacagtagccaatcttcggtctcggtcgttttcccgggtgatcctctgaagaagatttgacagtcgagactcatcacaataagacattgatctctctgtgaatatataaacattttgttgtccactgagtataaataagcaaaggaaattttaaattttaaaataattttaaaatttttaaaattaaaaattatttaaataataattaaattattatgggggctcatgcctgtaatcccagtactttggaaggcgggtagatcacatgagttcaggagtttgagaccaccctgggcaacatggtgaaaccctgtctccacagacacacaaaaaattacataaactagccagccaaggtggggtgcacctgtagtcccagctactcgggaggctgaggcaggagaatcactggagcccgtgaggcggaggttgcagtgagccaagatcaccccattgcactccagcctgggtgacagagcaagaccctctctcaaaaataaaattacatcaaaagtcacagtccactggtcaataaaagctcagggaatataggtcctatcgctcttttgttcaactctgtattccaaatcccagcagagtgcctggcacataacagaccctcaaaaaaatatttgctgaaggaaacaagaaatgaataaccctaggccaactgaacacctcattccagaggactggctgggagagaaaaaagaaaggccttagtaacaactttctttgggtccattccaaactgttttcaacatgcaggtaaagagcccgggtgtaggtaaattaaacaacttccaaggggtatggataaagtctcaatcgagtaaaaacaggatataggcttctacttatcatctaggtatcccactggaggaaagcctcttattcacattatcatcatttccctgggatgaagttttggggagccataatcacacatttagttcaacaaatgtctaattatcatctaccacatgcaaggcatgcctccactagaaaggtagcaaaccacaacttttctccctttattttttaatcacaagaacaagcaaacaatagtgaatactattagtatattaacgatgcctttaaaaactagatttttgctgggcgaggtggctcttgcctgtaattacccagcactttggaaggccaaggcaggcagatcacttgagcacaggagttcgagaccagccttggcaacatggtacaaccccatctctacgaaaaatacaaaaattagctgggcacagtggcacatgcctgtaatcccagctactcaggaggctgaggtgggaggatcgctttagcctgggaagcaaaggttgcagtgaaatcacactagcgcattccagcctgggtgacagagcgagactgtctcaaaaaacaaaacaaaacaaaaaactcaatttttgcaaaacattttcaactgtgctatttaccataattagccaatacatacgtaaacaacaaatcacaaagggtctgacagtttcatttctaaggtatgagaaaaaattgataataaaagaaaccagaaggctgggcatggtggctcacacctgtaatcccagcactttgggaggccgaggagggcagatcacggggtcaggagttggagacctgcctggccaacatggtggaacctcgtctctactaaagatacaaaaaattagccggggccgggcgcggtggctcacgcctgtaatcccagcactttgggaggccgaggcgggcggatcacgaggtcaggagatcgagaccatcctggctaacaaggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaattagccgggcgtggtggcacgctcctgtaatcccagctactcgggaggctgaggcaggagaatcactttaatctgggaggtggaggctgcagtgacctgagatcgcgccattgcactccagcctgggtgacagggagatactccatctcataaataaataaataactacaagggggaacaacacacactggatccttttggagggtggggggtgggaggaaggagaggatcaagagaaacaaccaatgggtaccaggcttaatacctgggtgataaaataatctatactacaaaccctcatgacacaagtttaccactgtaacaaatctgcacttgtatcctgaatttaagttaaaaaaaaaaaagaaactacaatgactgagagaagaataggatttttacaaatccgtagcccatagagtatttcaataaggacagataccaaatatgtcatcaagttaccagctgggaaattaggctctacttacaattctgtcactagcaaactacatgaccctgagcctttgaagaagaggaattctctactgaactactttagagtcgctgtttagcttctataatatcataagtctaaggcttcaaacactctattttaacaaacagcatacatagcctttgaattcattccacttgtgaaaacataaaaagaaatcagttttttaaaagttatataccaacaataaaagctacaggcacaaagattttcaccaagatacacgaagcacacacacagtataaaaaataaaaaaaaaaagtcaaaaactaaacgtccaaaaagtaattacatctgacaaagcccataactcagctttaccgataagtttctctttaaggaaaaaaattatcattacctctaatcctctgaactttcttttttgttgttgttgttttgagacggagtctcgctctgtcgcccaggctggagtgcagtggcgcactcagctcactgcaagctctgcctcccgggttcacaccattctcctgcctcagcctcccgagtagctgggactacaggcgcccgccaccgcgcccagctaattttttgtattttcagtagagacagggtttcaccgtgttagccaggatggtctcgatctcctgacctcgtgatctgcccgtctcggcctcccaaagtgctgggattacaggcgtgagccgctgcacccggccaatcctctgaacttccaaggcactcacctatacagtgaggctatgtcataaggcagaaatgctatcagtgtatttaactttagaaaagtgcccactcaaggcagggcccggtggctcacgcctgtaatgagcacgtgtgatcacttgaggtcaggagttcgagaccagcctggccaacatggtgaaaccctgtctccactaaaaatgcaaaaatcagctgggtatggtggtatgcacctgtaatcccagctacttgggaggctgaggcatgagaatcacttgaacctgggaggcggaggttgcagtgagcagagattgcagcactgcgctccagcctgggtgacagagcaagactctgtctcaaaaaaatatattgaaaacaacaacaacaaaaaaaccagaaaagtacccactctagggggcggggggaaggagagcatcagcaagaatagcttaatggatgctgggtttaatacctagatgatgagatgatctgtgcagcaaactaccatggcacacgtttacctacataacaaacctgtacatcctgcacatgtaccctgaacttaaaagagagaaaaaaaaaaaaaaagacagaaaagtaccccctctctacatatatctatatcctccacaggcccaagagttcaaggacttgctgtagtaggagcctactatgcactatacattcaatatccacgataattgggtaaaccttttctgtaagatcttatccagtcttctaatcttgttttaagagaattctcttttaaaatgtactatagcctttctagtgggaaattaacaattcacaggaaaagaatgtaaacaatttttacctgcacagtagactaatcaacttatgcctttgcaaggcattagtaagaggcatccagaataagaggagatacaagtctttggaaggtgtatgtgattggtccccgttttcccagccttaccctgtgatttcctcatgtctttggtggctaaagcacaactgccatgctgaacactggtgaactcagggctggtcacattgttaaccctcagctcttgccccaatgacttccgaccataagtattttccccagatcccccattgacaccgtagccacctacaaacagccatgtgtacgtcatttaaatatgattgttcgtttcattcagtcaatttcctgatagctcaggatcttatgactcaatctgcagctcaaccagcctttgcttctcctacctttttcctgtactgtctgccttgaaaatcattttcatttcttttaatacacctttgaagttaaattaattttattttgatcccttcattggaaaataagcaaagaaatgaaaactaaattaaatcaaattttgcaccttgttttaaaactttcttgaagtttagagacagtagccaagaggaacttcaaccttagctaaatatttttgaaaataaaaacaaaaatagtattgtatcttttttgtaagaaaactgcattgatgaattatgtatggaaaaattttaaattttaaaaataataaagtggataaacgtcctatgaagttttcagaaataacactgcatttgttattcatattttaaatatattagaagaaagtgagaaagttgggggtgtaagaaggcaggaaggtgggataggtaggttcaaaaaacatgcttgtagcaataagaaaatatatatacccttttcgtcattctgtatgtcagcgtggactctggtatcatcgtgcctttgccgagacaccacagctgaatttgaaggttgcagtccgtaagaggaagaaccacctctatctctggatgaagaatattttaaattacctgggtcggctgatgcactatcagttctataaaaagagaaaagtttaagattagaactttaaataacataaataaatctttctttaaacaagcctctcttctcccaaattttacatttaaccattactattgtatttagtgtaatatgcactatatattatatgtaagcactcagccgtctaataagaagtctttcactgggaagagagtctcaatggatgaaatgccaacttttcactctcttctactgttctaaagacccattcagaaatatgaataactactgggattagggtgactttgctggttttagcattgaaagtctcctgtcccaggcaaaacaggacaattggttactctggtccagtgttctcctcacatgacttgataataagaataattctttctaaattctcccccatggagacggttaatcagtcaaaacatttcagcctttcctgtcataaaaataaaaaacactggcagcatgtcagggacgggcaatgtcttaccaagttattttctaagtactgattaggtactgtagtattgaagaccccattgaagatgccttaattgtaaagagtagcaatcaaaattttaaaaagtaaaaaagaagacattttaagaaaataaaaggtatcagaaatgcaataaagttatatcagaaagttgtagttcgtaatctatttaaaattcaggtactgtttagaataatacctgatgcttattagtaaacaagtagggtacagccaagggtaaaagtgtgtcctcatctaagtatctgctctatgcttcaactgcctcataagtaaaacagagctgagttacaagacttctcatgagtgttactctttcagccatcaatcataaactatcaagaaagaagacaacaaaataatctgttatagcatatgaaaaatccaagtaagttcttcccctactgattttctcctgagaggaacaattttgaggaaaaaaaaaaagaaaaagaaaaagaaaatcacttctatgatatttactaaaaatgctttctcaaccttttagaacctgaatcttttagaaaagtttaggacactggcaaggccagaaactaacctattcctctacgctttgcccctccctctatggtgtaaaagtgacagcagtgtttgtatactgtatatatttcgtttagagtttattagtctttccttgctcccaaaaatactaaacataaaactttgcatgagctcaatcagttggacaccttgatctgcacttactgcaatcactgttaatacagaatgcagacaataggtccaattaaacttggatatctaactggtacaagtcattacttataaaggatctcaatctgaaacttcatgaaattcaaaacctagcatactaaaatgactaaggctccataaggagtatcttctaatattcagagttcacttattcataaagctaagtacttcgaacataagggaaaataaaatctatggaatttcaagaaaaatgtatgagaatattttctgagtatactaagtctataagcattaaaatattaactcaatggaccataacttttttaaactaatgaaaagacattccttatgtacctaaaaatagcacacttaacatgcgtctatataaatcatagcataccattactttctgaaaggagactgaaacgttaagagagcttataatcttttctgacagggtttgaactttatatgtatgccacagtaagctcttattagatgagcgaataaaataagcacttgactaattcagaaacacaaagataactgaagtctgccaatatttaaacgtatcttcacttcctgttttcatcatgtttacttatctcctacactacctttactattaagagttaaatgtttgtatcattttctggtgacacagtagtaccataaggcagcagagaatacaagttaaaaaaagatctgggctcaaatcccagctccagcactgaaaagtatgtgtgcttttgcacaaattacttgatctccaagccttggttgtctcttgcataaaatgaggatgatacctatctaacatgtaaggttgttgtgaggctgaaataagataatgaattataaagaaacacttagtttgcagggtatgttaaaagttgttatgaccataatacaaaataaactcaaagtttccagtctaaaagacaatgtacaaacagttcatgagtatatgaatataatcaaaacaagtttttacagtcaatatagagcaacttaaatacttcactgaagaaagcaggtaatctgttgctaccaacaatgtgtttccaactaggaagcatctgatttcaaactaaactgtaaaaccaggagcagcttccccgttggttagaaataaggtttctaaatcccctaagttatgaacactgagatttttttcccaaaaaaaatctgttttcagaaatataacaaaaaaaactggaatagagccaccgtctcagaaatacctcaaaactccctagttgccaaattattttaatacaaattgatcaaagcatccccaaccagaactcaggttgtaagcattctgaacctaaaagcacaaaatggtttagcatttataagaaatttctatttttatacaatcttgactgctttggtttcaaaaaatgtcaatgtcaggctgttagcaccaacaagatcatcccagtccaataaatagagaactgttaaagaagggaaatgagcacttaaaatgaggcaatcaaagccacaaaatagaaactgcagatttgaactccaagaagcaggcatgaatgttaagactagttagttagaagagctgaaagggatatcatctgccagaattagtgtctcaatttagtgaaaaaagaaaatctatctgttaagtctaagaatcctagcaaggatccaaaaatacctctacagcccctttaatattctaaaaatatcatggagagaaaaaaaaagaaatgcataaatttccccaaaacgatcaaactgaagttaaagcctgatgtacatgccacatgagaggtaagtttctaaagctcatacctcaaaaatcgcctttgtgatgttgtgcatcaagtcaatctgtaagacagtagttacaatattagtgaagacagtgggttaaaacatttgttgttcaaacatggagcaaatatcattcatgagttaggtgcctttagttgaactatggtcccattagggttcatacattaaagcaaaaattgaggtggaaagacactctgtgccttacaggataaagaggcttactgtggcaaccaaaaaaattttagtacataagagaatttaaatgttaactataacatacaaatcacatgcaaatatagttaccacttattttagttacctattctcaatatacagaaaaatgccacaaatctaggaggccattcgtttcaaatgaccggaatccttagacctcacaccaacaagccaccatgtgctggggatggtatcgcctgactaaatgtagccttgcagtccattcttgtaagtattagagagaaaaagagagagagcgtcgtctctggaaagtgtgaagtcagggaattccctactaggaagcaattccataaagcaccccaaaatgacttgatgcaaacaccacacctagtggtgacactggaataagcatcatattacttcaaattgcttttacctaggtttattaagggattttgctctcatggtgagatctaatttgtaatggatataaaccaggaaatgagatttgcactaaagccaatgaagtaggaatgtacttattctctaaagcagcaaagatagtctcactgtcacagagcagttataggatatgttgctttccatactaatggttaataccacttggaaatgatttacccttcaaaaataaattcaaggttttcccctgtaatgcctcttacctggattcaaacatgctttaatgaggaataagagaaagggtgaaactatgaataaccctgggccttgtatcattacattagaaacactgctctaaatatgagtctatggctaaaatattaatttgggaggctcagggaatttattatacaaatctcttcttgcagagaactttaagttcaaatttaataaaacaaaacagaaccattccatgtcaaaattgtaaatgagtatgcatcagttttgcaatactgaaatattaaattactataatttattggtaaaactaccttagctacctaagtattaagtgtctataataaccaaatcttaattatccatttatgggtgatttgtttccttttttgagacagggtctcactctgtcacccaggctggagtgcactggcatgaccatagctcactgcagcctcgacctcatgggtgcagcctcgacctcatgggttcagcctctcaaacagctgggaccacaggtgcatgccactccatttagctaattttttatttttatgttttttggagacaggtgtctgattatgttgctcaggctgctctcaaattcctggactcaagcaatcctcccacctcagcctcccaaaatgctaggattagaagcatgagtgaccacatctggactgtcaccaatttttaactgtctgtcaactaaacagccaatatagactgataaaatatatttaactattgtaaaattgtaaagaattgtatcttcaccaaggagaggtctggcttttacctgtgaattctggaaggtaatctctaaactcttgaaatgtcatacctaataagagggtcctggccaggagcagtggctcacacctgtaatcccagcactttgggaggccaaggcgggcagatcgcttgaggtcaggattctgagaccagcctggccagcatggtgaaacctgtctctactaaaaatacaaaaattagccaggcatggtgacgggcacctgtaataatcccagctactcaggaggctgaggtttcagtgagctgagatcatgccactgcactccagcctgggcaacagagcaagactatctccaaaaaaaaaggggggggggcggcggtgggggaaagtgtccttgttcatctgggggctttaggccacagcacagtctaataatgtggcttatggtgggggctttgagtcacatggatcagcttggcctccagtggggctggagactaaggttagccacatgggcatgcaaccatggaaccccagtaaaaacgctggacataaaaaatagagtgagcttccctggttggcaataatccatgagtatggtcgcacaccagtgccaccaggaaggtgtcatttttcacaactctacagggacaggacaattagaaactccaacatttggaacttccccgaactctgccctatgcacctctacccttggctcgttctaatctgaatccctaaactgcaataaactctaaccacgggtatgagagctttcaatgagttctagtgagtcctcctggcaaatcatccaacctaagagtggtcttggccaggcacagtgactcaagcctgtaatcccagcacttcgggaggcccaggcaggcggatcacttcagctcaggagtttgagaccagcctggcaatatggtgaaactgtctctaaaaaatatagaaaaactagccaggcgaggtggtgtgtgcccacagatccagcaactcaggtggctgaggtaggaggactgcctgaacctgggagggaggagttcagggcgcagtgagccgtgatcatgccactgcactctcaccggggtgacagagagaggccctgtctcaaaaaaaaaaaagagtggtcttgggaacccccaaacttgcaactagtattagaagcaagggtcatcttatggactggactccctcttactctgcactcatatttaaaaccattaaatatactgtagctcaaaaaaagttgcttgtttgttttgaaaaagggtctcacactgtcgcccaggctagagtgcagtggtgcaatccgagctcaagcaaacctcccacatcagcctcccaagtagttgagaccacaggcttactccaccacgcccagcaacttttgtatttttttgtcccattctctacaacattcccaaaatgttgcccaagctggtctcgcactcctgagctcaagtgatccactcacctcagcctcccaaagggttgggattacaggcataagccactgcacccggccataaattttgttttttaataacatttccagcaaacatgataaagatttgacttcagtgttgcttattttccttccaaggaacctctaatattctctactttcagaactccaatcaaattagccagaaagagcaaacgaagccaataaatccaggagggcaatagatctgattttaacccttgtttcacatgcacaattgtcttcagagaaaagctgaagaaagtaccccctcacctccatgccccaatgctccttttctctgacttcaagtgggcctctgatgctgcccacatttccctcaccaggtttctttcctttccaaaacatctgtaaaactttctgcacctttttccttctcccaccactaccagtggatgaccttatagatttctgctccatgagaaacagaagccatttgacagcaccctcagcaagagctaacattttagctcctaacaagagctagtgggcaactgatccaagcagtttacatatgtttatcatgtcatttcgtgttcaacacaatcctattagttataacttgataactaaggtttcataactggcctatggttgcacagcttgcaaaaggcagagtcagaactcagacccagtactgtctaatgtttgagctcttcaacactccatcactgcctgtcatcttccttctaatatatccacaaattcacctgcatctgcacatacagcttttcttcccatcatcttcgcataatggaacaaataaacctcctatccatagaaatcatctgtctattccccccattttccaaggtatgtcttgtctttttttttttgagatgtagtctcgctctgtcgcccaggctgaagtgcagtggcgtgatctcgactcgctgcctcccggattcacgccattctcctgcctcagcctcccgagtagctgggactacaggcgcccaccaccacgcccggctaattttttgtatttttagtagagacggggtttcaccatgttagccaggatggtctcgatctcctgacctcgtgatccgcccaccttggcctccccaaagtgctgggattacaggcttgagccactgcacccggcctgtttcttttgtacgttgcaaaatctcccattttactactgcttatcacatcatcaacatatgagcactctcaaaagtcttactttaaaaaaaacaaaaacaaaaacaaaaaatggccgggcacggtggctcatgcctgtaatcccagcactttgggaggcgaaggcaggcagatcataaggtcaggagattgagaccaccctggccaacacggtgaaaccccgtctctactaaaatagaaaaaataaaattacctgtgcgtggtggcacgcacctgtagtcccagctacttgggaggctgaggcaggggaatcatttgaacccgggaggcagagcttgcagtgagccaagatcgtgccactacactccagcctggtgacagagcgagactccgtctcaaaaaaaaaaactaaaggccgggtgcggtggctcacgctggtaatcccagcactttgggaggccaaggtgggtggatcatgaggtcaggagttcaagaccagcctgcccaatgtagtgaaaccccgtctctactaaatatacaaatatcagccaggcgtggtggcgggcgcctgcaatcccagctactcaggaggctgaggcaggagaatcgctcgaatccgggaggcagaggttgcagtgagccgagattgcaccattgcgcttcagcctgggcggcagagagactccatctcaaaaataatcataataataataaaataaatttaaaaattaagaaaataaggccgggcacggtggctcacgcctgtaatcccagcactttgggagggcgaggcaggcagatcatgaggtcaggagtttgagaccagcctgggcaacatagtgaaaccccgtctctactaaaaatacaaaaaattagccgggtgtggtggtgggcgcctgtattcccagctagttgggaggctgaggcaggagaactacttgaaccccggaggcggaggttgcagtgagccgaggtcacgccattgcactccagaccgggcaacagtgtgagactctgactcaaaaaaaacaaaaaacaaaaaaaccctttaactgcctttctccctctatcaatctaatagcctggactcttcacagacaaacctgttgaaaaatttatcttccttgccttcatttactttttaacccactttaatctgggttccacctgcaacacaccactgaagctattcctactaaggtaggaactgccactcaaggccttcttggctctaaaatcccatgagcctttttcagttcaccctacaatttctcaataccactctaaagtttatgagttttttagttaactttaatccagtgactctttctactttatcccaatccaagtattctcctccttcttcacttcattttttttttttttttttgagacagactctgactttgttgcccaggctggagtatagtggtgcaatactggctcactgcaacctccacctccaggttcaagcgattctcctgcctcagcctcccaagtagctgagattacaggcccctgctaccacacccggctaatttttgtatttttagtagagacggggtttcaccatgttggccaggctggtctcgaactcctgacctcaagggatccacccgcctcggcctcccaaagtgttggaattacaggcgtgagccaacgtgcccggccccttcttcacttctttaaccagcttagatttcattgtgtatcatttcaacaacactcttgcctatacccttaactcttaagattctcatcacacccatctggcaaaaccccaatcctggataaacccaacgatccatcaataagcaccacactcccaggtcctccagtgtttacttcccattctatacatgcactatccagacattcccattctcttcaaattccaaaatatcctatcacctcccctccccatacacacattctacttcaccaacaagaaaaaaggtaccagctgggcacagtggctcacgcctgtaatccccgcactttgggaggccaaggcgggtggatcacttgatgtcaggagttggacaccagcctggccaaaatggtgaaacctcatctctactaaaaatacaaaaattagctgggtgtggtggtgcgcacctgtaatctcagctacatgggagactgaggcaggagaatcgcttgaacccaggaggtggaggttgcagtgagccaagactgcaccactgcactccagagcctgggcaataataagagcgaaactccgtctcggggtggggtgaggaagataccataaaatacctgtacccgattctagaccttactgaggattccatctacttccaccttactgtaacttttcaaatacttttcccactgaactaaatcccccccataaacatgcaacactttctaatgtattccattgaaaaatacaaaaacatataaaaaggaaaaactccatcaatcccacatgtccctccatcaaacaatctgcctttacttgctgcagccaaactaaagttgtctagattcccctctcccatttcttcacttcttctagctccttaacacacactggtccaatttctgccccatcactcttggcaaaatccattatgacctccaggctgctaaatccaagatacagttcaggcctcaatctgctcatcctttcagcagctttcacagggcttctgagtagggttgagcagttttgccctgcacacaggtgccctgcagaggaatgaggtgggctgaatgaaactccttttttaaaaattcttggctggcatagtggctcacgcctgtaatcccagcactttgggaggctgaggtggacggatcacttgaggtcaggagttcaaggtcagcctggccaatatggcaaaaccccatctgttaaaaatacaaaaattagctggccgtggtggcgggcacctgtaatcccagctactcgggaggctgaggcaggagaatcacttgaacccaggaggcagaggtttcagtgagccgagactgccccactgcactccagcctgggcaacaagagagaaactccatctcaaaaaaaaaaattgtttatgccaactaattgtacacctaaatgcaccaagttcctgactttctccttgcatttatttgtttatttatttatttatttatttattaggtctcactctatgttgcccacgttgtagtgcagtgtgtgattacagctcactgcagccttgaactcctgggctcaagagattcctctggtcttagcctccccagtagctagaactacaggtatggagtggctctctgcctttatttctaacccaagctaccttacaaccttaaaaagagacgctgcttcgccgggcacagtggctctcacctgtaatcccagcactttgggaggccgaggcgggcggatcacgaggtcaggagatcgagaccatcctggctaacacggtgaaaccctatctctactaaaaatacaaaaaattagccaggcgtggtggcgggcacctgcaatcccagctactcgggaggctgaggcaggagaatggcgtgaacccaggaggtggagctggcagtgagccgagattgcaccactgcactctagcctgggcgacagagtgacactccatcctaaaaaaaaaaaaaaaaatttattatatacatacacacacacacacacacacacatacacacacacacacacacacatctccccagaagcatcaatatttactgaattagagtatttcattacctgttataaaaaacaaacaaaaaaaccttccattatactaatttataaaggaatcaaaacaaaatgggttggcgggtccaggcacggtgtctcacttctgtaatcccagcactttgagaagccaaggtgggaactcgaggtcaggagttcgagaccagcctggccaacatggcgaaaccctgtctctaatacaaaaattagacgggcctggtgacatgcgcctgtagtcccagctactcgggaggcagaggcacatgaatcacttgaacccaggaggtggaggttgtactgagccaagattgtgccactgcactccaccctgggagacagagtgaaactatgtctttaaaaaaaaaggcggggtgcagtggcacacacctgtaatcccagcactttgggaggccgaggcaggtggatcacctgaggtcaggagttcacgaccagcctaacatggtgaaaccccatctctactaaatataaaaaaattagccgggtgtggtggcacatgcctgtaatctgatctacttgggaggctgagacaggaaaacagcttgtacctgggaggcggaggatgcagtgagccgagattgcaccattgcgctccagcctggacaacaagagcaaaactctgtctcaaaaaaaaaaaaaaaaaaaaaaaaaaaaaaaaagttggggtgaggggaaggttcaacttaaagatacaattactaagtgtttcataaggaatgacttatttcataatggagtaggagtttgacaccagcatgggcaacatggggaggccccatctctacaaaaaagtaaaaataaaaaattagcgtgccaagcatggtgggtcacacctgtaatcctggcactttgggaggccaaggaggaaggatcacttgagcctaggtattcaagaccagcccaggcagcatggcaaaaccccgtctctacagaaaacaaaaaaaaaataaagtagctgggggtggtaacatgcacctgtggtcccagctattgggagggtgaggtaggaggacttattgagcctgggaggtggaggctgcagtgagctgagatggttccactgcactccaacctgggcaatggagcgagactctgtttcagaaaaagagagaggaagccaggcgtggtggctcacgcctgtaatcccagcactttgggaggccgaagcgggtggatcacctgaggtcagcagttcaagaccagcctggccaacatggtgaaatcccatctccactaaaaacacaaaaattagccgggcatagtggcatgcacctgtattcccagctacttgggaggctgagacaggagaatcacttgaaccaggaggcggaggttgcaagtgagctgagattgtgccactatactccagcctgggcgacaaagtaaagctctgtctcaaaaaaaaaagagagagagagaggaaaaataaattagccaggtgtggtggtatgcacctgtggtcccagctactcaggaggctaaggcgggaggattcccagagcccaggaagtcaaggctgcagtgagcagtgattgcaccactgcactccagcctgggcaacagagcaagagcatatctcaaaaaagaggaaagaaaagaaaagaaaaacataaaaacaaatgttcctttagttttaatttttattttttagtttattatggctgttttactctcccccaagtaaaacagccatacacaatttgctgaaattttccttagtgtactttgaaatctgtggaacagaactggcaatcgctaaattctatttgactctagttccatttaatattagactggtgtggaagtaactgcggtttttgccaaaaccgcaattacttttgcacctacctaataggtataaaatatgtaacttcacttaattttatcctttatgtatctccctatattatgtacctatggacatcaaacttagtacagactgataaaaggctgaatagacaactctggtttcaaaaatccagcttctcacaacatcagacatactagtatacagcttttctaatttcacaacacatttccattttttggtctttcacaatagagaagatgtgtgtacttttgaatactctgatctgtctacaatctaccaaaattggaaggtgtttttattatacagtttcatccttttagaaatatagaaagatcctaagtttgggcacagtaagacactcaatatagatctactactaaacaagtaagaccaattacacaattaatgtcctaataccccgagtggagaagtaaaatctacttgttttctgttgacttgaatgccttctcttctttgttgaattaatcaatctatttgactccaatgtcaaattaatcaatgtcactttagaatattaaaatgtacaattatgaattacacatttaattttaaaacacatcattctgatctctgtcttgattgatactagaagattatcttccaaactaaggtggaaaaaatgacagactttagctattggcaatgataggtcatttttttagggaagaggagtaaagagggccacctccataggtcagatatccctttgttctaagaagccaccacccctgtttcttcatatgaaaaaaaccagaggcatccagtggttcccaaaaccttctcaactttacgcttgaggaacccacagatttcaaataatacaactgacctaaaacactcatttgtttaaccattctttttttaactttttattttttttgagaaggagtcttgctctgctgcccaggctggagtgcagtggtgtgatgtcgctcactacaacctctgcctctcaggttcaagtgattctcctgcctcagcctcccgagtaactgggattacaggcatgcaccaccacatcccgctaatttatttatttatttttttttagtagagacgggggtttcaccatgtcggttggccaggctggtctcgaactcctgacctcaggtgatccacccacctcagcctcccaaagtgctgggattacaggcgtgagccactgcccccggcctgcttaaccattcttaaatgtcgggtgcagtggctcacacctgtaatctcaacactttgggaggctgaaggtgggcagattgcttgcgttcaggggttcaagaccagcctgggcaacgtggtgaaaaccccatctctacaaaaaatacaaaaatgagccgggctgttggcaagcgcctgtagccccagctacttgtggatgctgaggcaggaggcttgagcctgggaggtcgagactgcagtaagccaagtatctgtgccgctgcactccagcctgggtgacacagcaagaccgtctcaaaaaaattgacagaagagttgactgagagcacagtgaatgaaaaggaagactataagccagtgccatataaatgcttactgttggaggtatgcttctatggaacacgggtttgctctcttgccatatgacattcacatattcagccacctggaacacttcctgtcagtatgtgtgaagtatcatgtgtggtcaaaattgtctcaacagtcattttccacaccaactggcaaactaacactaaaagaaatcaacaagtattgctttttcaaaagcctaaatcggctgagtgcgatgacttacacctgtaatcccagcactttgggaggccaaagcaggcggatcacctgagtcaggagtccgagaacaggccggccaacatggtggaatctcgtctctactaaaaatacaaaaattagctggacgcctgtaatcccagctactcaggaggctgaggcaggagaatttttccctgtaaccgggaggcaggggctgcagtgagtcgagattacaccactgcactccagcctgggagacagagcaagactccatctcaggaagacaaaaaaaaaaaaaaaaaaaaagcctacatcaaggaaaacagaaccaaaacaccagggacaaaatggtacataagaggcaaaaaaattttcaccaaaattattcagatgaacaataataaatgtgcctgcatctgaagatgttctaaaccttcatttaagcaagaagcaagatcaagatctgttccgtcagttacctggagtctgtcatctttctgaataggggacagaatcacctcaaatttaactaataaaaatttatgacttggcaaacaccccaggtatttttattgactaacaaatcagctatgacaatcttagcaacaaatcaagttatgctatggggtatgtccacacttccctgttccctctacaacaggagaaaatcaaatttttccaacatcctaacaaactgttattgcctgtaaccaaatgtatcacagtatcgtctaccaaggcgttacatcctgaaactttcctacaaaaagcacagcttcaaagaaaccttgcaagctttcttgtaagctcctcccttcccccatcgcccctccccagagccaagaaataaagcacttgaaagaaacaacatggataatatttattaatagctcatgtacatattccataactacataagccatttggcttcatacctgtcagcaatgaagtcagctggccctagcacgtggctgcgactcttctctatttatttagaactacaaactacaatttacacttttccaaaagctgtaggactatttgggaagggcactttattcttctaaaaggttactaaattctcttatatacttatactgatcacaatactgaaaaataatagaaaatccattgtcattcatttaccacctaatttgttagatgccagaaaatcaaatttcacacatttcaataaaaaggcaaaactaagcatgtcaatcataggaaaaaaaatacttaatcaactaattttatttaaagcactcacaaactcttaagtggtacaagacaagtcaacgctgtttatcgaacaatatttttttttacgactaaacatctcaattctagactcaggcactaattattaaagtcatctagttatatacaccaattctcaacagacacagttttttttggaaaggcatattaaacagactaagatgtgtactacccattagccaaagataattttattgatttttctaacgagtcttcaaatgttacattctaacatcttagcaaattatttccaaatactgctggaattacatgtaactatcaggaaacaaaagggcttctcaacaacttgtgcgttctacattatctggccagtttccggacaattataatacaattgtgctccaaagtaggagagttccatgaatcaattacccctaaaatatatttctgtatatttaaggagttctaagcattgggttaaattccaaacagactctgaatacaagcatttatttagtaagagaggttagaataaatcaatcctaaattaggcacagctgccctccccccattgatcaaaaagacaggaaattacatttatttaaaaagttaatgttcctaatatattcaaatctaactaagccccaaaacggtctgacatcaaatcctccataaaagaggaaattctctagacttctaagtgggtgcccagagttcactcaagtgtccaggtatgaattacgattcaccagagtaaccggccttgcacttagggaaaacttccatcgcccaagaccagagtaggtcgatcccatcaacagtcacacaatctcatctcacgctccactaatgaatgttctgcctaaagtcagagcaatgccttagctggagttttgttttggttttttcaatattaccacgtgggggtcacagaaaggaacagaggttagaagagctctcacgtggcggctgaaagactggggaaccgagaaagtgaatgagtaacagggagggtcctgtactctcagaatctcccaactcggggtcagggggaagcggtaagtggaatgccccccgcccccccacccccgcctctttctcacctcctggtcccgaccctaggccagtgccaccgccgggagccccgggtctcggcttcagccccgggctgaacaagcagggaggggagaggcacttaggcctcgcctccccgcggccttcctcccccagccggggcggaggagacccaggaagccgcgcccggctcccgggggtggagggcctaggccgcgcctcccagccccgcggccctaggcctccgcccgcccgaggcggagcccgggaggtcggggcggggtcccgggccggtcacccacctgggttgccagtcattccagctccgcgaatagttggtgccgttggtgccgccgccgccgccgccgccgccgccgccgctcagccgagaccccggggctctgcggctcattaccttccccgacacgatatggccaagcgccgccgcccagagaagcgcgagtcgccacccgaaccggccgccgccaacaccccgctccggcccggggctgagaaggaagccgagaaggaggaggaggaggaggcggcggcgggcgggggaagaggacgaccgtttcgggttccgcctgagcccgcagcacaggacgaggaggcgggagcggcgcggtgagagagaggcggatgaaggggaggcgacgtctcttccagggccctgcgcggcccacgtcgccggggcccccgaggaggaggacgacgaggaacaggcggtggcggcagctcctcacgctcacacggccactgcttccccgcctcccggctccgctcgccgcgccgccgctgtcgcacggcatgctgggagcgagaggcggggtcggccccgccgtgcctgcggagagaggcgggtcctgtcggcggggcggggccgatagcaggccgccccgccccccacggccccaggctcttggacggcgaagaggtctgggcgtagcggtgacgaatcctaagacgggatctccactactgcggccacacacttttctcccaaatgcttcccggaaagcaccggagggccaggcagtcaggtgtaaacaggcgtccaatcaaggacctgcggtggggggggggggggggggcgggctgttgccctggggtgcgcgcgcacacaggcgcgcccttggattcacgtgtgccagttttcccactttctacggggcggggtggaaagtgaaaatagtcagatcgacaggtggatatccaccttcccaacctccacctgaaatgtgcccatcgagtcctagcaccttttaccatttcttcccaatgaaaaaaactaaacgatggaagggaagggagtacccacgaccaccaaaccctgtcctctgcaatgtgaaatgtgctttgaagtcctctcaccctgaggcttgcccgccttctgctggtgaaagaagctgggggctaggcgcggtgggtcacgcctgtaatcccagcactttgggaggccgaggtgggcggatcatctgaggtgaggagttccagaccagcctggccaacatggagaaaccccgcctctactaaaaatacaaaaattagccgggcatggtggagggcgcctgtaatcccagctacttgggaggctgaggcaggggaatcgcttgaacccaataggccgaggttgcagtgagccaagatcagaccattgcagtccagcctggagaacaagagtgaaactctgtctcaaaaaaatataagagagagagagagagaaagcagggagggaagaaaaaggaaggaaggaaggaaacgagggagggagggaaggagggagggaggaaggaaggaaaggagggaggaaaggaaagaaaaggagaaaagaaagagagaaggccgggcgcggtggatcacacctgtaatcccagcactttgggaggccgaggcgggcagatctcgaggtcaggagatcgagaccatcctggctaacacagtgaaaccccgtctctactaaaaatacaaaaaattagccgggcgtggtggcgggcgcctgtagtcccagctactccggaggctgaggcaggagaatagcgtaaacccgggaggcggagctcccagtgagcagagatcgctccactgcactccagcctgggcgacagagcaagactccatctccaaaaaaaaagagaatcagctgggtagaggagacgtacctgactgtctaccccatgacatgccccatgccccagggaaaaaaattccctaaagcatctgatgcataacgtgaatgcatacacattttttaaaaggtgggccaggatgctccttaaacaagtgcctaaaccttatctgcataaggagtcttaacctatcattttatgttgcaaagaaaacgtctttatatatcgcttgtgcaattaaaaattgttaccaaaagtacttgaagattacgaggagttgacacctccacacacatgcatatcccctccaccttgggctccttgcttatggccaccaatccctcactaagggaggatcttgccagttctaaatgatggggactacaaaaattacaaaaattacccggcgtggtagcgcgtgcctgtggtcccaggaactcaggagggtgaggcaggaggatgacttgagtccagcgggtggaggctgcagtgacctatgatcctgccactgcactccaggctgggctgcggagggtagggagggagggagaagaagaaagagaaaacgcggggcaccatggatggctgactcctgtaatcccagcactttgggaggccgaggtgggtggatcacttgaggtcaagagaccagcctgacaaatatggtgaaaccccgtctctacaaaaaaatacaaaaattaaccaggcatggtggcgcacgcctgtagtcccagctatttggggaagctgaggcatgaggattgcttgaacccaggagccagaggttgtagtgagccgagatcgtgccactgaactccggcctgggtgacagagcaagactgtctcaaaaaaaaaaaaaaaaatcatttagatgaagtgattcatgcctgtaattccagtgatgggaggctgagactggaagatccttgagcctgggagttataggccagcctgagcaacatagtgagacccccatctctacaaaaaaaatattaaattttttttttcagacggagtttcactcttgtggcccaggctggagtgcaatggtgtgatttcagctcactgcaacctctgccttccaggttcaagtgagtctcctgcctcagcctcccaagtagctaagattacagacacatgccaccatgcccggctaattttgtataaaaatttaaaaatttttaaaattagacaagttagaaattgcttgagcaactggacacaatctctggtactacctttctttttcttttttatttttttattttattattattattttttgagaaggagtctcgctctgtcgcccaggctagagtgcagtggcgcaatctcggctcactgcaagctctgcctcccgggtttaagccattctcccgcctcagcctcccgagtagctgggattacaggcgcccgccaccaagcccggctaattttgtttttttgtatttttagtggagacggggtttcaccgtgttagccaggatggtctcaatctcctgacctcgtgatccgcccgcctcggcctcccaaagtgatgggattacaggcgtgagccaccgcgcctggccctctttttctttattggtcaaaatattatccaactaggcatatggatgtggaggcatgcctgtgatcccaattacttgggaggctgaggtgggagaatcgcttgagcccacgagtttcaggctgtggtgagccataatggtgcctctgcactccagcctgggcaacaggatgagaccatttcttaaggggacggaaaaaatcactctggctgtggcagatttccttaggatagattccgagaagtggagttattggggaaaaggctgttaatgattttaagtctttggatacagactgttaagttgctttccaggaagtttctgccaatgatagtgtgatactttctgtgtcctcacaccaccctttgtcaacactgagtgtttttgagggttaattatttctatgagagaagttaaaaaaaaaaaagacaacaaagaaattgcttcaggtggggcatggtggctcacgcctgtaatcccagcactttgggaggctgagatgagagaatcacttaagcctaggaggtggaggttgcagtgagcctagatcgtgccactacactccagcctgggcaacagagtgagactccatttcaataaaataaatcaaatgaatcaaacgtgagcaactctcataacttccaacatttttttcttcttcctgttggtggttctgcctctctggctccattaggatttccctactccatttcagtcatgggagccgagtttctgttcctgaaacacaccaggcctttctggcctctggatttttgtacttgctgttcccgccatctggaatgccttccctgcatttgttcccatcagggttgggactagcaaagtgacaggtgatggagttgctgagggtgcaaaatttaaggaggcacctactcccagggtcatgcaaaagccaactttgcatttgcacaatcctgtgagtgagtccctccttaaatttgaggctgtactgtaatcccagctactcaggaagctggggcaggagaattgcttgaacctgggaggcagaggttgcagtgggccgagatcctgccattgcactccagcctgggcaacagggcgagaatccgtctaaaaaaaaaaatgaggctctaggcaccacatttgccctactctggcccctgccctgattttcctggcctgtctcatctccagacaggtttgctttgacctccctgcccataaaagctggccagtgccctttccaggtactctgtcatataccctatttctttccttggtagtacccagcaccatctgcaagtattgggtttctttgcacatttagcatctgtccaacccttagtatatcagctttgcaagagcaaaggtcacatctatctcagcctacctcctccatactcagcacacagcacagcacctgaccataggaagcactcaagaaatgggaggaatgaaatggaaattatctaaaataaggatcaagattgatacagaagtattcatctcagttttacttattaatagcaaaacaaaaacaaaacacctggaaactatactaatgctcaacaataggaaactgattaggatgcagtacattcagagctgaaattttctgcagccattacaaattatatttgtgaagatttttttttttttttttgagatggagttttgctcttgttgcccaggctggagggcaatgtctcgatctcggctcactgcaacttccgcctcccgggttcaagcgattggtctgtcattttcagaccccacagaaacacaggtgctcctgccaggcccccggggactgcctccaggagtcatttgtaatgacagggtgcgttctgcgcacggtttcagagtctgtccaaagggccaatgctggggctggggcagaaacggtccaaggcctgtgagctgtgcagctttataggcaaatgaagatcgtttacccagaattgcctgctggagagagcatagaggaagtggcggcagcttcaccagttccaggaagcccaggcagcctggtcccccagggtgcacctggcacagcagttcgcacagggccagagagcggcagctgaccgctgcaactacagctggcctgacaccgggcacaggtaccagcccagcccagtcccgcccagcgcagcctgcggcccctagcggagccagcacctggcaaacctgacacccagccttggagcttgggcccccctctgcagctggctggggctcctgagacagcttctttgtcggaatccactcggtacacacacggtccctaacttagtggctgcccagtgaacatggggcttagtagaaccagtaccttcctccctggccccttcaagtctaaatatcccctgctctgagtacaagcttccaccttctccaccgacagacagcccccaccatctccaccgacagacagcccccaccatctccaccgacagacagcccccaccatctccaccgacagacagcccccaccatctccactgacagatagcccccaccatctccactgacagacagcccccaccttctccactgatagacagcccccaccttctccactgatagacagcccccaccttatccactgatagacagcctccaccatctcccgtgtcatcccctggggggacttgtaaaagcagtggtgggggagtgggatggaaacccagagcttctgatcaggcaggtcgggggagagggagacaacacatctgcacagaacaaggtcccagggaggccggcgctgctggtccagggagcaccccccagcacaggcgcgtgcttccctgatggacacgtcaccgccctgggctccagaaaatgaatgtctgacccagtgacccctgtcctcacccaaggccaacctcaccccagaatgggctggaatgctgagcctgcccatgccggctccagatccacccgcctccccaccattgctggccacagagagaggtcaaaatggtccggaaaccccaaggaaaatgaagcagttccagggcagggaagcaaaggcagtgtttccttttttttttgagacgaagtctccctcttgtcgcccaggctggagtgcaatggtgcgatcttggctcactgcaacctccacctcctgagttcaagccattctctcacctctacttcccgagtagctgcagcctctgcctccggggatcaagtgattctcctgcctcctgcctcagcctcctgcctcagtagctgggattaccgacacctgccaccacgcccacctaatttttgtatttttagttgagacaagggttcaccatgttggccgggctggtctcgaactcctgacctcaggcgatccaccaaccttggcctcccaaagtgttgggattaccggagtgagccaccgtgcctggccaggatggtctgcttataatggctcaattttgatgtccagtctctgcagagcacaaggcccccgctttgggccagacatacagatgtccctgggcaagcacagagatgatcccaaggccctggccccacctgtctgctcagtgttgaatcaggtttctgtgaaaacaaattactaacaggctggtgtcacattttcaaattctgtcaccaggccttgaacacatgtctttgtacttttttccatttttaaccggggctgagttacgcccaaccacactgtcctggctggcacgggggaagaggtgtcagctgctgtccagaatggggctgacacattcattttaaacaggccaggaagatgcagatttggcaagctctgaaatttgccgacaccccaagtcgagggtaagcaggagaaccagaaaagggcagcttctcatgtggtcaggttctcctgatgcaagcgtcctggtggatttgggtttcccaagggtcctgactccaggagacccccaggaccgacaggaagggccacccctccctctgaaactctgaagccaggccacccggtgctgaaatgctgtgtgaactcgggaaagttccttcgcagggactgagcctccctttcctgtctccaacagactggaacactgcctcccattgtatgggtgaaatacctcgcggacatgtcttacggcgccccatgaaagcatcaccattaatctgaccagtcaccgcagcattagtatcttcagggcacagatgaagccgtgggcaccagtgataaggagttgccactgctggctaagtgcggagcctcacacatctgtggcccagaaacccacaccccactccaaaccctctatagctccaacagttatgctaacaagaaaaaggagtgaaaacccgctccagttacggtattgtggaggtggaggacacttgtggcagccaatccaacacctccattttatagctggtgtaaacatagttcagaaaggttgtcccacttgctgaaagtcacacagcagttcctgggcggcaaagtgaggacatccaggtctcctaaatctcaccctcgtgctctgcccacttgactgggcttttcaatcctggctgtcaaagagaagcaccaagtccacttgggctcctggccagcatccaggccagtccaactcaacagcaagcggaagcaaataccacacaatgaactcgttgaacagactctgcgctcaggcttaaccagtgcacagcctgcacacccgacaggcggatacagctgttccaagctaaggccagggcctctccccaatcccaatgggctctgcaggtgcagtgatggaagaatccctggtgacagggagcccttagctctgagcaggacctgaagccatctcagggcttgcaccggtccagatgctgctgcacaagtgctacaggggctcctgccctgccctcctcacctgccccctcacctgtcagggatgtttgattcctggctggcccctcccctacctgacccctgccaaagacctacgccaccccaggctcccagctctgaagcaaacgccagagaagtcaagcgcctggctgcgggccacacagcttgagggactcagagctccagggacagtgcccgggccctgctcaggccttctgcagaggctctgggctcttccagttgactcagctcacagggcccctacacggtaccaggtgaagacacagccccaagaactcccaggctctgaagccacacatgtgagctgtgggcagaatcctgcattggcctccagcagctcgagagcacagggacaaagctggactggccccagggtcaccgtggccttggttttgtagcagctgcagtttgagcacgtacaccaaaaataaaattctaagccccctaactgactgaagggacccctcctattggccaaagggatattccaaagttaacctgaaaaacgagctcaggtcatgatgggaagaagggtcacacaggccttgttataccccctccctctggaattcaggtacagctgaccagcactaacattcaaacacagatcttggcctggctcagtgcctcatgcctgtaatctcagcactttgggaggctgaggtgggcagatcacgaggtcaggagttcgagaccaggccgaccgacatggagaaaccccatctctactaaaaatacaaaattagctaggcatggtggtggcaggcacctgcaatcccagctacttgggaggctgaggcaggagaatcgcttgaaccaggttgcagtgagccgagatcatgccactgcactccagcctgggtgacaaaaacaaaacaaaacaaaacacaatattggtctccacaacctcctgtcttacccagatactcctttctattgattccaggtctttagctaataactctttcaaccaattgtgaatcagaaaatcttttgccaggcacggtggcccatgcctgtaatcccagcactttgggaagccaaggtgggcggatcacctgagattaggagttcaaaaccagcctgaccaacatggtgaaacccctgtctctactaaaaacacaaaattagctgggcatggtggtgcatgcctgtagttccagctactcgggaagctaaggcaggagaatcacttgaacccaggaggcggaggttgcagtgaactgagatcacgccactgcactccagcctgagtaacaaaagcatctcaaaaaaaaaaaaaatatatatatatatatatataaagaataaagaaatctttgaacccacttgtgaccaggaagcccatccccaccttggagttgtcccgcctttctcggcagaaccaacaaatacctttcacatactgactgatgtctgcctgtaacttctgtccttgtacaaggtatgaactccagctgtggcccaccccctggggcacatgtcctcagggcctccaggccttggtcctcacatttaactccggataaatctcttcaaatattttacagagtctagctttctcgttaacaagcagctcacacatatagtgtctcagcagtgacagatgctggcccaccccgaggtcaggatgactcagcagggatcgagtttgcgggcgtcacgctccaaggcccggaataggaggttggtgctcattcctcacatagtgggcaaatcctagggcaggggaggggcgggcaatgccagagaatggtccccacctggggcggtctgacggccagggatgcagagaaagagacgcctcccacgctcccggagggcacgagctgtggccaccccggagggtccgccttccagagggagagttcaggatttggccacaatcagggaaggagacgctgcgggggggccctcctgttggaaaagggcagcggcaggaagggggtgctgccacagggcctctggggagcgcgcgggcacacagtaccaatctgcgtgcatacacatgccctgtccctgcagacgggccaggcaaggcctgcccatggccagccatccaggtgatgctccagggagggccaggcctactggggagcagaaccctgtggctgtccaggatacctggatgtgagtctgggaaggatggagaagggtggaggagcgcgaagagcccctaggggttgctggggaacacagatgagcctctgacccacctgtgtccttacctgggccgactgggccacccagtcttgctgacacctccccagacccctggcacccaccagactccccaggcgtggctgtgtgctcccctatgcctgaagacaaacggtggcctcagtgtagaggtgggcactgtggcccctggctcctggcttgctcctgcctcagtttccccagctgtaaattggggattatcactggcttcaaaggctggagtggaaagtggtggccaagaggtgccaagaggtggtgcaagcgtgtgccctaccttggacacccctctccagggggtggctctcaccctggcctgggccctcgggggtctgcacagcccacccttctgtgtgaaggcggctggtacacattcctgggcaagattctgcacattctgctggattatgaaagaggtctgtgacccaaggaaaaagggtcagaagtgcccgttaggctctcctgtgtggctcaggtcatgtgcttctgtgaactcgccctagggccttgccccgaatcccgtgatgcagcgtgacctgcccaggcgctggcggcactttcatgtctggctgggaaagtcggatttcagcactaatcactggctgccgcctgcaatgagcccacggcttgagctctggggcccacccagctccttaaacacgcagaacctttgctagctgagccagggtcccagctgtggggggttggggatggaggggtgcagggatcccaaaacccaacccggggccaggttttacacaggcctggactgagaagtggggctacaggctacaggtgcttgataccccgggggggccctggaacaggcctggactgagaagcggggctacaggttacaggtgctggataccccaggggggtgctggacacaccaggggggcggatagaggcagccaggcagcctgaagaccctggggcaaaacacacacaggccccctctgctctctggtcactgctaactggccaactggcctttgagtccactgaccacagctaagcccacagccatcaaaacccaccccttacacccttcaccctttagggaggggctcagagacagttgtggcgattcctacttccacccacagccccccgaccctgggcctgtgccgagtgtgggtgggtgacatcatcttgcacccagagctccagactaaaggaaaccctggctcctgtctctggctcttccctccctctctttgttcccttgctcctttctttttgccaaaggagaagacagtgaggctgagggctgctcaacatgcacagtgagcaggagatacaagcacgtggagggacggtcacagcccgtgcaactggcaccttcacacacggaggcctgtgattcccagacacctggcgctggggcaaatcccattccacagccagaaacaggctcggcagggccaggtggatttctcaaagccttggttgcttttggcctgacgctagctggacaatgtctcagctcacaggttcctaaacgcacacccgcccacaccaatctgctgaggagtgacagccatggggaggagacccacctcactccagggaccctggcaccgtctcccatgaggccaggtgtcctcagccacccgcagccagagtcccgcgagaccgatggacggcctgcccctgcgtgacggcacgcctgggactgtcccagcaggctcccatgcttcacccaactgggacagggaaacaggagggggctacttctgctttcaaggcatggaggagctgtctgcaggccacttcccgaacacctatgcgcttggggaactgactgagactgagccggggtatcttctccacgatgtggtgagcccatcaggcccttcttctgagagcacctccctggaggtggaagcccctgaggcccacagcatcttctgaacctgtgagttcccacttactgagagctcgcctgggccagtgccagtccacggctgtggccgggactttgagtagatgctaccctacttgctatgcagagccagctggggcccagggaggtcagataaactgcccaaaccaaatccaggcccagccagaatctcaactccagcctttgcgccttctgataaaacccagcattgcttgaatttccagtacacgctgccaagtcttcatcaagcaataaataacccacacaaccctactgtcatgccaagttccatatggccatccagaaagagacacatggagctggttcctctcatctttatgacccgtgaaaagcgcaccaacacgaagacacgcgtgaaaggacctcatctcctaaccagactgacaagcaagggattttttccactcaccgtcagtgggatggttctaagcaccgaggccaacccatttcacacgattatttcacaaaaagaaactttctgtgggacgtgcctgggcgactgaaaagacagccagcaaaactgagaaccttgttcgcaaatccgtaccctctcccaaggcagcctcagaggcccgagggctgaggatccagacccgaaagccactgtaccttctgtaggatcaggctcaaggactaagggggtaaaaggtgccctttcccttcctaagcagaaaattctggaacccaaccttatgtgtgatcatttaaaaaaaaaaaaaatcagctgggtacactggctcacgcctgtaatcccagcactttgggaggccgaggtgggcggatcacctgaggtcaggagttcgagaccagtctggccaacatggagaaaccctgtctctactaaaaaatgcaaaattaaccaggcatggtggtgcatgcctgtaatcccagctactcgggaggctgaggcaggagagtcacttgaacccgggaggcagaggttgcagtgagccgagatcgtgccattgcactccagcctgggcaaaaagagcgaaattccatctcaaaataaataaataaataaataaataaataaataaataaataaaataaatcactttctatggcttttcactgctccaggaacaatgtccacagatcaaacgccgagcctctccttcacaccctggagcgcccatcctgcccactggtccgggctccaggctgccccctgcacctgtcagaagtccccctacaagggcagggtctcccttcctgggacatccactgcccttctccgagctgaagtcagaacgacctgagaatcagcttggagttctaccagactcagccaagcccacctctgcgacagcactcctttcaagggggcaccagctgcagggagtctgtcccttacagacccgtgaccccgtgacagatgaataaagtacagacacacagatattctgctctgccagtccagctgagtgttccagccgcttataggctccctgctgagtcctgtaaacagttgctacttggccctgatcagctagtcagacgcgcatttattcagtatgattaattaacaaaagcttgagtcaacaccattagagtgtaacagacattgtggacttaccgggtaaaaagcatttaagcacccagggtcttaagattatatgagtaaacaagctagctaggtaaactactctgcctttcttttatttctatgtttatttgtttaactaaaggtaaagggatcaggccgccttcagccagagctaattaccaaagttatgccaacttctcggccttccaagatttgtgtctatttctataactacctctaatatctttcccaccagaatgattgaaccccaacacacctccctctctcagcagggtctgcctgttcagagaacacaacttctccttctcgccttacacacaggggcaagaatagattcactcttgcagagagcacatccctttctgttactgaaaatcactttccaaaaaaaaaaaaaaagcaacacatacacacatactcaccacatacacaggtgggtcagagaaaaaaaacaagtacaaatggcttagggacatgagaagtgtggccctaactttcgctgaaagggatcctattaacattaaccctcacctctgggtcagaagggttggcactctagagcctgccttgaggctttacctactgggaccaaaaggactgctggaaagctattttaggccgggtgcggtggctcaagcctgtaatcccagcactttgggaggcagaggcgggtggatcacctgaggtcaggagttcaagacaagcctggccaacatggtgaagtcctgtctctgctaaaaatacaaaaaattagctgggcatggtgggcacctgtagtcccagctacttgggaggctgaggcaggagagtcacttgaacccgggaggtggaggttgtagtgagccgagatcgcgccattgtactccagcctgggtaagagcaaaactccatctcaaacataaaataaaataaaaataaataaataaaaatactttttaaagccctattaccacaaaataaatccaggaacgtgtgacttggtacagcctctttggaaggcacattagctattacattagaatccacaccccgccgggtgcgatggctcatgcctgtaatcctagcaaattgggaggctgaggcacatgcctgtaatctaagctcccggaggttgaggcaggagaattgcttaaaaccaggaagcagaggttgcagtgagcaacgagcctgggcgacagagacagactctgtctcaaaacaaaaacaaaaacaaaaaacaaaaaaccacataaccttttcccatttgcacaaagctgggaaaccccaaatgccctccacaggggtctacggggggtcggggggtgggggcggtgagcacacttgttcctgccgacacagggaagtcttcttagcagctaaagagggcagcctctgcgtactgcctgggaacatggcaaaaccattttaggcttaaaaaaaaggtggagaacaagttgtacattatgatcttttaaataaataggccagcgatatatttgtaacagaagcagctctggaagcgtacactgtcagccacagaaactctggggctggggggtggtaaaggaggagaaatgtgtcacccaggcaggagcttagtggcaccatcttggctcccaagttcaagcagttctcctgcctcagcctccgagtagctgggactacaggtgtgcgccgtcacgcccagctgatttttgctttttttttttgagacagagtttcgccttgttgcccaagctggagtgcagtggtgcgatctcagctcactgcaacctccacctcctgggttctagtgattctcctgccacagcttcccgagtagctgggattacaggcatctgccaccacgcctggctaattttttgtatttttagtagagatggggtttccccatgttggccaggctggtctcgaactcctgacttcaggtgatccgcctgcctcggcctcccaaagtgctgggattacaggcatgagccacagtgcctggctggtttgaatttttaaatgatgatgaattcatgtatgactgatgtgatttttattagaaagagaaaactaggcagcgccccatcctatgtctccttcctggtggccaatgaagcatttcccacaactcactcctggcaccaacaggaagtcagacactcagcacccaggggctgctttttttttttttttttttttttttgagacaggcttgctctgtcacccaggctggagtgcagtggcaggatctcaactcactgcaaactccacgtcccggagcatgcctcagactcataagtagctgggattacaggcgtgagccactatgctcagctaatttttgtatttttagtagagatggggtttcaccatgttggtcaggctggtctcggactcctgacctcggtagatctgcctgtcttggcctcccatagtgctgggattatagacgtgggccatcacacccagccaacagggattcattttttaaaggtaagagtgcaggctgcataagctattatccatgtcgttacataccaggcgggcatgtacctaggcgagagggagactgaaccagtgaaattctaatgacaaaaaaaagaaatcagtcatcccctacattcacatgtccaacgcccagctggaagccacaggctctccccactcctgtcctacgatttttcccggctttgacctgcatggtggtgcggctgctccgctcagagcctcagagaaaccacacagagccctgctgagtcttgccctcggggcattctcacatttatgaagaaatgcctccccctcccccttctccccaaagtacggtgtggcagaaaacagcgccaacaggtcctgccagtcagaagccactcccctgatttcatggctcaagaccccaactataaattaacccttcccaccttgaatgtgtacacacactactgagatccaggccgatccttgccatgggatgaacctgagaattgccaagacccgccttcccacgccacccaaccaaatcatgtggtatctggtacaagtcattttccccctgaaatcccacaagaaaactattttgaggccgggcacggcggctcacgcctgtaatcccagcactttgggaggccgaggcgggcggatcacaaggtcaggagatcgagaccatcctggctaacacggtgaaaccccgtctctactaaaaatacaaaaaaaattagccgggcgtagtggcgggcgcctgtagccccagctactcggaaggctgaggcaggagaatggcgtgaacccgggaggcggggcttgcagtgagccgagatcgcgccactgcactccagccagggcgacagagtgagactccatctcaaaaaaaaaaagaaaagaaaagaaaactattttgaaaagcagttctctctggcctggtgaagaacacaccagcaccatgcccaccaaaataggagccccatggctgtttcccagagtaacctgggacccgaacctccattcactgtaacacagactgaatctgcagccaagctccgctctctcactactgggcaaccctcaggggggatcccttagcctaaaccagcaccagtcactacccgcacacgattttattactactgttttcttatgagtcagcccgtgtcactgattcctgacgagctggtgtggagagcagaaatgaataattttctttttaactgcaatttcgttttcaccaaccagtcagcaatcggagctttaacaataaaccggttgctcagttactccacgtgggtgccacgcaagaggctgggagtattgctcagcggggccaacgggaggctggcacttgcctgaaccgcttaagtgggggaatgaaatgcccaccgaagggcagggcagggaccctgctgtcccgtcactgaagatattcccagcctgtggggagaagtgtaaaagaatgaatgaaagaaacgcacttggtttctgggaccaatgaccttagcctagaactgccgggacggtccaggaacgcaaaaatgtagagatgtgggagccaggggcgtagtgatgcaaggatgcagggacccagggactacgacctcccaacccccggcccgcgccccgtactcacgcacggagtggcaggctacgagcttggctgcctcctcgggcaccgggcaggtggggaagagcggcttgagcaggtaggtggcgaagaccagggccacgatgtactgcgatgaaggccggatgatgagcagctcgatccagagcttgaggaaggcgggcagcgagccgtagacgtccagcatgtaggcgtagtcgccgcccgatttggagatggtggtgcccagctccgcgtagcagagcgcgcccacgatggagaagacgccgcacgcggcccacaccaccagcgccagccccggcgagcctgcctccttgagcacgcccgtgggcgtcacgaagatgcccgagctcatgatggcgaccacgatgacggccacgcccttgagtagcgtgatgttcccctgcagggtcacgccctcgccctcgcctgccggcgccgcgccgtccgcgcgcttggcggccatcatcttctcccgcgcctcttccttctcctcggccaccggggccgctagcgcgcgccgcttcgggcccgcacccgccatgctctgcttaccggccgggcctgggacacccgggagccgcagccgagcgaggattgtgcgcgccgctcgccgcccgccgcccgcagctgcgtcaggaaccccgcccgcgccgccttttaggccccggcccactggccccgcccaccgtccgcggctcctccccgacccgtggcccggccgcggccctcagccccgccccctcgacccagctcggagcacgtgcgtcgtccggcctagcctggcaggcgattcccaggcccgcgtggtcctcgaaggcccccgtactcctgcgccatggagaccccggcctcgcgacctacccccccggcgcccgcgtcatcccagcccgtcctcccgggtgcgcctgggcggggcctggcagtcagggcgagccccttcacccactggcccgcagcctctcgtcaagcctgggagcgggcagtgcaccagggctggcctgaggccaaggatggggtttggggtaccccccgaagggaacctaggctcctgtcccggatgggccgaggggatggaaccgcccccacaaccagctcctggggcacgggggagggatgagaagatgacctgaggggaagctcctgcagcctccttccagcctgggggctgcatcaatgtggctggtgagccgcgaactgagacgagggaagaaccgaaccgaggccacccagtaattcccattgtatcccaaaagaatcttgccaaagatggcgatccggtgcccgtagctttgagaagcagtaataacacaggctttgggaagccagcactctgcctgagctcaatttaatcaacagaaccgggggttcaccgggagccataagacccccacccccaaatctagctgggaaattcaaaggcaggcttcagtgtgaaggggctttaaagcttgttattcctggggaatgcgagaggcatcttagctaaaaagggttgagaggtaatttcagttagaggcgagagcaggatgccaaggctcctaggcctggaaacgggaaggaatataaatactgccccgagattgaccagactggtgagcagccaaagacctgttcaaagggtgtgtgtgggtcagggaggaagctcctcggtatccccccaacccggggttccttggcgtgtgtcctaacgagtacttggaagctcacagcaggcatgtggggaggcctttgttctgggtgagcgttcagcctcccagggcaaacacgcaaacaccggttgcagagctgggtgttcacagcaagacagtctgctgggcagatgcctctggaatccacagaattctgaacaatagccgtggtggagggggggtcagaatccctgtcgtgctgggacctctagctgcagccaggaatgtccaggccccaccccggggaggaggcggctgaggaatgccacggcttgtcattctggaccttgctcgccccccggtatggcaggcattcctctgcagtgataaaaccaagcgaaatctcagcagcccaggcagccaccggcaggggagtgcggaggtcgcacagatactaacttgtaatctgccgtccacgctgcgggctgtggaaggtgcagagagccctccatccaccctattcttcccgctgtgcctgcagagggaaggagacagtaccaccatggctggacaaactcaccgagtgctcactgagtcctcccctagatagcttcttgtgcaatagggtaggtgccagttaggagcaaggttagagattatagggccagattttttgcttaggttcaactacgcaaaataaaaatagactttgcatgcatttcaggcactgggctgacgaccggccaccagggaggctccgccccacttcttagctttggccccaacgttagtcttgttgctgctctcaggcgtgctctgcgtgtgaaagatgacttggaggctgggcgcggtggctcacgcctgtaatgccagccctttgggagaccaaggtgggaaaatctcttgagcccaggagttcaagaccagcctgggcaacatagggagaccccgtctctacaaaaaatacaaaaactagcccagcgtggtggtggtgcacctgtagtcccagctgctggggaggctgaggtagaaggatcacctgagctggggaaggttgaggctgcagtgagctgagatcacgccactgcactccagcctaggcgacagaatgagaccggtcttttttttttttttttttttttttttttgagacggagtctcgctctgttacccaggctggagtgcagtggcgcgatctcggcttactgcaagctccgcctcctgggttcacaccattctcctgcctcagcctcccaagtagctgggactacaggcgctcaccaccatgcccggctaattttttgtatttttagcagagacggggtttcacggtgttagccaggatggtcttgatctcctgaccttgtgatccccccgcctcggcctcccaaagtgctgggattacaggcgtgagccactgcgcccggcgagactggtcttgaaaaaaaaaaaaaagatgacatggaagcaacagtaggagccggggtcagagttcaggcccgtccatccgtggatgatggataaacccagcgtagtccgccatcccttggagagtcattcagctgcacacaggaagacgcgctgcaatgtgcaggacccctgaaaacactgggctgcgtgaaagggtcagtgaccacgggttgtatgattccgagtgcacgaatgttcaggacaggaggatccagagagacggacgagattcgtggctgcttagggcggggggaaggggcgatggagagtgagggctgagtggatggggtctctctttggggtgataaaatgtcttggaactagatgatggggatggttgcccaacactgggagtgacttaaacaccacggatttgtacgtgtttaaatgactaacggttaatgttatgttatgtgtgaactatacatccaaaagataaaagcagttcaggcctagaatcgaacggtcctgggttcagatctcacctctaccacttgctggttaatgtggcaccaggcgagtgactcggctcagctttcaaagtctcagtttcctcttctgtgaagcagggagacacctgcgcccgcctcctggggaccagcaggtagaagaccctgagccgctggcattgccatcactgcagaactgtgctcccagggctggcaggtggaggaccctgagcctctggtgtcatcctcactgcagaactgtgctcccggggctggcgggtggaggaccctgagctgctggtgttgccgtcactgccgaactgtgctcccagggctggccgaatgcctggcttccaccctcagactttctttccaatgtgtgcagagggaacacggagggacagcagttgcagcagcccacacttgctgtgtcgggcatggtctcagtggctggagcgtgaagatggaggcggggatgggagtgggcggctctgagtcaagggacacctggagcccccagaagctggaagaggcaggaggggtcctggagcccccgagggagtctggccctgccaccaccttgatgttggcctctggcctccgggactgtgagagaagaaagggctgttgtcctaagcccctgtttgcagacaaagggaataatctcaacattgaaaaaatatggccttaatctttagtgcgtaggtggcaaacttaccttcaggatggcagagacagatctttttttcctgttgacaggcattttaacatttccagagacacaggagccaggttctcctgcttggcctctgcagtatgagccaaacctgcctattgttaagtgattgaatgagttgatgctcaccttgaactttcttccactctaccctggattacaagaagaattcattgctcagcccacgtcccagcatgaggctggaagcagctgtgaattttgtagagactggagggccctgcactctttgcagctgccagcttcagcgctgctttcttcggctactttgccccgcctctcagttttggggacagtggctgcagggcagatgccattcaaccaggtcaaatttccatgtgaggatggaaatttgtaggttataattcaattctctattttgaaaaatatccaggtggatattgtttaccaccaaaacaatgacttctattgtgtgggcccgaaaaccaggctgatgcatgctacggcatgggtgtgtggtgcctgctccgtgtgtgaaccatgctgctccgtgtgtgaactgtgtctgttccatgtgtgaactgtgtctgttccatgtgtgatccatgctgctccatgtgtgaaccatgtctgttccatgtgtgaactatctgttccatgtgtgaaccatgtctgttccatgtgtgaaccatgtctgttccatgtgtgaaccatgtctgttccatgtgtgattcatgctgctccatatgtgattcatgctgctccatgtgtgatccatgctgttccatgtgtgagccgtgtatgttccatgtgtgatctgtgtctgttccatgtatggtccatgctgttccatgtgtgaactgtgtctgttccatgtgtgaaccatgtctgttccatgtgtgaactatctgttccatgtgtgaactatctgttccatgtgtgaaccatgtctgttccatctgtgaaccatgtatgttccgtgtgtgaaccatgtctgttccatgtgtgattcatgctgctccatatgtgattcatgctgttccatgtgtgagccgtgtatgttccatgtgtgatctgtgtctgttccatgtatggtccatgctgttccatgtgtgaactgtgtctgttccatgtgtgaaccgtgtctgttccacatgtggtccatgctgctccatgtgtgagccatgtctgttccatgtgtgatccatgtctgctccatgtctgatcacacctgctccctgtcactcattttgtctagacttctcaatgatgacagcccccagttaactggatttaaggtagtttctaaacatttgtagccagatccatctagtatcctgcaattcattcattgactcagcaaacatttcacaatagctagacatacgcctggctttgtgagaatgcatgtcctcatgacaccccagcctgcgggtgaccctttcatgtgcacccctgtgataacgtgggatgtgcaggagcctgggtgtggggggaggggatgctgctgcctggggctggcactgacgaaggaggatgagcccaggagagggagcagcgcctggaggcccaggggcagtgcacagcagtccccgagcttacaagtgggagcactgcagcccatggcgcctgaccgcgtttattctgtgccatgggcaagcagaatggttgaggatcccgcccctgggggctcacattccagaggaggatgcaagcatcatgcagcaacacatgcctgatgccaacagctggggaggggacacagggagaccgtggttgggacaagtgtctgaaagctggttgaggatggaaaggagtgactgtgaagcagccgtggggacagcaaccccagccagaggcccacacacacaaggtgacgtggaagagggccaggctgcgaatcttgctgggagaagctcgtgctcgatcccaagcctagtggaaagcctcagttttgaacagggcagcagaatggccaagtgtcggtttctcaaaaaaacccactgttaaaagaaaaagggatttgagggaagaggggaagaggctggaaaggaagtggctaaactggaagcccagcttgtcactcaggctgcagcagaagggacagagaaaagtggacggacttggaataggcagcagtttgagggtcctccagcagagcgtgctgctgccctgggtgcaaggagtgaggggagaggagggcccaagggggctcccgagattgcctgtggcgtcgggtggatggaggaaccatttatcaagacggggttggtgggcacagagttggggatgcagcagtgcatggacagcccacctttcagcaggagggacaagtgtcaaaaaatgacagctccgttactgctgggcaccgctgtgtgccaggtgccatctgggggctcagctcaggctgagggaacaggaggagcaggtgttgagcaggtggtgtggggcgggcggggaagggtgccctcaggtccatcagaacagccacaagagccctggggtgggagggggccgatattctggtcggcacagagtgggctgccaggagagggtgggggcggaggggcaggaatgtggattctgtctcaggggggcaaggctgaggggatgtagctgggcacatggcctgctctgaattgagcttggttctctggagggtcgatgggaaggatgtgctggggatggggaggaagcggaggaggaggaggcggtggcagctgtgaacaggcaatgcttctcacacaggtgtatctttattaaacaagaaaataacataaaagcaaagggaggaagccttgaaccttaaaagctgggccagaaattctacaatacaatcagaagccacaatctggtcacagtgagagcccttcccgcagagccgcagacattggccgctgcccctggggcgggagggaagcctcctgtttgttttttgtcccgttgctttgagggctggaatcaatgtcattttctctcggagtgtttctggtttcatctcagtgtgtccaggctcggatgtcttcctgggagtatctccgtgtctcaggattaacaccagtttttaaaaataactgacaaaggccatttttcaggagacaaagatgttggtgcgtgcagagggccccctgtgttgatatggaaaatgaaggtcagccactccctgcttctcttggtatcttgttggacacgatgtcaatgtggggctggtagaactggagcccagggcccctctggccgcttgggcctttctctgtctccaggtccccatggaaatgggcagcccatggagaatggctgaatagctgctgtctgcccccatcccaagctccaggttcagacaccaccccctccattgactgtgtcaccccttccccaccagaggagcgggctattctcacagcgctgcaggaagcccagccaagtgccttcctctggctgctgcttccatcagcgtgaactgcccggcattgtaggataagttttctcctgggttttaaggttcaggactctctctttgctgcactttttccttgactaattgcacaaataagagaaggcaagagtgaaatgctgcgtatcccttggcctagcgggtcagcgacaactttctcaacttgtcaagtgagcctcagtttccttattaaaaaccagggatgattttgtagaacttgtcgcaactcagtgggagtgccgtggcccttatgcccaatgacaccatcctgtcacttcaggagtttctcataaaacaccattccccagaccaatggcgctgcgagcttctggggcgtgggctgggcccagcatgtcagtgcgacccacagcggggctggagctgctgaatgtgcacaacacacttcaccccgggcctggttcaggagcgggcaaggcagctgtacaccctgtccttcagcaaactcctcttgatcgatggaatcgaagtcaggagcatcaccttagacgcagaacagaaacgtgcccatttcccagcttggtgctttcccacttctactttgactccttcaacccaatcctctttcacccgcatcaccaccaagtgtgatctcctttaaagagccagacactttattttgggggggcatggaggggtggagtctcactctgttgcccaggctagagggcagtggcacaatctcagcttattgcaacctccacctcctgggttcaagcgatttctggctagattttgttttgttttgttttgagacggagtctcgctctgtcacccaggctagagtgcggtggccgccatctcggctcactgcaagctccgtctcccaggttcaagcgattctcctgcctcagcctccacagtagctgggattataggtgcatgccaacacgcccggctaatttttctttgtatttttagaaaagacagggtttcacaatattgcccaggctcgtctcaaactcctgacctcatgatctgcccacctcagccttccaaagtgctgggattacaggcgtgagccaccgtgcctagccttagtttttttttttttttctttttgagatggagtctcactctgttgcccaggctggagtacagtggcacgatctcggctcactgcaacctccacctcctgggttcaagcaattctccctgcctcagtctcccgagtagctgggactacaggtacatgccagcacacccggctagttttttgtacttttagtagagacggggtttcaccgtgttagccaggatggtcttgatctcctgacctcatgatctacctgcctcagccttccaaagtgctgggattacaggcgtgagcctagtttttgtatttttttttttttggaggcggagtctcactctgtcgcccagactggagtgcagtggcacaatcttggctcattgcaacctctgcatcccgggttcaagcaattctcctgcctcagcctcccaagtagctgggattacaggtgcctgccaccatgcccgactaattttttgcgttttttttttttttttagtagagacggggcttcaccatgttgcccaggctggtcttgaactcctgacctcaggtgatctgcccacctcagcctcccaaagtgcggggattacaggcgtgagccaccgcgcctgacctaacctacttattctttatctccccggaatgaaacggcttttatcaccttgggaaacagattagcatctgcttatttttctgtgcttatctgactgtaaggtgacattggaagataatttaattaggttgattgtaaaactttctctcttctgggaggaatattttttaatgctatgaaaataaaaatactgggccaggcacggtggctcatgcctgtaatcccagaactttgggaggccaaggtaggcagatcacctgaggtcaggagttcgagaccagcctgaccaacatggtgaaaccaaatctctactaaaaatgcaaaaaaaaaaaaaaaaaaaaaataggctgggcgcagtggcttgcgtctgtaatcccagtactttgggaggctgaggcgggcggatcacctgaggttgagagttcaagaccagcctgaccaacatggagaaaccccatctctagtaaaaatacaaaattagccaggcgtggtggcccatgcctgtaatctcagctaattgggaggctgaggcaggagaattgcttgaacctgggaggcagaggttgtggtgaaccaagatggcatcaatgcactccagcctaggcgacaagagcaaaactctgtctcaaagaaaaaaaaaaaatttgctgggcatggtggcgggtgcctgtaatccccgctactcgggaggctgaggcaggagaattgcttgaacccgggaggcagaggttgcagtgagctgagatcatgacattgcactccagcctgggtgacagagcgacactccatctaaaaaaaaggaaaagaaaaacactgtactgattttggattttttccaagcaagtaataggtaaaaagaaacccaaactggcttacatgaaagggcacctattggcttgtgtaactgatcaggtgcaaccattgctataagcttgatccagacccgacgcggtgactcatgccagtaatctcagcactttgggaggacgaggcaggcggatcgcctgaggtcgggagatcgagaccagcctgaccaacatggagaaaccccgtctctgctaaaaatacaaaattagccaggcacagtggtgtacgcctgtaatcccagctacttgtgaggctgaggcaggagaatcacctgaacccgggaggtggaggttgcagtgagccaagattgcgccactgcactccagcctgggtgacaaagcaagactccatctcaaaaacaaaacaaaacaaaaaacaacaaaaaaaaagagggtgaaaggcagccccagagtgggagaagagatttgtaaaatggacaaaggccttataattggaatatataaagaactcctaaaaatcactaagaaaaccacagacagcccaagagaaaaatgggcaaatggctcaagtaggtatctggtgaaagaggatatgcagatggccaatgaatctgcacaaagtgctccacatcattaatcattagggaagtgcaaattaaatccacaggagacacctgggcacaccctccagaaagcacacaatgacctgctggcaaggacaggaacgaccactttggaaaactctttggcagcacagccaaactgagcctttccactcgaaaatgccctttgctcagaacccagcagcagctccaaagtctccacccagcctatggggccccagtacccacccttgcctcccatgcctctctcctcacccctgcacttggctgccctcaccctcgggctgcaccttgaacaccagaagggtgctcctgcctccagcctctgcctggaattctctgccctcgggtagccatgtggttcactcctcctttggtctctgcccaaatggcccctgtagaagagacctccccacccagccatgtcctctccctgtgacttaccaccccagactttctgtgttgatgcatcatggtctacctccttccatcagaacgtgagctccgaggcaaaggctcttcagacctgaaacagtctaggctctgtccccagagtctagaatagagcctgccacgtaattggcactcaataaatgttacatgaattaatggaaaccatcctggcacaagtggtagctctctttccacaaaaagaatgagcttgccaagagagagacaacatcacgaaagagagacagaaaagccacactcagacccaacattgagttctggatcaagtctttttttttttttttttttttttgagacaaagttttgctcttgtttcccaggctggaatgcaatggcgcgatctcggctcactacaacctctgcctcgcgggttcaagcaattctcctgcctcagcctcccgagtagctgggattacaggcatgcaccaccaagctcggctaattttgtatttttagtagagatggggtttctccatgttggtcaggctagtctggaacttggcctcccaaagtgctgggtttacaggcgtgagccacagcgcctggctcctatgttattttttaggagctttattgttttacctttcctatttagatctatagtctgtcaggaattaatttttgtgtgtgctgtgaggtaggggtgtgaggtatggtgagaaaaaagattcatggttccccatttggatatcccgttggctcggtggggtggctcatgcctgtaatcccagcactttgggaggtcaaagcaggagaactattggagctcaggggttcaggaccaacctgggcaacatagtgagaccctgtggatcgacagatgaattgatcgatcaatcaatacatagatagataagtatccaaatgatccaaaactattcacagaaaagcccatccattccctacagcatgactcagggatcacaaatgtgtggaaccttctagacatgctattctttttcattggttgatttgtccttctctgacaggtaccacattatcttaattaatatagctttttatttttatttatttatttattttatatggagtctcgctctgtcgcccaggctggagtgcagtggcatgatctcagctcactgcaagttctgcctcccagattcaagcgattctcctgcctcagtctcctgagtagctgggattacaggcatgagccaccgcacctagctaatttttgtatttttagcagagacagggtttcgccatgttggccaggctggtgtcgaacttctgacctcaggtgatcttcccacctcggcctcccaaagtgctgggattacaggcatgagccactgcgcctggcctactatagcttttgaaataggtcttgacatcaaattgtgtatgttttctggttttatcctgccagattacttttggttgtatttttggtagagacggagtttcaccatgttggccaggctggtctcaaacttctgacctcaagtgatccacctgcctcagcctcccaaagtgctgggattacaggcgtgaaccactgtgcctggcctcacaagaattcctttttattttgagacggagttttgctcttgttgcccaggctggagtgcaatagtgcaatcttggctcactgcaacctctgcctcccgggttcaagcaattctcctgcctcagcctcccaagtagctgggattacaggcacgcacccagctaatgtttgtgttttttatagagacaggttttcaccgtgttggccaggatggtctcgatctcctgggtaacaacgcttccttccttcaaagtcagttctgctattcatgtggacctaatgtctctaggatcttgtgccctcattagtggcctggaaggacgcccagaccttccagttcatcaggggttgaagtgggcgatagttgttcaccatcatcttcttctcttcaccaagtgcagaaaacaggagagtacgaaatgcagagagctggaatagagggcagccagggtgagcttggtatgagtgcagggtgagccagcccccgggtgtccctcaggccttgtgtggtctcctcccatgctgaatcaggatggcctgaaatgaccagtaaagatggtggaagtgatggtgtgtgcagggccaggttataaaaggcattgccgcttccgccttggtctttaggatcacttgctctggggggaagctggtcaccatattgggagggtactcaagcagccccgaggagaggcccacagggaaaggagctgaggctcccagccaactgccagcgccaacttgccatccacttgagagggccaaccttggaatgaatcctctagccctagttgagctttcagatcgctacagtcccagctgacactgggctacaattcatgaaagatggtaagccagagccacccaaattcacaacccaaggaaactatgggagataataaatgattggtttttgttgtcgttgttgttgtttgagacagtgtttcgctcttgtttcccaggctggagtgtcattggcaagatctcagctcgctgcaacctccgcctcccaggttcaagcgattctcctgcctcggcctcccgagtaattgggatcacaggcatgagccaccatgcccggctaattttttttttttttttttgagatggaattttgctcctgttgcccagactggagtgcaatggtgtgatctttgctcaccgcaacctccgcctcctgggttcaagggattctcctgcctcagcctcctgagtagctgggcttacaggcatgcaccaccacgcccggctaattttgtatttttagtagagatggggtttctccatgttggtcaggctgctctcaaactcctgacctcaggttatccacctgcctcggcctcccaaagtactgggattataggcgttagccactgtgctcagcctaattttgtatttttagtagagacagggtttcaccatgttggtcaggctggtcttgaactcctgacctcaggcgatccactcgcctcggcccccaaagtgctgggattacaggcatgagctactgcacccggcccaaatgattgttttctaaagccactatgttttggagctatttgttacacagcaatagataactaacacctataatgtaaatgctaaagtaacatttgaatttacttttcactcaaggaactaaaagactactttttatggctggatgcagtgcctcatgcctgtaatcccagcactttgggaggccaaggtgggtgaatcacctgaggtcaggagtttgagaccagcctggccaacatggagaatccccatccctactaaaaatacaaaattagccagatgtggtggctcatgcttgtaatccagctcctcgggagggtgaggcaggagaagcgctttaacctgggaggtggagcttgtggtgagcgagatcacgccattgcactccagcctgggcaacagggaaactctgtctcaaaataaataaataaatgaaaaataaaaaaagactttttatgtattatctcacttgttcacagaatatacttatgaactctgtgaggcaactcacgcatttaattaaattcagaagtgagattatgtctacatgctgacagcatactgggccagttagccctgcatgatgatccagcgccccctagaattgcgcgcgcatggtgcacgtggcctcctgggccatgaccacagtgtgctcatccacatttgtggtctgcacatttgttgactgtctcagaaaggcagcctttctcctcccctggaaaactccccgccttccaggacatgtgcctccctggctcccctgctcaggataaggagctcctgccctgcatttttatatgacaccggccaccctggcttaatactattggcttcgtttctactttcctgccagacagcagtattctgagacgaatgccctgttcctgtgccgcccctccacacctgcccccctcccaccctctcttggtggcacagacccagaatgggcacttgtcacatatatgcttgttgagtagcataagggccttgctgacaaggggccaccttcaacaaaagccttccccatgtccaacagctctggtttggaggtaggcagatattctgcatcccacatctccacgtgcaaatgacatcatgccatggtttgtatataagggaatattttcacaggcccaggagactgaaagaccctctaagagctcacctggagccctcagaaagagatgagccagagatgctaagtcctgctgcgactgctgagaaacgtctgccgggcgggggcggggcataggcagcatgcctgtggctctgaactgccttggacagacagaattgctatagattcttaagatttccagaaaaaaatgatagtataacttttatttattttttattttatttttttgagacagtctcactctgtcgcccaggttggagtgcagtggtgccatctcagctcactgcaacctccgccttccaggttcaagtgattctcctacctcagcctcccaagtagctggcactacaggcacacgccaccatgcctggctaatttttgtatttttatttatttatttatttgagatggagttttgctcttgttgtccaggctggagtgcagtggtgcgatctcggctcactgcagcctccacctcccggcttcaagttattctcttgccccagcttcccaagtagctgatattacaggcgtgcaccaccacgcctggctaattttgtagatttagtagagacggggtttcaccatgttggtcaggctggtctcgaactcctggcctcaagtgatctgcctgtctcagccttctaaagtgctaaaattataggcatgagccatgacgcccagcccaatagtataacttttaaaaatgtatacaaggattattaactaattttcgaaaaaaaaaaaaagcaatgaaactatttagataagaaaaaggaggccgggctcggtggctcatgcctggaatcccagcactttgggaggccaaggtgggcagatcacctgagttcaagaccagcttggccaacatggtgaaaccccgtctctactaaaaatacaaaaattagccaggcgtggtgatgggtgcctgtaatcccagctactcgagaggctgaggcaggagaattgcttgaacccaggaggtggaggtagtagtgagctgagatcgagccactgcactgcagcctgggcgacagagcgagactctgtctcaaaaaaaaaaaaaggaaagaaaagaaaaaggaagaaaacaaaaaccatgcagacccatgacgctgggacaactcccatggatgccttgtgtgtctgtgtgtgatagattagggcgttgctcagaacatgctcgctgtgatcactggaaccgctgtccaatctcaacaagctcctacttcaattggaactttcttcttgtgtaagaacaccccaaatgcatgaaagaatatatataactcctcaaggctcttatgcagcatcttagtgacgctgccaagcaagagagacgccttccatgaagcgccatcatgccagttacgggcacggctcacttggcttggggccacttcaacgggctccttctggatgatccaggtgaccgactcggtcagcggcggggtggtgagcgagcccacataggtccagtaatcccagcaggtgggcagcagagcggaggggtcgaaggggcgcatggccgcctgcgcgtcctgagagaccgagaagcacaggccgtatcagtcctcaggtgggactaggagcttccatcttgtctcagcacgggaggccttcatggtgcttggaaggaagtgctttccccgagataaggccatgaggccactgctgtcacacttggaagcagtgataagaaaatgtgagccttctatacagagcaaggattcctgccaacttacattggtgggaattacattacattacaccagcttatgttggtgcttacatttttccttttgaagtcatttcttggggcgcagtagctcacccctgtaatctcagcactttgggaggccgaggcgggtggatcacttgaggtcaggagttcgagaccagcctggtcaacatgatgaaaccctgtctctactaaaaatacaaaaattatccagatgtggtggtgggcgcctgtagtcccagctactcaggaggctgaggcaagagaattgcttgagcccaggaggcagaggttgcagtgagctgagatcacgccactgcactccagcctgggcaacagagtgagactctgtctcaaataataataataattaataaataaataataaaaaattaaaaagccatttcttttagcataccttggctgcaaaaaatattactttttattgtgataaaatatacataacataaaatttaccgtcttaacctttttttttttttgagatgcagttttgctcttgttgcccaggctggggtgcaatggtgcgatcttggctcactgcaacccttcgcctcccaggctcaagtgattctcctgcctcaacctcctgagtagctgggattacaggcacccgccaccacatctgctaattttgtatttttagtagagacggggtttcttcatgttggtcaggctggttttgaactcccaatctcaggtgattcacctgcctcagcctcccacagcgctgggatgagaggcatgagccaccatgcccggcccatcttaaccattttgaagtgtaaaatttgatggcgttaaatgcagtcacattgtggtgcaaccatctccaccatccgtctccagaacttttccatcatcccaaactcaaattctgtcctgaccccactaaacactatgtccagcttcctcccccaggcctggcacccaccattctgcttccatctctctgaatctgaggactctggggacctgatgtgggtgggatcctgtggtttttgtcttttgtgtctggcttatttcactgggcataatgtccttcaggtttatccacattggagcatgtgtcaggagtccctgcattgttgcttttttttttttttttttgagacagagtctcgctgtgtcacccaggctggcgtgcagtggtgtgatctcggctcactgcaagctccgcctcctggagttcaagaccagcttgaactcctgggttcatgccattatcctgcctcagcctccccagtagctgggactataggcacccgccaccacgctcggcaaattttttgtatttttagtagagacggggtttcaccatgttagacaggatggtctcgatctcctgacctcgtgatccgcccacctcggcctcccaaaatgttgggattacaggcatgagccaccgtgcctggcttgcctggagacatttctactgctaccttaccgatcagggtatccagtatctccgtgattaccttcatctgtccctggaaactgtgcctgccaccctacgctgcagccgtccagggactggcaggcctcggcctaaaggtctggagggtgggcgacctgcaagactcacaagaggggaagccgacagacatacctacagacggagtgctgtgcccctggtgccgataagaaagctgaggctcgggctgggtcagcaaccgaattccagtttagaggcagatttggtcgtggacatggccagccacctccgtaaaattagagaggattattttgcattgaatacactcacagccaaaaaacaaaaaaaaaagagtcagggtcttactttgtcaactaggcaggagtgcaatgatgccatcatagctcactgcagtctctaattcctgggctcaagtgatccccccgcgtcagtctcccaagtagctaggacaccataccagggtttaaaattaattgtttgtagccagggggtcttgccatcttgcccaagctgttctccaactcctgggctccagtgatcctcctgccttggcctctcaaaatattgggattacaggcataagccactgtgcccagccagctcttttggatatatacccagaagtgtgtgattgctgaatcatagggtagttctatttataactttttattttttttatttttttgaggcagagtctcactctgtcttccaggctggagtgccgtggcatgatctcggctcatggtggttgggcctggccgcaacacagccctcatcagcgtcccatgccaaccaagcacaactctgcacctgtccctggccagcactgtgggacaagagtccagtccaaagtgacagagtctctgtctggaaggaagatggcctccctgctcagccacatcacatcaccttgactttgctgggccctggccttccaaggtggaagccagcaacctagatgccttgggcttgtctcctaacatcaagcagtgagggtcagggtcaagagaggcggctgagctaccagaaggaagcccaggagtgtccacgccggcagacacatgcatcagttctgtgcacacgtgttcacgtttataattatccagttaattaaaaaaaaaaaacagcattataggctgggcacagtggctcatgcctgtaattgcagcactttgggaggccaaggcaggcagatcacctgaagtcaggagttcaagaccagcctgaccaacatggcgaaaccccgtctctactaaaaatacaaaaattagccaggcatggtggcaggtgcctgtcatcccagctactcgggagtctgagacacaagaattgctttagcacaggaggcagaggttgcagtgagccaagactgcaccattgcactccagtctgggcaacagagagagactcggtctcaaacaacaacaacagcaacaaaacccacagcattattgtgatagaattcacataccatgcaactctcccatctaaagtgtacaacctggttgggcgcgatggatcatgcctgtaatcccagcactttgggaggccgatgtgggaggactgcttgaggccaggagtttgagaccagcctaagcaacataacaagaatctgactctacaaaaaacacaaaaactagccaggtgcagtggtacatgcctgtggtcccaggtagttgggaggttgaggtgggaggatggcttgagccccggaggttgaggctgcagtgagctgtgatcataccagtgcactctagcctgggtgacagagtgagatcctttcttaaaataagtaaataggccgggcacagtggctcatgcctgtaatcccagcactttgggaggccaaggcgggtggatcacctgaagtcgggagttcgagaccagcctgaccaacatggcgaaactgcgtctctactaaaaatacaaaattggccaggcgtggtggtgcatgcctgtaatcccagctactcgggaggctgaggcaggagaatcgcttgaacctgggaggcagaggttgcagtgagctgagatcatgccattgcactccagcctgggcaacaagagtgaaactccatctcaaaaaaaaaaaaaaaaaaaaaccagaaaaagtaaataaaaattgaagtgtacaattctatggttttgggtatattcacagttgtgcagccatcccaagtcaattttagaacattttcagcacctcaaggaggaagcttggtactttttagctcttctccccacccccgccgtgctgcttctgtctctgtgggtttcataggaactgagtcatgtaacatgtggaacatttgtgtcttgcgtctgtcacttagtacggtgcttttgaggctcacccacaccgcagcgtgagttagagctgtgtcctttctgattgccaagtaatatctcattgcatggtctagctgggttgacatcccattgcacactctagctgggctgtgaaggagcaggctgcttgtgcacatgggtaacagatggatgtacagtgagacgtcagtctgtgcacatgggtaacaggtgggtgcaccgtgaggtgttggtctatgcacatgggtaacaggcgggtgtgcagtgagacgtcagtctgtgcacatgggtaacaggtgggtgcacagtgaggtgttagtctgtgcacatgggtaacaggcgggtgtgcagtgagatgtcagtctggtgcgcgtgggtaacaggcaggtgtgcagtgaggcgtcagtctggtgcacgtgggtaacaagtgggtgtgcagtgaggcgtcagtctgtacacgtgggtaacaggtggatgtgcagtgaggtgtcagtctggtgcacgtgggtaacaggcgggtgtgcagtgagatgtcagtctgtgcacatgggtaacaggtcggtgtgcagtgagacgttggtctgtgcacatgggtaacaggcaggtgtgcagtgagatgtcctctcctcctgccggccacacgtccccgctcccagggcacagatgtgccagtcactttctgagcaactacttcaaatcttcagaacaacccttcaagaagtatttctagtttactgatgaagatagacagacagatataaacaacttgcccaaagccacgttgccagtcagggccactgaggcctggcccgttccaaggtgcgggctcatctctccctccccaggactgcaggaatcagtcgggggagcggcaggccccagccattccactgcgtgcaggtttcctgccaattaagctttccagccttgggctgagaagaggatgcctgtgtgttgcctcatcgtccccaggagttcctgtcctgtctctaagatgcatgagggctggagcagccatgtggttacagaaagctgctccccctcagggcccccagaggaagtcagggcccttcctttatgcgtgtggtgagccccaggcagctagaatgggacaccggtgagcacaccaatgaggctgaagaccatcacatccattatctgagcacggatggcccagctacctgtggaaagcaccacaagcctttgctggcggaagtgggttggtgacttgttccacttttctcttatttatttatttattttgagacggagtttcgctcttgttgcccaggctggagtgcaatggcacgatctcggctcaccacaacctccacctcccgggttcaagcgattctcctgcctcagcctccctagcagctgggattacacgcatgcaccatcacgcctggctaattttgtatttgtaatagagatggggtttctctatgttggtcaggctcgtctcaaactcctgacctcaggtaatccacccgcctcagcctcccacagtgctgggattataggcgtgagccaccgctctgttcctggttttgtcttctttctcttaaacaggaccccgcattttatgagcgtcaagcctcacccagcctaactccgcccttggtttgtcctcttagagtctcagtttccccaggtgtacgacaggcagtgtggtggctgtaatgggcttccatcagtgcctgccacatgggcgtggggctcggtaggtgctgccgctgctgctgccaaagctagaagagcccccacagggcatagagccattccctggatcccctggacctggtgggctgtttccagctccacaaggcagccaattccccggtagccctgactcttgcgaaggcagggaggagggggggccccagcagcctgaggagcttgcagcttgtccaggcatggagggtggggaccctctgtgggcagtttttgccaaaacttctggctatggtgagagggtcaaaggcgaagcctcgaggtctccattctgggagtgtctgcccagggtcaccggggccacactggggctgggcctgcgtgctgggagctgagtgcatagtgacaggtcagcactggtaggggcctgtgcagatgggacggcgctgggggtgggggtgggggtccgggcttccaggcggcgcctaatgtggttttggttatagacactgcctgtgtttccctctaagctgctgaaaagctcagaaatgtgcagcagggcctggagctcagcctgggttctgactgcatgtgggaggtgggcgctgggacgactgggagttcaggctgcatggagccacttcctgggtttaaaaacgggctcttcacctgccacctgtgtgcccgggcaaggccttctctgcctctctgagctttggtttccctgtgtgtgcaagacagatgaatcacaggccctgccccatggagtgattggaagattcagtgtgatgatttatatggagggctgtcgcttctttgaacccttcccaccgaggtgtggggtgatgtcgccttgccctgagcctgggcaggtgctcctggtgggagtggtgaacaggatgccgcaggagcagtgctttgtgactctggaagccagggcagaaaagacatcgtgtccatctggctctttctggaaatgcacccttggagccctgagcactgcatagaagccagctgggtccccagggaatgaccgtggcaggcattcctggagggtctctgccgagtcagtcccacatcagggcccggaccagcctggaactaggagagatgatggggactacgtgactctggtctttcctgccctagttcaggacagcttgttccttaactggaggaaaccaggaaagcagcccagaagctgcagatgagcccatccctgggtgaggactgctgagtccgagggggtgagaggcagagctgggatttgaagccaaggccatctgcccttgagcctgaggccaccacggccccgtcctgccctgcactgcccaccaatcaggagttagattcaaccacacttctagcattttccatcagaaggccatcattctaaagtttcatggactcccaaaaggtaatagctctctctgggaaccagctgactgaaagcacccgcagcaacaaaaagcgactttaaccttagtgattgggctggtggattttcgtttcgtgacaggcagcagcagcctgtgcattccacagcagacgtgtgtgtgtgagtgttggccacagctgggccttaaactcaactgcacatttcaccaagaaccagacatgctccttattccattacatggtgagaatgctgctctagtgtggattttttttttttttggagacggattctcgagctgtcacccagactggagtgcagtggcatgatctcggctcactgcaacctccatctcctgggttcaagcgattctcctgcctcagcctcctgagtagctgggattacaggagtgtgccaccacacccagctaatttttgtatttttagtagagatggggttttgccatgttggccaggctggtcttgaactcctgacctcaggtgatctacccacctcggcctccctaagtgctgggattacaggtgtgagccaccgcgcccgggctactgtggatgtttaacatctccatttcacaggcgaggaagctgaggctcagaggtgcgcagctcaggagtggtggatcagggctctggacccaggagtccaactgtggggctctctgatacactgtgctatgggagaagctcccagaagtcctaggctaggagcctctaggcgagagggttgttcaagtctcttcccattccctgacccgtgaagcatagactcttgcccccaaggctgggtcttttacctcctaaggtctttttttttttttttttttttgagatgagtctcgctgtgtcactcggcctggagtgcagtggcacaatctcagctcactgcaacctccatctcccagattcaagcaattctcccgcctcagcctcccgagtagctgggattacaggcacccgccaccatgcctggctaatttttgtagttttagtagagataggctttcaccatgttggccaggctggtcttgaactcctgacctaaggtggtctgcctgctttggcctcccaaagtgttaggattacaggcttgagccaccgcactcagcctcttaaggtcttttaatttctcaaaggtctaactcggccaggcgcggtggttcacgcctgtaatcccagcaatttgggaggccaaggtgggcggatcacttgaggtcaggagtttgagatcagcctggccaacatggtgaaaccccgtctctactaaaaatacaaaaattagccaggcatggtggtgggcgccggtacttccagctactcaggaggttgaggcaggagaatcaattgaacctggaaggcggaggttgcagtgagccgaggtcgcgccattgcactccagcctgggcaacagagcgagattctatctcaaaaaaaaaaaaaaaaaaagagtctaactctttattttcagctgaggggatgagcccagagatcagcatcaggaccagagctcagtccgcggtggcacttcctcccctgtcccgggcatcattcctcccctgtggtttgcctagaaaattctgacttaccccatggggaagaaatgctccagaaccttccccaggaggaaaacagcccttgggtaaagggtccttcacagccagctcttttctttcccaccaagaggtgggaccacctggtgtggaaggtggaggctggctgggaaaacaacccctccccaggtttcctctggctgtggagccgcgcggaggaagaggatggggcgtcagagctctcagaaccgtggccttgtgaagtttctgagcaggcagatggggcggcggggggtgatctggtcccagtcccaggaggccgccccgaagccagcatcaaggcgaaggccacgtacagatcaaacggctccttgaaccgcgaggaagggcttgccccagctccatctggaccagcccgcaccattgttaacacaggttgaagcctcatccttccgcacatctgaggcttgcgttgactccttctgccctggaattcttttgtttgctgctgaataaataaactacatttctttggaatttctccttctccctcaaagccttttctcagctgatcttggagaaaggcgacactcttgtccccgtcatcttttcgagctgtgctggatgcagggaagcgtatggagagctgggcgctggatgcagggaagcgtgtggagagctgggcgctggatgcagggaagcgtgtggagagctgggccggagagccgcggtttgggcaggtttctctctgcccttgggcttggggtcggacagggacgttcaaggagatgctgggtggtacatgagtcaacattcttaaatgttattagttagggatttgaggtttttgtttcaatctgttttcaaacaaacattatcattagtgaatatcatcacccaggacaaggctaaaaatttttcgagctaatcaatttaaagaaaaatattaagtaggctgggcgcggtgattcacgcctgtaatcccagcaccttgggaggccaaggcgggcggatcacctgaagtccccagtttgagaccagcctggccaacatggtgaaaccccgtctctactaaaaatacaaaaattagctgggtgtggtggcgcacacctattgtcccaactgcatgggaggctgaggcaagagaattgcttgaacccgggaggcggaggttgcagtgagccgagatcgcgccactgcattccagcctgagtgacagagggagactcctcgaaaaaataaaaaagaaaagaaaaatattcagtagaaagttgtcccattggcaggcagatacgtcaaagtcttcaggatcttgcctgcatgactgaattttgggaacttccattgagcccaacacccttattttatggaggaggaaacagggtcccagagcagtggtgacgcattcaaagtcagagagagctagctgtggacacacgagcatcaaccctgcagaatcctgtttccagaactggaatcacagcgcctcggcggggctctttccactatgagatttctttttccttgcaaatgaatcgctgcactaaacaattttgcttgtcaaattatgctgatttctttcttttctttttttttttttttgagataggatttcactcttgtcacccaggctggagtgcaacagcgcaatctcagctcactgcaacctccacctctgggttcaaacgattctcctgcctcagcctcccgagtagctgggattgcaggcatgtgccacgacaccctgctaattttgtatttttagtggaggcgggatttctccatgttggtcaggctggtctcgaactcccgacctcaggtgatccacctgcctcagcctcccaaagtgctgggatcacaggcgtgagcctccgcgcccggcctgctgatttcaaatatgcagcttaccttatgttttacttccagcaagatgtccaccagcctctgcagcatctgatgatgggccccgagctgcgtggcagacacacaaggggttagctgaaaaggcaatgggtggcggggggaagctcactccactgtaaatacaccacgttttaaaagcaatcctaggccaggcacggtggctcacgcctgtgatcccagcactttgggaggccgaggtgggcagatacctaaggtcaggagtttgaaaccagcctggccaatatggtgaaaccctgtctctactaaaaatacaaaaattagctgggtgtggtggcacactcctatagtcccagctactggggaggctgaggcaggagaatcacttgaacccaggaggtggaggttgcaatgagccgagaccacgccactgcactccagcctgtgtgacacagcgagtcctgtctcaaaaaaaaaaagcaatcctaatgatggatcaccactttcttcattagatctacaccccagcaagtgattacctttaaaaacacgcctatcacagaaagcattctctcccacgacagcttccttgtaattttggtatttcacagaattccagtgaactaaatgcagctgaaacacaatggaaagagaacttaaattgatcagcaagaaataagacagtcacttccccttctgaatggctgacctatgtgtccacttaatcataatgaaatggccaggcgtggtggctcacacctgtaatcccagcaccttgggaggccgaggtgggtggatcacgaggtcaggagatcaagaccatcctggctaacatggtgaaaccccgtctctactaaaaatacaaaaaaaaaaaattagccgggcatggtgatgggcgcctgtagtcccagctactcaggaggctgaggcaggagaatggcatgaacccaggaggtagagcttgcagtgagctgagattgtgcctctgcgctccagcctgggtgacagagcgagactccgtctcaaaaaaaaaaaaaaagaactaagttgttgcagccagatgtgtaagatcccagcaccagcagcacctctgagctcccaggcacttgacgaagccatgggaaggaagagcctcagtcttcctggtggtgggaaaaaggagaggatcatgttaacctcatccaatagaaatgggtggtttcattattttctacttcctagttatccttggacaaggattaccagaaaaaactcaggcctcggctgggcgtggtggctcacgcctgtaatcccagcactctgggaggccgaggcgagtggatcacgaggacaggagttcaagacccgcctggccaagatggtgaaaccccgtctctactaaaactacaaaaattagctgggcgcggtggcaggtgcctgtaatcccagctactcaggaggctgaggcaggagaatcacttgaacctgggcagcagaggttgcagtgagccaagatcgcgagatcatgcgatcgcgccactgcactccagcctggggaacagagtgatactcagtctcaaaaataaataaataaataaaatatctgttcatcaaaaacaaagttgcagatagagatactaaaataaaaggcatgttgttaaatgaaaggaagcacacagaagccattgttgtgctcattcttggaactatttataaatatgtgtatgatgatgacaatagatatcactccctatttataaaatgtccagaggtcacctctgggtgtgcgattacaagcaattttcattttttggtttgggtgcactctagttccacattaactgcagcattactttcataacaacaacaagttcaaaaaacagaaagagtcctcaacttgaaaaagcatcaagaagtcaggtgagtgggtgagcagaggtgtgataaagtgaatatggcaaaaatgatcatcacaggactgagacgtcaaactcatagattcttctcgttcatttcttttcattttttcatatgttgcaaaaatttcataataaaatatttggggaaatctataaggcatcacttatcacccaaaaaaactacaaaaaccaattcccagcattgatccgcactcattttctctactgactcccactttggaatgttgaaaataagactgctttaagaagatgatcttggctgggtgcagtggctcacgcctgttatcctagcattttgggaagctgaggtgggtggatcacttgaggtcaggagttcgagactagcctggccaacatggcaaaaccacatctctactaaaaatacaaaaattagcagggcctggtggcacgcacctgtaatcccagctactcggaaggctgaggcaggagaatcgcttgagcctgggagacggaggttgtggtgagccaagattgcaccaatgcactccagtctgggtgacagagtgaaccctgtttcaaaaaaacaaaaaacaaacaaacaaaagaagatgatctctattgcaaagatgttcagcttctcagcggagggccttgtggatttgctagtccctacagctgcaagcacacagctgagtgaagcgtggcaaagagctcaagctctgactttgaatcccagctgtctggctttggcaagttccgtaaccattcagaacctcagtctcttcttccgttaaatgagagaacttaaagtgccttcttcgtaggagaggagtgtgactaaacgggtggggcggccgacggttctggtttgagcactgacagtcccaggccccaggaaatccttcacatctgagcggcaggcatggcttgttcgccccccaccatagagccggagacatggaaagcgtccagatatgtgccgttaggccacgtctacaaacctctgcggggtacacgtggccgtccactgtgtgctctgagcccccctcattcactgctccccagtggaagtgaaattgcttcagtctgtagtggttttccaagggcccgccactaattcctggaaataaaggcagcgagacgtgtgtgtcattttgtctgtttgttgagctgtggtgttacctgaggcattgtctacattagggttatatgagttcactcgcaaggggttgctgtatggttgaagtgacaagccaaaggtgggctccgtgaaaggtgggctctgtctgtcccattcactctgccccccgccagcccagcgcctgcccagaggttcacagtaaatgtggaatgaaggcagggtcccagtgctgccactgggtggtggtgagggcctcatctccctgcaggcagaaatcgataaagaaagtttctgagatgcctgcctgtcctataagatttccagactttaatttaaaaaaaaaagatgtcttccaaatattttttaaaagcagcttaaatcctatcaccaaataacattataaaataacacaatgagcaaagtttttgttttgttttattttaagacagaatcttactctatcgcccaggctggagtacaatggcatgatctcagctcactgcaacctccacctctgggttctagcgattctcctgccccagcctcctgagtagctgggattacaggcatgtgccaccaggccaagccaatttttgtattttaagtagagacagggtttcaccatgttggccaggctggtctcaaactcctgatctcaggtgatccactcgcctctgcctcccaaagtgctgggatgacaggtgtgagccaccgctcctgggtgagcaaggtttttaaataagcagaccctgagctatagcatcagtcctgatctctggcagtccctgcttaatctaggcccaccacagggccagcttttattggaacactccttccgtcctaagtcaccctaaacactcgccttggagtcagcgctctccacctgcaggacttggggtgcccctctccatggcacagtgccaggtgcagcctcccaggagcttccttctcctgacacgtggggctcagccataagcatcgctcactgaggcctctggctctgcctcacagagtcatggctgccatccccaggtccaggtagtgctgggagtctgccttttaacgagctccccaggggttctgatgtgggtggcttctcctgtgtctaagcactttgtcactaacagatttccatcaacagctgctacaaatgtggtacctattccacacgttttcattgaaaggagcacagtgtgctcctgggatggctgggcaaggctggaaggcgccagcagaactggagcactgatcacgaattcgcggtggcccgagtgcctcccgtagctgtggaggagcctcgtgtcacccgccttgctcatgtcacctcccgctgtggcaaaagccaggaaagcactgagcgcatgacgaatgccttggggagcttgacactgctgactcctggtggtttcctgacaccaaaagtacttgggctgggcgtggtggctcacacctgtagtcctagcactttgggaggccgagacgggtggatcacttgaggtcaggagttagagaccagcctggccaacgtggtgaaacccatctctactaaaaatacaaaaattagctgggtgtggtggcgggcgcctgtactcccagctactcaggaggctgaggcaggagaattgcttgaacctgggaggtggaggttgcagtgagctgagaacgtgccactgcactccagcctgggcgacagagtgagactcagtctcaaaaaaaaaaaaaaaaaagtactcatagttggaggcaccaaggtgtaaactggaaaatggaaaatggatttggctttggtccagtcaggggctaggcaagtgctggaccaagccacagagctgctcactgcccctcttcactcaaaatctcagtgttggtctggagcaacctcggagtcatatgtagttttaaaattctaccattatgagcaagtcttctattctccttaaatatacacagatgaattacatctcaatttttaaaaatacacagaaagagtgcttcacacaatcagcacataaaatcactttgttaggccaggcacagtggctcacgcctgtaatcctagcactttgggaggccaaggcagttgtatcacttgagatcaggtgttcaaaaccagcctggccaacatgctaaaaccttgtctttactaaaaatacaaaaaattagccaggtgtgttggtgggtgcctgtaatcccagctacttgggaggctgaggcaggagaatcgcttgaacctgggaggtggaggttgcagtgagccgagatcgtgccaatgcactccagcctgggcgatagagcgagactctgtctcaaaaacaaaacacaggcgtgagccactgtgcctggcctccaaaacacaatgtaaggaacttacagaaccacaaaatgcaagcacggtgagctctgtgctcgcttcgcctcggcctgtgtccgtggtagaaagggggtttgcagcctaccagccccagcggcatcaaagtgcattgatgggtggctgagggtggagcctgccagggggtctgcctctcgctcttgggatgggctcactcatgataagtttactgtgtggaaattcatgcatgtctgtatcatctcttctagaatagaaatgcctagaaggcagggatgatggatgcttcatggacaagttagactggacccagcctggtagatgtcatttgtaagactgagttaagtcccatccagttgcactcttaggacagaggctgtttctgggctgggcatggtggctcacgcctgtaatcccagcactttgggaggccaaggtgggaggatcacccaaggtcaggaattcaagaccagcctgaccaacatggtcaaatcccacctctactaaaaatacaaaaaattagccacgtgtggtggcaggtgcctgtaatcccagctacttgggaggctgaggcaggagaattgcttgaacctggtaggcggaggttaaagtgagccaagatcgcgccactgcactccagcctgggcaacaagagcgaaactcagtctcaaaaaaaaccaaaaacaaacaaacaaaaatggctgtttccgtctggaccatcactgtatcaacacgacttagtgcaggaaggggtcattgaaggcacacaacgaaccctcacgggatgaatgaatacaggaatgaatgggattagtcagttcattgatttattcatcgaatcactcggtcggtaagcagctctgtgtgttacagtggaatcgagcctttcccacggcagtttgggaaccgcctgggatttctaggaaagtccacagaacacagaaatagttaaagacctggatttgcaactcagctctgcttctaacttgctgtgtgaccctgggcaagtagcttagcctctctgagcctaagcctctctacctgttaaacgagaagagcgggaaggataaatggagacaaggcaggaggcattttgtaaagtgttgtctgatgatggcagtggtggtgattgtgcatcgcacaccattcaggggctccgcagcttcatctgtgtaaagagagttactacacgtttctcctggtcccagctcaagcactctagggttctacgtaggcacataaatagggttccaaagagcgacgccaactgcataaggcataagtccactgacagccgatgcctgccagacccccacccacaaaacctagtagaaaagtcaccctccagaatgtggccaaccaacaagggccaggaacaggagctgctgggaccagaagggacttgtgagccctgagcctctgcagggtaaggtgctgtgctaactctggggctagaagactttcccaagggtttccagcagggctggagcccacaggcatctcttcacctttcccgaccccgagctgtcccagaattcttcttcttctttttttttttttttttttttgagacggagtttcactctgtcgcccaggctggaatgcagtggcgtgatctcagctcactgcaacctccgcctcccgggttcaagagattctcctgcctcagcctcccaagtagctggtactacaggtgggcaccaccacacccggctatttttttttttttttgtatttttagtaaagacggggtttcaccatgttggccaggatgatctcgatctcctgacctcatgatccgccccccttggcttcccaaagtgctgggattacaggcgtgagccaccgtacccagcctgtcacagaattctttactgcggcagcctctgatgggctggatcctccgcctctctactcattggagtaagagacaagtcagccctttccaatctgcctcctgaggggaaccatggggccctcgggacatgcggcccctcctcaggctggctcggggcatctgcacccctgtacctgagcaagggacttgcttgaaacggcggccaccctgggctggggaccaagcacgctcaggggaaaacccaaaaaggctactgtgtctcactggctctatgatacgcaaatgaggagggaagcgaaacgttcgttcttctaagagggtaactgcaaaggaagtctgggccgctgcgttttcgggaacagcaggtgcggtggccgatggataactcgggctgggctggagcggcccctggtggcagttcggtgaagaggcacccggaacctggcaacgtggcccgcgcggggcgcacgcatatcaggaagacacagaggcctttttactgaaaatgccagcgggtgcggattccacaggctcctcttcagcatcagtctagtgtgggattcatacaccttgagcctctttcaaggtgaaacagagaatctcactgaaaactttaaatcccactgtaaattccaaaattagacctgcgccgcgaagaccgcccaccagcaaaatgccaagcgtatttctttaaaaactggaaagccgtgtttcgctgctcttcctgtagacaatacagcatgggggcaggagtggggtctggagtcggacgcacgttcagaggctggggtcacttctcccaaaccgtgtgcagtcggacgcacgttcagaagctggggccgccactcccaaactgtgtgctctaggtccagcttttgcacccctcctagcctcagtttccccatctgtaaagtggggatgatccttgaacccccaccataggactgctgttacgattaagtcacatgggaaatacgaagtccttagcacaacgcttgacataaaggaagcactctaaaacaaacaaacaaacaaacaaaaaacaacgaactggaagccactgaagccttcatggggtgaaacagctgattaaggggcaaaggctctcgctggccaggttctggcgtgtcccgggcaccacgcatcctgtccatgagctcacgtcgttgtcgtgatggagaaggcttggtgcataccagagtgcggcggaggagctggccttcactgggcacctgctacctgctgggcattgcgaggtaactttatgttcctcccaggatgaactcctcacaatggccctacagagcaggtcctgtgagtccaactttgagatgaggaaattgagacgcagagaggttcggtcacctgccccattttagccggcaacctcacccaggtctgacggtccaggccctcagcttttgtagtagggttcaggccaaactctgctacttgccttgccagtaaagttagggacccaatttaaggctgcagacctggataaaataatctcaaagtgacttcttttttttttaggtggagtctcactctgtcacccaggctggagtgcggtagggtgctctcggctcactgcaacctctgcctcccaggttccagtgattctcctgcctcagcctcctgagttgctgggactacagacaagtgttaccacaccccactaaattttgtttttgtttttgtttctttgagatggagccttgctctgtcacctgggctggagtgcaatggccagatcttggctcactgcaacctccacctcctgagctcaagcgattctctcacctctgcttcccgagtagctgggattataagcacccaccagcatgcccagctaatttttgtatttttagtagaggcagggtttcaccatgttggccaggctggccttgaactcttgacctcaggggatctgctgcttcagcctcccaaaatgctgggattacaagcataagccactgtgccaagcctaaagtgacttttcgtaatgacaatacaatgtcaggatattctccttaatcaaaaaaaaaaaaaaaaaggcaagcccaattcacgaaaaggggtctttaagctgccagcccccatcccccagactctgctatcggcagggctggtccaccgggcagcactggccactgttgcctcagcgttctgtgcaagcaggtgcgtcagaaccggctcatggagatataattgaacgattgcctcagcgcgtgccagactctccaaacataataacagatgacgtttggggtcggctccaggcggtgacgtgctggccccagagaatattgtctctgctattacaacagatgctgttaatagctatctatttgtagttcggggcttttaccaagatgagcaggcttttggcaggcacgggttgtttgaaggcttaaaattagtacaagagaagtttgagatgttctaattactggaaatttcaaataacacgatgccgcaagggaccggtctgcttccggtgccactctcgggggtaatgcacgttcccaagctgtaaatggggaaggctgagggcttctgtgtgccacctccccaggcaggcaggggccgcagccactgcaagcccctgcccacagaactcggcgatgacggaacctagactgctccctggaagttagcctctgagaccatcacatattggcactggtttgaaagccaggcaaatgtgggctccaatcctggcttcacacggtggggctttgcaagttgttttataggtctgtggcccagactagacatttgtaaaaggataatgatgcctatggcaaggattgagtactgtgatgcttacaaagtacctccctaacagtccctggcatgcagtgagagctcaaataatggtagccacttactattattatgactggtgttattgttattattaaaattactgtcatcgcccaggcacggtggctcacacctgtaatcccagcactttgggaggctgaggcgggcagatcacttgaggtcagacgtttgagaccagcctgggcaacatggtgaaacccggtctctactaaaaatacaaaaattagccgggggtggtggcacgcgactgtagtcccaactacttgggaggcggaggtgagagaatcgcttgaagccgggaggtgtggaggttgcgtcactgcactccagcctgggcgacagagggagactccatctcaataaataaataaacaataaaataaaataaaattgctatcatcactggcatcgtcatcatctcactacagcagagatccgcagttccccgaaacaaataccacgagtctcaaggtaagacctgcacgtaaggatgtcgaaagataaatatgtcttaagaacatgtccatgagaaggggctttgccagccatgcaagcataaaagaagaaaagtccctcattcatccaaaaacacccgctgagtttctcccgcgtgccgggcaccacgctcagtacgggggacagagggaggaggctctaggctctgacttgcccttgcagagcttggaatccaggagtgtcagacggtggtagagataaaaagctgtgtgtctgagaggtgagggcgtgggctttggggccctaaacttgcttgggacgcccgggagggcccccgtggaagcggcgtttcagtggagccctgaagatgggtttctatttgtcaggtgaagataatggcagctccaggcagaaagggacgaccagcggaaaggaccctggtgagagcagccaccacgacggaacaggcagaagcaccagctggcaaaggcactgtcaggggcagcgggagatgggattggaagggcaacagggttggcgcccgtggtggcaaaaggaaggggggccttcgccaacaaaccccaacagggttttttttttttttttttttttttgagacagagtcttgctctgtcacccaggctggatgcagtggtacaatcttggctcactgcagcctctgcctcctaggttcaagctattctcctgcctcagcctcctgtagctgggattacaggcacgcaccaccacaactggctaatttttgtatatttagtagagacagggtttcaccatgttggccagtctggtctcaaactcctgacctcaggtgatccacctgcctcggcctcccaaagtgctggaattataggcgtgagccaccacaacctggggaggtcaatgctgcagtgagctgtgacgcagcactgtagtccagcctgggtgacacagtgagatcttgtctcaaaaaaaaaagtattcagcaaaatatatatttgaaataaatttcatacctacgagtaagttttctaatatccaattattattttactgttaacatgctcagaactgtatagctcaggggtatgattcttcccactgacattttcaaaagatggtttatgattccttgatacagttacagaaatgttggttctgcagggaagattattttactacattttatagatttatttatttaatagtgacccaaagatatactatccagcagccagtgaatgtaatggttaagtttgttgttaatggagatctataactggggtaattaattgggcaagaaaaccaacatatgatctcttctagttatctgggataaggtacttcatgtagtaaagttagaaatgggttgtcttaattgttttatacatccaactcatattaaaatttgtgcctgggtgcagtggctcatgcctgtaattccagcactttgggaggcctaggcgggcagatgacttgagcccaggagtttgagaccagcctgggcaacatggtgagaccccatctctacaaaaatacaaaaattagccaggtgcagtggcgcccgcctgtagtcccagctactcaggaggctgaggctggaaaatcacgagcccaggaagcagaggttgcgatgagtcaagatcatgtcactgtgcccaggctgggtgacagtgagaccttgtctcaaaaaaaaaaaaaaaaaaaaaaaacttgcaacacaagtccacattttgcacaaagaagaaacaatgacaatgaagttctagtatatgaaaggaaaagggctattccttccactcagcccactaagcatgcttgcattctttcttcagcaaacatttttgagtgcctactggtattagcactgagctgggaactgggatacaaagagtcctaatatatatatatatatatatatattttaagagacttgcggtattgcccaggctgggatgcactggcatgacatgatcatacctcactgcagtctcttgggctcaagcgatcctcccacttcagtctcccaggtagctaggacacgggtgcataccaccatgcctggctaatttttttttttttttcagatggagtctcactctgtcactcaggctggagtgcagtggcgtgaccttggctcactgcaacctccacctcctgggttcaagaaattctcctgcctcagcctcctgagtagctgggattacaggtgtgtgccaccacgcccagctaatttttgtattttttgtagagacaggatctcaccatgttgcccaggctggtcttgaactcctgggctcaagtcatccaccagcctcagcctcccaaagtgctgggattataggcatgaggcaccccacccagctcttaaaactaattttaaaactgctttttgaaaacaagtgctttccatatttactaaagcaacaacctggaaattctcaggcaagaactggctcctgcttgtttaatgacctcttttcatattaggactaaattggtggttttatgccatgttaaagattaggctacttagggagaaacgagctaatcttatgtattatacttggggctggtggactttgttctttcaaagtatcaattctgtatcatactcttgattctgctgtagctctgaaatgctccattgtaagtttcttattctttttctttgtttgttttttctttttaaaggcatggcctcactgtgttgcccaggctagagtgcagtgtcagatcatagctcactgcagccatgacttccggggctcaagcaatcctctcctctcagcctactgagtagctgggactatgggaacatgccaccatttccagctaattattattattattattttttggtagagacaggtctcactatgttgcccaggctggtctgaaactcgtgggtttaagcaatcctccctccttggcctcccaaagtgttgggattgtaggcgtgaaccactatgcccagctgtaaatttttgtattaatgtttttccatattattgacctataaagccattgaagcatagtgccttgaaaggaaagcaaaaaagtaaaaataataataatttaaaaaaccctcctctgaattgctcatgtagcctactattgggtcaactagaagagtgagaaatagccagcagttagaacattccacatattctgagtgtcaaattttattactttggtgagacatgacttcccgctttcagcactatgggttttttgtttgtttgttttcaagatgaagtcttgctctgtcacccaggctggagtgcagtggcgcgatgttggctcactgcaacctctgcctcccaggttcaagtgattctcctgcctcagcctcctgagtaacagggattacaggcgcataccaccacacccagctaatttttgtattttagtcgagaccgggtttcaccatgttggccaggctggtctcgaactcctaacctcaagtgatctgcctgcttcggcctcccaaagtgctgggattataggtgttagccactgtgcccggccagcactatgtattttagaagacaatattaaaaaacatgcacaaattacaactccaaaaaattgtgtacatataatcgtattcatttgttaggattgctgaaatgaacattgggataatcactgtgtctttgacaaggttctttaaattaagtccagttgctaactgtaatgaacatgagtacttgtggcattctaaattattaaaaatatttggcccaaaagattatggctcatgcctgtaatcccagcactttgggaggctgaggcaggagtgtcgcttgagcccaggggtttgagaccagcctgggaaacattttttgtagaaacaaggtctcacagttgcccaggcaggtcttgaactattagatacttgatgggatttgtcagaggcgatcccttccagttgagagtgtcttaactcatttctactaaaagcatatgaccatcttcttagaaactgaggtttttccttctgataaatttgtattagagacaccattttatttatttttattttattttatttttgagacagagtctcgctgtttcacccaggctggagtgcagtggtgtgatctcagctcgctgcagcctctgcctcctgggttcaagtgattctcctgcctcagcctcccaagtagctgggactacatgcatgagccttaatgcccagctaatttttttttttttgtacttttagtagagacagagtttcaccatgttggccaggctggtctcaaactcccgacctcaagtaatatgcctgccttggcctcccaaagtgctgggattacaggcatgagccaccgcgcactgccaccattttatcttgaagagatttttagttcatatctaagtaaaaaatcctcagctccaaactcactagctgtgtaactttggccaatttaattaacctgtctaagcctcagtgtcttcttcaggggtgttgtgaaattagtagcaatgagggaaatgttccaacagggtgctatggattaaattttgtcttccccaaattcatatgttgaagccttaaaccctaaagagatgctgttttgagatgaggcctttggaggtgattaggtttagttgaggtgatgagggtgggcctgcatgatgggattagtgtcctcataagaagagacatgaggctgagcacagtggctcatgcctgtaatcccagtgctttggaaggctgaggcgggtgggtcacaaggtcaggagatggagaccatcctggccaacatggtgaaaccctgtatctactaaaagtacaaaaattatctgggcgtggtggggtgtgcctgtagtcccagctactcagcaggctgaggcaggagaatatcttgaacccgggaggtggaggttgcagtgagctgagatcgcaccactgcactccagcctgagggacagagcgagactctgtctcaaaaaaaaaaaaaagaagagacatgagagagctccctttctctctctttctccccccattccccttccttctccctctccctccttctccctccctctcccttatcctcttccctccttttctctctcccatacaagaagctagtttcctgtctacaagccaggtagacagtcttcactagaatccaaccatgctggcaccctgatctcagacttcccagccttcataactgtgagaaataaatgtctgttgtttaagccacctaggccgggtcttggggctcacaatataatcctggcggtttggaaggccaaggtgggaggaggctgaagcccagagttcaagacccgcctgggcaacggtgagaccttgtttctacaaaaaaaagtttaaaaaaattagctgggcttggtggtgtgttcttgtagtcctagctgtttgggaggctgagatggaaggctcacttgagtctgggagattgaggctacagtgagctatgattggtctactgcactctagcctgggtgacagagcaaggccctcttaataaataaatatataaatagctacccaacctgtactatgatattttgttatggcagcccaagctaagacatagagccaggcaaatagtaagccttcgatgcatctcacaccattattcttaaaagggacatgtcaggctgagcccagaaaggagaaattccctctctattcttgaagtagcaacagtttatagggactcaagttttcttttcacgaattcgaaagaaactatacggacacattcaccttactgaggtttctctggccttgtccattctgagctcctgttttttctgcagaggtgctcattgatactgacttggtgatcttgaaaggattctctgtatttctctttttttaaatagagatagggtcagtcttgccatgtttaccaggctggtctgaaactcttggcctcaagtgatccacctgcctcagcctcccaaagtgttgggattacaggtatggaccactgcgctgggccagggttgtctgtttttatatgaatgaccataaagttatttcactgatgccatcaggaagcaaccttattaattttatgtatttttgagctgatgttgatagcagaagagtggaaaggagtcagactttgctttagtctcgtgatgtagaagatcctaaagataggattcaaggtgagagtatgatcatttatatggccctcttcacctcacagagctgaatttaccaataatttggcaggtataagctaggaaaatgaagtaaaagggtccagacagtaatattttagaattctgttacctgcgggtggatactttcttcttttgagaatagaagattaggctgggtgcagtggctcatgcctgtaatcccagcaccttagaaggctgaggcaggcagatcacttgagtctaggagtttgagaccagcctgggcatcatagcaagaccccgtctctactaaaaatacaaaaaaaaaaaagtagctggctgtggtggtgtgtgcctgtaataccaactactcaggaggctgaggtaagagaatcacttgaacccaggaggtggaggttgcagtgagccaagattgtgccactgcactccagcctgagtgacagagcaagactctgtcagaaaaaagaaagaaaagagagagagagaaaggaagaggggaagggaaggaagggaaggaaggaagagagagaggaaggaaggaagagagagagaggaaggaaggaaggaaaaggaaggaaggaagggaacagaagattagttgagcatagtggctcagtgcctgtaatcccagcactttgggaggccgaggtaggcagatcatttgagcctaggagttcaagaccagcctgggaaacatggcaaaatcccatctctacaaaaaatagaaaaattagctgggcattgtggcatgcatctgtagtcccagctacttgtggggctgatgcaggagggtcacttgagcccaggaggcagaggttgcagtgaagtatgattatgccactgcactccagcctaggtggcagagtgagactctgtctcaaaaaaaaaaaaaaaaaaaagaagattgtgagcaaaaattgaatgcaatttttttcataagcagaggtgtaatggttattattacaaaagatgatattaaatttatttatgtattatctctttgcctccaccagaatgtaagctttgttgaaggcaaggatcattgttgatttatttactctgtatcccaggcatctaaaacagtaagtgtgcaataaatatttgttgaatgaatcaaagcataagcaaggcttcagattcatttttctatcagagattcatttaaaaatgttaaggaaatgagaggtgaagacatcctaaaggcataatactcaaagtagtcagtaggttcattgataacccagaggaaaatatataatattatagaggaaaagaaattctctgaaatcatggcatctctcctagcttgggataacattttagcagaaagaccgaagaactcttccaagaaacatcaagcaattaaatgaagtagtagaaaaatcaccagtactttaaagtagatgaagccattaaaatagttgcagcttcagtaatcaccatgtaagcctgtaagtggtgggtcttagaccacaacatggtagttatcaaattgctttattcatcgaaatgttcattctcctggctgcccttgaacttccagcctaaggctttctctctgcagggttgtcagcatgctcatgcaaggctttgcctctgcagattatcagaggtgtactccatgcccctctcaccatgaaaaaagggagaaaaagacaatttcgtctcagagatagaaaatctcccagagagaacccctggcagctggaatccatttttttccccctgaagctggaatctgttataactacagaacactgaaggataatgaggttctgctgctaagcaaatgctgggacaaaaagcacagaggtgctgcagccaggcagagactgggcttttcatgaaaccctgtgtctctgagcacatattgcaataattctctgactagctgctcaaggccttggcttcgtggctttttactccgtttaaaggtcttgatcaggccacttccgtttttaatgtttgagaaatgtctgatttatgctgcttcaaagtggaacttgggtttctattacctttttggcaccttgcacccattgttggcctaattctgctgtctcgtctatcttgtggttcctatcagtaaacaaagtccaggagaggcgtcatgcttgtgaacacctccaacatcaagttcaaaagtacaatcatgaccttgtcctgtcgttctcagaatctgggctcagctatttcaaacctcccatgtcttcactggtagtggtcaattagaaatcactgaatcctttccctagagtggtcagagacagccagtttatggtaatttgggcacaagtgccaattggaaaggtgcattattcaaaccactttggctacaagtgacagaaattcaatgcaggttagcttaaataaaaaaggaattcgggctgggaacagtggctcatgcctataatcccagcattttgggaggccgaggcgggtggatcacctaaggtcagaagttctaaaccagcccgggcaacacggtgaaaccctgcctgtactataaatacaaaaaattagccaggcatggtagtgcacgcctgtagtcccagctactctggaggctgaggcagaagaatcacttgaacccgggaggtggaagttgcagtgagccaagatcacgccactgtactccagcctgggcgacagtgagactctgtctcaaaaaaaaagaaaaaaagaaaaaaaagggaatttattggcttctgtagctgaaaagtcaggcagatttggatctcaaattatgtcattaactagtttctctgacttaccctctgcgttgtgtataagcttttcatcgcatggcagcaagatacctccatgttcacatagggctaacagcccaagatggtgaggaaacatgcacttttgttccagtagcacagaaaaagtccccaggtggacgctaatgggcactgtatgagtcaagtgctcatggctgaggcagtagttgtaccttgacacatgaagtcctctgaccagatctgggcatgtacctgaccttggggatggaagtgaggcagtccagctccaccaactcgtaaggactgagacagtttactagggaagaggggaaagcgtgtttcttacaggaagaaatgcgggcagacaaaacaccatataccccttaaattaggttttccacagataattgaggtggagcagaagggtaaccacattttgacagcatcatcagtatgtggtgagtggcccagcatttgaccctggcctctgtggtcatctcagagcccagaaagtagcagcagaagagcagagcatgggtaggtaaccatcagttcttggataactgaagggtgatcttgaggagcagtgagtctgtgggatggccatgcctaacaaatgtcatccagttcagagcaccaaggacattcccagctatggcttttatcttttatcttcttcttcttctggttttgctctgtcacccaggctggagtgtagtggcatgatctcggctcactgcaacctctgcctcccaggttcaagcaatcctcccacctcagccccctgcgtagctgggactgcagctgagcgccactacacccagctaatttttgtatgttttgtagagatggggtttcaccatgttgatcatgctggtcttgaagtcctaggctcaagcaatctgcctgccttgggctcccacaatgttgggattacaggcataagccaccatgcctggctccagctgtggcttttagaggaggaggtagtggtggccggaggttttgcacatgattctaggcagaaccctcctagttaatgcctacttgtcctttagaactcagctcaaatatttcctctggggagcattctctggcctccacttgcccagcatgagccagaccctctaacaatgagctctcatttaataccttgtttttctatcatagcactttctacagtcatcttatataatcatgtgtaaatcaaacttatgactatttaaataagacctatctcgcacactaggaggtaggtaggctccatgaagatagagactttagcagtttcacctaccattgaatacccagtatttagtccagtgcctagcacattaataatcacatgggacctattttttttagatgaataagttatatacagaggttctggtaatagccattggttctagtatgaaaatgtaacaaactgcctcctcttcttctatcatatagtttgactttttcacatctttcctcaattggtagaattaataaggtgctattttagataacccatgtcaccaaaaagaagctgcagactggacaatcagcctctaagtaatcaagggcccccttttactgtgcatgatttaaatgaaaaatacaatctatctggaatgtaactgagaaccataggaatctttgggcttcgtgaaagttcttagcagaaaatcaggccatgtcacttctgaataatattattaaccctggtttcctcttgtaacctctaagtgtgttgaatggaagtaagtttagtactagaaaggaatgcacagatcctaccactttgtttaaaacctgttggatgggccagatgcagtgactcacccctgtcatcccagcactttgagacgcgaaggcgggggaattgcttgaggccacaagtttgagaccagcctgggcaacatagcgagaccctgtctctacaaaaaataaaaaaattagctgggtgtggtggcacgtgcctgtagtcctagctatttgggaggctaaggtgggaggatcactggagcccaggagttcaaggctgcagtgagccatgattgtgccactgcactccagcctgggcaacagagaaagactcagactctaaaaaaaaaataaaaacctgttggatggtaatttcaagataaattattacaagtacacacatgtacgtgcctatcctttgtgcctttgtccccatccttggtcctctgttgtagctgttgcatttttcaccaggcattgtgatcacaggttgacatgtcagcttcctctggtatgagcaactggaaggtaggggtgactcagctatccataatttgaaagaatcaaaactgtttgataaaatatcttacttttttttttctttttgagactgagtcttactctgtcacccaggctagagtgcagtggcacaatcttggctcactgcaatctccacctcctgggttcaagcaattcttctgcctcagcctctggagtagctgggattacaggtggctgccaccacacccggctaatttttatatttttagtagagacggggttttaccatgttggccaggctggtctcgaactcctgacctcaagtgatccatccgccttggcctcccaaagtgttgggattacaggcatgagccactgtgcctggccaaaatctcttactttttaaatggtttcatagataaaacttttccgaatcctttgttaaacaaatttgaattaataagaagccattggagaaactatgttctctatcttctttcccccctagtgcagttttagatcttcatgatgctatgtttagtttgatttgcctggtcccactgggcattgcaataattcatattctggcgtggagcccattttcagtcagaaacaagacagactacatggggactcttcaaggccaacaccggctgttatgggattcaaacaaaacttcaagtgtttgttcttatagagtttacatcgtaccagaaggcaaaactgttcattttaacctctaatttgtttagaaaacaaagcaaataaaacaaaaaagaaatcctacaagttttagagctttttgactctaaattagaaagttaaatatcaggtgtaaggcctgtccgttggctatttccaagcagtcttgtagcttggacacagctgtaactcttcatcaatgaatttccatatgtggattggtttgggtttcccagagcccactgggaaaaccaaccacatgggctgtgcatgccacttccttttattttatttatttttttattatttatttattttgagacagagtttcactcttgtggcccaggctggagtacaatggcgagatcttgtctcacttcaacctccgcctcccaggttcaagcaattctcctgtctcagcctcccgagtagctgggattacaggtgccggccactacgcctggctaatttttgtattcttagtagagacggggtttcaccatgttggccaggctggttttgaactcctgacctcaggtgatccacccaccttggcctctcaaagtgctgggattacaggcatgagccactgcacccaccctattttttatttttttgagaaagagtcttgctctgtcacccaggctagagtgcagtggcacaatcttggctcaccgcaacctctgcctcccaggttgaagcagttttcatgcctcagcctcccgagtagctgggaccacaggggtgtgccaccacaactggctaattttttaaaattattcttctatttttaaaatttttattttattaatttatttttcagagacaaggtctcgtgctgttgcccaggctggagtgcagtggtgcgatcacagctcactgcagcctcaatttcccgggttcaagagatcctcccacctcagcatcacaaagtgctggcattataggcatgagccaccatgcccagccccttttattttttaaacctcatgttgcttctctgaccaattttattagtgagacaacagttttttgtttttcattaatgctgcatcatcatcatctgtagattcacctgtgattttatagcggagaaggtcaccacacaacgtgatttcaaaataaattataaactattgtaatcaagacagcatcgtgctgacataaaaacagaccagtgggctgggtgctgtggttcacacctataatcccaacactttgggaggccgaggtgggtggatcacctgaggtcaggagtttgagaccagcctggccaacgtggtgaaaccccatctctaataaacatacaaaaaattagccaggtgtggtggtgcatgcctgtaatcccagctactggggaggccgaggcaggagaattgcttgaacctgggagatggaggttgcagtgagcagagatcatgccattgcactccagcctgggcaacaagagcaaaaacgccatctcaaaaaaacaaaaacaaaaacaaaaatgaaaaacaaacaacaacaacaacaacaacaacaaaaccccagaccaatggaataggatagaaagcccagaaaaaaacacaggcatttacagtcaattgattttcaacaaaggtgtcatgaacacacaacagggaaaggacagtctcttcaataaatggtgacgggaaaactggatatccacatccagaatgaaattggaccctttggccaggcacagtggctcatgcctgtaatcctaacactttgggaggctgaggcgggcagatcatgaggtcaagagatcgagagcatcctggccaacatggtgaaacctcgtctctactaacaatacaaaaattagccgggcgtggtggtgcatgtttgtagtcccagctactcgggaggctgaggcaggagaatcacttgaacccaggaggcagaggttgcagtgagccaagatcacgctactgcactccagcctggtgacagagggagactctgtctcaaaaacaaacaaacaaacaaaaaaaccccagaaattaaacccttagctctcaccgtatataaaaatcaactcaaaatgaagtaacaacttaaacataaagcctgaaactgtaaaactgccagaaaaaaacaaaagagaaagctgcagaacattggtctggtcaattatttcttgggtaggactccaaaagcataagcagctaaagcaaaaatagacaaaagagattaggtcaaactaaagagcttctgcacagcaaaggaaataattaacaaagtgaagagacaatccacagagtagggtaaaatatttgcaaactatatatctgacaaggggctaatatccacaatatataaggaactcaaaagaactcaatagtgagaaaacatgactaaaaaatgagcaaaggatgtgaacagattttctatttctcaacagaagacatatgaatggccaacagatatatgaaaaaaatgttccacatcgctaattatcaaggaaatacaaattaaaaccacaatggaggccaggtgtggtggctcatgcctataatcccagcactttggtaggctgagggcaggcggatcaactgaggtcaggagttctagaccagcctggccaatgtggtgaaacccccgtgtctactaaaaatataaaaattagccaggcgtggtggcgggcacctgtaatcccagctattcaggaggctgaggcaggagaattgcttgaacccgggaggtggaggttgcatgagccgagatcatgccattgtactccagcctgggtgacagagaaagactccatctcaaaaataaataaataaataaataaataaataaataaataaataaataagtccacaatgaggtatcacgtcacacctattagaacggctattttggctgggcgcagtggctcacgcctgtaatcccaacactttgggaggccaaggcaggcggatcatgaggtcaggagattgagaccatcctggccaacatagtgaaaccctgtctctactaaaatacaaaaaattagctgggtgtagtggcagatgctgtaatcccagctactcaggaggctgaggcagaggaatcgcttgaactaaggaggcagagattgcagtgagccaagctcatgccactgcactccagcctaggtggcagagcaagactccgtcttaaaaagaaatggctattatcaaaaaagtaagaggtcagcatggtgcctacgcctgtaatttcagcactggaaggctgaggtgggcaaatctgcttgaggccaggaggtcaagaccagcctgggcaaaattactaaacccagtctctacaaaaagaaataataatacaaaaaattggccaggcatggtggtccatgcctgtagtcccagctactcaagagggtgagtgggaggatcacccaaacccaggagttcgaggctgcagtgagttgtgatcaagccactgtgctctagcctgggccacagagtgagacttctaccatggtcagtttcaagatatcaatgtgatatcactgaacacaaatttggaaattgatgagtagtcacataccattataaagtatttccaccacgctgtctcaaaagaaaaaaaaaatgacaggccaggcgcggtggcccatgtctataatcccagcactttgggaggccaaggtgggtagatcacttgaggtcaggagttcaagaccagcctggctcacacctgtaatcccagcattttgggaggccaaggtgggaggatcacttgaactcaggagttcaagatctcagcctgggcaacatggtgaaactccatctgtacaaaaaatacaaaaattggccaggcacggttggtcatgcctgcaatcctagcactttgggaggccaaggtaggtggattgcctgagctcgggagttcaaaaccagcctgggcaacagcgcgaaacttcatctctggtaaaaacacaaaaaattagccaggcgtggtggtgggcacctgtaatcccagttactcaggaggctgaggcagaagaatcgcttgaacctgggaggcagaggttgcggtgagccaagatcgtgccattgcactctagcctgggcaacaagagtgaaactccaactcaaaaaaaaaaaaaaaaaaattagccgggcatggtagtgcacatctgtagtcccagctactctggaggctgaggcaggaggattacttgaacccaggagaccgaggttgcagtgattggagatcacgccactgcaccctagcctgggcaagtgagactccgtctcaaaaaaaaagaaaaaaaagaaaaagatcagatttgggaaattcaagaccagaattagagaataacccagatttatatggcacactcttagggtcaagaaaagggaattcaatttcagtgattttaaagaggttttttggaagtatatagtaggcaaactcataggcatccaggaacaggaaatcatggttaagctatacaaagactggagtgggaaagcagggactgaggtgacttttgctgtttctgacacctctgcttcatttctctgtctctctttttcttcttctcccatttttttttctttttttttttttttgatagagtctcactctattgcccaggctggatgaagtggcataatctaggctcaatgcaacctctgcctcctgggttcaagccattctcccaccttagcctcccaagtagctgggatacatgtgtgcaattgaccacatccagctaattcttttgtatctttagtagagatggggcttcaccatgctggccaggctggtctcgaactcctggcctcgaatgatccacccacctcaccctcccaaagtgttgggattacaggcatgagccactgcacctggccccttcccccaccccaccaacacacgagttcagtcgcccaccttcatctaactgattcagattctctgtgcctgttcagattttcttagccaagagtgatcatcagctcagatggacatgtgtagacattggtgtgctggaaatgcttaaaactgactcttcgaaaaaaaaatattatgcattctatacatatgtaacttactataaattttacgaatcaacagagtcacaaaatccagactgaataaatgcttgattactattcaagttactcctgtcattgaccaaggagtgtagttccaacctaaatgttgttttatatttttgtttatcttaatgagtaagacaaaagtgaaacaatgaagacccacttcagaacttcacttggtcactagtgatgtgagcaacttctttgctgaattaaatgataggttttgaatactgggaagaatatttccttaattagttgtgcatttgcagtgtaatggctaaagaaatgacagttttgggttcagtctttacaagcatcttttttactactttcttaagtctagacccggggtaggcaaactatagcctgtgggccaaatccaacccatggcctgtttttttgtacagcctgagatctaaccaccaaagaagcagagactgtacatggctcacaaagcctaaaatattatctggctctttatagaaaaggtttgctgacccccttgttcagtcaattaataaaccaacacaataatttatactgatttccattgtataaatacttctaccatggccagtttcaagatatcaatgtgatatcactgaacacaaatttggaaattgatgaacagtcacataccattataaaatatttccaccaggctgggcatggtggctcatgcttgtaatcaaggagttcaagaccagcctgggcagcgtagtgagaactctacaaataaatacataaataaaaattagcggggtgtggtggcatgcatctgtaggcccagctacttgggaggctgaggcaggaggattgcttgagtcaggagttcaaagttgcagtgagctgtgatcacaccactgcacgtcaacatatatatatcagatattaataacctttaagagcataaataggccaggcacagtggctcatgcctgtctataatcccagcactttgggaggccgaggcgggtggatcacttgaggtcaggagttcaagatcagcctgacctatatggtgaaacctcatctctatttaaaaaaatacaaacattagccaggtgttgtggcgggtgcctgtaatctcagctacttgggaggctgaagcaggagaatcacttggacccgggaggcggcgggtgcaatgagccaagatcgcaccactgcactctagccagggtaacagagcaagactccgtctcaaaaaaaaaaaaaaaaaagatatagacatgttggctgggcgtgatatctcacgcctgtaatcccagcactttgggaagccaaggtgggtgaatcatttgaggtcaggagttccagaccagcctggccaacatagtgaaacccccatctctactaaaaatacaaaaattagccaggggtggtggcaggcacctgtagtaccagctacttgggaggctgaggcaggagagttgtttcaacccaggaggtagaagttgcagtaaaccaagagtgtgccactgcactccagcctgggtgacagagcaagactccatctcaaaaaaaaaaagaaaaaagaaaaaaaaaagaaaaatatagacatgttatcaggcacagtggctcatacctgtaatcccagcacttagggaggcggaggtgagaggattacttgagcccaggggttggagacctgcctgggcaacatagcaggaccctgttctcccaaaaggaaaataaataaataaataaataaataaataaataaataaataaagatatagacatgttaaaagtaaaaagacttaggttgggtccagtggctaatgcctgcaatcccagcactttgggaggccgaggtgggcagatcacttgaggtcaggagtttgagaccagcctggccaacatggtaaaacctcatctctactaaaaatacaaaaactagccgggtatgatagcaggctgctgtaatcccagctacttgggaggctgaggcaggagaattgcttgaacctgggaggcagaggtgcagtgagccgagattgcgccactgaactccagcctgggcaatagagtgagactcagtctcaaaaaaaaaaaaaagtgaaaagactttaaaaaaataacaggcaaggtcgggcacggtggctcacgcctgtaatcccagcactttgggaagccgaggcgggcctatcacaaggtcaggagtttgagaccagcctggccaattggtgaaaccccctctctaataaaaatacaaaaattagctgggcactgtggcaggcgcctatagtcccagctactccagaggctgaggtgggagaatctcttggacctgggaggcagaggttgcagcgagccgagatcatgccattgcactccagcctagcgacagagcgacactctgtctaaaaaaaacaaaaacagaaacaaacaaaaaacaggcaaacgcactaagcaaagttgcagtaactgtattcatagtagacaaagtagacttcagaagaaggaatgttatcaatgataaagaggaagaccatattatgaaaaatgggtcaattaatcaagaagataaaataatcctaaacatgtatgtgcataacaacagagcttcaaaattcatgaagcaaaagctgatagaagagaatggagaaatagacaaatccacaattacaggtggagatttcaatacttctcttttagaaattaacagaaaacactgggcagggtggctcacatctgtaatcccagcactttgggaggccgaggtgggatgatagtgtgagctcaagagttagagaccagctagggcaacatagtgagatcctgtctctactaaaaacaacaacaacagcaacaacaaattagtcagacatggtggcatgtgcctatagtcccagctacttgggaggctgaggcaagagaatcatttgagcccaggaggttgaggctgcagtaagcagtgatcatgtcactgcactccaacctgggcaacagagcaagaccctgtctcaaaaaaaaaaaaagaaaaaaccccacaaagacaaaacaccaaaatcaaacaaacaaaaaaataaatcaacggaacaagtagagagaaaaccaataagtatatagaagatgtaagcaatactctaacaaaacttggaccaattgacatttatagaacacactgcccaaccacaagagaatacatgttctttttcagtcaaatggaacatttaccaagatagaccatcttctgggaaataaagcaaaccataacaaatgtaaaagaatagtaaccatataaagtatctcctttgatcacgatggaattgaattagaaaccaataagaaatatacttgggaaattctcaaatatctagaagttttaatatacacttagaaataactcataaatcaaagaggaactcacaaaggaaattagaaaatgttttgaattgaacagaagtaaaaacttctgttcaaaattcatgggatgtaacaaaaacagtgcacagagggaaatgtttggcataaaatgctaatattagaaaagggtcttggccaggtgcagtggctcatgcctgtaatcctagcactttgggaggccgaggcaggaggatcacttgagcccaggagtttgagaccagcttgggaaacatggcgaaaccacatctctacaaaaaatacaaaaattagccggacatggcggtgtgtgcctgtagtctcagctacttgggagactgaggtgggaggaccacctgagcccgggaaggtcaaggctgcagtgagctgtgatcatgccactgcattgcagcctaggtgacaggcaagaccctgtgtgaaaaaagaaaaagaagaagcaaaacaagaagaaaggggctcaaatcaatgatctgtgcttttattaagaagttagaaaaatgagaaaaagagcaaatcaaacccaatttaaacagaaggaggaaataataagatcagaaaccaataacatttaaaaaacaaaatcaattatgccaaaactgtttctttgaaaacaccaataaaagcgataaacgtcttgctagactagtcaagaaaaaaagaagacatgaatttccagtatcagaaatgaaaaacaaggcatcagtccagattctgcagatatataaaggataatacggaaatattatgaaatctttatatcaataaatctgacaacttagatcttttccaagaaaactccagacccagatggttttactggtaaattctaccaaatatttaagaaagaaataataccaatttaacacaaactctttcagaagattgaagagaacacttcctagttcatcttatcagtattaccctgatactttaatcaaagacataagaaaacatagaccagtattcttcatgaatatagatacaaaagtcttcaacagaatatcagcaaatctaatctagctaatatgaaaaggaaaataaatacaactaaatggggctaattgtggaatgcagtgttgattcaacactcaatgttgaaatcaatcagtgtaatttaccatatcaacagaaaaagaataaaagccccatgaccatcttacgtgatgtaggaaaagcatttgatgaaatgcaacatccactcacgctaaaaactgtcagcccactaagagtagaagtgcaattcctcaacctgacaaagtcctctacgaaaaaatgtgtggctgatatcctgcagaggtgatattactgaatgcttctgtcctaagattgggaaaaaggcaaggatgtttgttttttctacttctattacaaattatactggagatcctagccagtaaaataagacaagaaaaatagattaaaggcatacaaattggaaaggaagaaataaaactctattaggaaatgtttagcaaagtcacaagatacaaggtcaatatataaaaatcaattgtatttctatatactgggaatgaacaactggaaatttatattcgttatttatttatttgagacggagttttgctcttgttgcacaggcaatgtctgtctgggcaattgtcgtgcaatggcgtgatctcggctcactgcaacctctgcctcccgggttcgagtgattctcctgcctcagcctcccaagtagctgggattataggcatgtgccaccacacccagctaatttgtatttttagtagagatggggtttctctatattgatcaggctggtctcgaactccctacctcaggtgatctgcctgccgagacagtatcttgctctgctactcaggctggaatgcagtggtgcaatcatagctcactgcagcctcaatctcctgggctcaagtaatcctcccacctcagcctcgtgagtagctgggattacaggtgcatgccaccatgcccagctaattaaaaaaaaattttttttttgtagaaatggagtctcactatgttgcccaggctggtctcaaactccttgcctctggccaggcgcggtggctcatacctgtaatcccaacactttgggaggccgaggtgggcagatcatctgagaccagtggctcaagaccagcctggccaacatggtgaaactctgtctctactaaaaatacaaaaaaattagcagggagtgttggtgcacgcctgtagtcccagctactcaggaggctgaggcagaattgcttgaacctaggagactaaggctgcagtgagccgagatcatcccactgcaccccggcctgggccacagagagagacttagtccctgctccaagaaaagaacaaaaatgaatctcaacccataccttgcaccaatggattttagacctaaatgtaatatttaaaaccatacatcttttagaataaaacataggaaaaaatctttgtgactctggaatgagaaaattttcttaaatatgatacccaattgcaaatcataagtgaaaaaattagtaagtttgatttcaaaatttaaaacctctgatctttgagagacatggttaagaaaatgaaaaatgtgaaccacagactggaagaaaatatttacaaaacaaaatgcctattcgataaaaacttctatgtagaatatgtgaagaactgtcacaattcaattataaaatgacaatcaacctaacttaaaaaatggtggtctgggcacagtggctcttgcctgtagtcccagtactttgggaggctgaggtgggaggatcacttgaggctcagagttcaagaccagcctgggcaatgtagggagacatcatctctacaaaaaattaacaattagctaggtattgtggcatacacctgtaatcccagtgactcaggacgctgaagtgggaggactacctgagcccaggagttcaaggttgcagtgagctatgatgatcatgtcacagaactccagcctgggtgacagaggaagatctagtcaaaaaaataataataataaaaataaaggcaaagtttgtaattaggctttgtttccctacccaaatctcatcttgaattgtaatccccataatccccatgtgtcaagggcagactaggtggaggtatttggatcatgaggacagtttcccctatacggttctcatgatagtgagtgagtctcaggagatccgctggttttataaccatctggcattccctgtgcttgcactcactccatcctgctgccctgtgaagaaggtgcctacttctcctttgccttctgccatgattgtaagtttcctaaggcctccccagcaatgtggaactgtgagtcaattaaactttttcctttataagtgacccagtctcgggtatttcttcatagcagtgtgagacccaactaatacagtttgtattccatggatgacttgaaaaaacaaaataaaaatgggcaaagatttgaacagacacttcaccaaagaagatatacaaatggaaagtaagtccatgaaaagatgctcaacattattggtcattaggaaaatgtaaattaaagccctaatgagtcacccgtacataacaattagaatagctaaaataaaaactgaataccaagtgctgacaaaggatgtggagcatccagaactctcatacattcttggtaggaattaaaatgatacatctactttaaaaaacagtttggcagtttcttttaaagttaaatatacagctgacatatgatccagaaatcccactgctagcttttttcccaagagaaacaaaaacttatggccgggcgtggtggctcacgcctgtattcccatttgagatcagcctggccaacacggtgaaaccctgtctctactcaaaatacaaaaattagccaggcctggtggcgcatgcctgtagtcccagctactagggaggctgaggcaggagaacagcttgaacctgcgaggcagaggttgcagtgagccgagatcgtgccactgcactccagcctgggtgacagagcgagtctccgtctcaaaaacaaacaaacaaactaactaactaacaaaaacaaatggaacagaatagagagtccagacatatatgaaaaattaatatgaaatgtgactttcttttaggttatctcaacatattatttaaaaataattatttttgggaggctgaggtgagcagaccacgagttcaagagatcaagaccatcctggccaacatggtgaaaccccgtctctactaaaaaatacaaaaattagctgggcgtggtggtgcatgcccagctactctggaggctgacgcaggagaatcgcttgaacccgggaggtggaggttgcagtgagctgagattgcgccactgcactccagcctggcaacagagtgagactctgtctctaaataaataaataaatatctcattaaaaataattttaagacgtttaaggccaggcgcggtggctcacgcctgtaatcccagcactttgggaggctgaggtgggtggatcacgaggtcaggagatcgagaccatcctggctagcacggtgaaaccccgtctctaccaaaaatacaaaaaaattagccgggcgtggcagcgggggcctgtagtcccagctactcgggaggctgaggcaggagaatggcgtgaacctgggaggcggaacttgtagtgagccgagattgcgccactgcactccagcctgggcgacagagctagactccgtctcaaaaaataaatatataaaaaattaaaaaaaagacgtttaagtactttttaattatataaattacatattacttttgctgaagattctgaatcagtatacctgggatagccaaggaagctgcattttaaccagcaccacaggtgatcctgacgctagtgatctgaggcctgttttgaaaaacactaatgcgctggccaacatggtgaaatcccgtctctactaaaaatacaaaaattagctgggtatggtcgcgagcgcctgtaatcccagctacttgggaggctgaggcaggagaatcacttgaacccaggaggcagacgttgcagtgaaccgagattgtgccactgtactccagcctgggtgacaagagctaaactgcatttcaaaccaaaccaaacgaaaccaaaccaaaaaaaccactaaggcggctgggcacaagaagaattgtcttgggccgcacatagaatacactaacacttgctgggcatggtgactcacgcctgtaatcccagcactttgggaggccaaggtgggcggatcacccgaggtcgggagttcgagaccagcctgaccaacatggagaaaccgcgtctctactaaaaatacaaaattagccaggcatggtggtgcatccctgtagtcccagctactcgggaggctgaggcaggagaattgcttgaacccaggaggcggagtttgtggtgagctgagatcacatcattgcactccagcctgggcaacaagagcgaaactccatctccaaaacaaaacaaaacaaaacaaaaacctctaagatcagacgcaatggctcatgcctgtaatcctgatactttgggagactgaggcaaaaggatcccttgaggccaggagtttcagatcagcctgggcaacgaggcaagaccatctctgcaaaaatatctttttttttttttttgagatggagtttcactcttgttgctcagggtggagtgcaatggcacaatcttggctcactgcaacctccacctcctgggttcaaccaattctcctgcctcagcctcctgagtagctgggattacaggcacgcacgtgccaacacgcctggctaattttttgtatttttagtagagacggggtttcaccatgttggccaggctcgaactcctgacctcaggttatccacccgcctcggcctcccaaagtgctgggattacaggggtgagccactgtgcccggcttgcaaaaaaaaattttacaaaagtaaataaacactaggaggcggtaaagcattgtggtgaagaatgagggttctgcaacccgactgcctagtttaaaatcctgcttcggccaggcacggtgctgtaattccagcactttgggaggctgaggtggaaagatcacttgagcccaggaattcgagaccagtctgtgcaatgtagcaaaacccggtctctacaaaaaatacaaaaattagttgggcatgcctgggtatgggtgcgtgcctgacgtcccagctgctcaggaggctgaggtgggaagatcacttgagcccgggaggtagtggttgcagggaacagagatcatgccactgcactccagcctgggtgacaaagaccctgtctcacaaaaaaaaaaaaaaattcctgcctcaaccacttatttatttattcactgtaaaagcaatggaagctttctctgccttagattattttctataaaaagctggtaataatagtatccacctcatttgattgttaggaggattaaaagagatggcagaccaggcgtgctggctcacgcctgtaatcccagcactttgtgaggccaaggcaggtggatcacttgaggtcaggagtttgagaccagcctggccaacatggtgaacccccgtctctgctaaaaatgcaaaagttaaccaagcgtggtggtgcacgcctataatcccagctacccaggaggctgaggcaggagaatcgcttgaaccctggaggcggaggaggttgcatgagctgagatcgagccattgcactgcggcctgggtgacaaagtgagactctgtctcaaaaaaaaaaaaaaaaaagatggcatatggaaagcactagcacaatgtctggcgcttagtggtgctgtcactgttctaagtgacatgcggtacccttgcagtgctgttgtaggaggctttctttcatggagagtaggctgtggcccagatctagaatgtcatggagtaaaaatatatctatttccatttcatttctagagttgtttttttttttccctcccaggtacttcacagtagaccgggcaagccttacagtatgaaacagagcaggtgtgtgtgtgtgtgtgtgtgtgtgtgtgtgtgtgtgtgtgtgtgatgaacatacaggggtaagaaaggcaaggatttttatttcaggtcataagaaggtgataatttgtcaagcacatagttctcaaaggaaaagatcatctccctttataaacattgtcacaggtatggtactatttataataaattcttgttttacggaggattatggaactctgaatttgtgagacttggttttttaaagaaaacaaagaaaattataccacttctgttgcattactaagtacagatgtatttatattagaatttggaaaaaattcacataattcataattcaccaaagaaagtaagcaggtgatggtccatacctttacgcatgggtggtcttgattgattagtatttatttatttacttactttctttttattttttgagacagagcttcgctctctcacccagactggagtgcagtggcatgatctcagctcactgcaaactccccttctgggttcaagcgattctcctgcctcagcctcccgagtagctgggactacaggtgcgtaccaccacacccggttaatatttgtatttttagtagaaacagggtttcgccatgttggccaggctggtctcgaactcctgacctcaagtgatccacccacctcggcctcccaaagtgctgggattgtaggcgtgagccaccacttctggccaattgattactatttttaaagacaaggtagttgggattatgtgatttttccaaaatcacgtggaaagtgtaaaggaaatactagaatgtgggcttcctgcctcttgatataaatcaagcatgtccaacccatggcctgtgggccacatgcggcccgggatggctttgaatgcagccccacacaaatttgtaatcttaaaacttcatgagattttggcccggcgaggtggctcacacctgtaatcctagcactttgggagggcgaggtgggcagatcacctgaggtcaggagttccaactcctgaccaatatggcaaaaccccgtctctactaaaaatgcagtgcatggtggtaacgtgcctgtaatcccagctactcgggaggttgaggcaggagaatcacttaagcctgggaggcggagggcagaagttgcagtgagccctgattgtgccactgcactccgcctgggcaattgtctcaaaactgtctcaaaacaaacaaaaccacattatgagtcttttgcattttttttttatgagaaggagtccctctctgtcacccaggctgcagtgcagtggtgtgatcttggctccctgcaacctccacctcccaggctcaaccaattctcctgcctcagcttcccgagtagctgggactacaggcgtgtgccaccatgcctggctaatttttgtatttttaatagagacaagttttcaccatgttgcccaggctgctcttgaactcctggcctcatgtgatccacctgccttggcctcccaaagtgctgggattacaggcatgagccaccatgcccagcaagtgttagtatattctgtgtgtggcccaagacaattcttcttcttccaatgtggcccagggaagccaaaagattggatacccctgacccctgatgtaaatgtttactccaatgttgatggtaaagatagagctggtggccaggcacagtggctcacacctgtaatctcagcactgggaggccaaagtaggccgattgcttgaaaccaggagtgtgagaccagcctgggcaacatggcaagactccatctctatgaaaaaatacaaaaattacccaggcgtggtggcatgtgcctgtggtcccagctactcgggaggctgaggtgggaggatcacctgagcttggggaagtggaggctgcagtgggccaagatcacaccattgcactccaacttgggtgacagagtgagaaccagtctcaaaaaaaaaaaaaaaaaatatatatatatatatatatatatctccccatatgtgtatatacacaccacatatatacatcatggagccatatatgtatacatacgtatatgtgtgtgtacaataaatttggagggctaggcgcagtggctcacacctgtaatcccagcactttgggaggccgaggcggggggatcacctgaggttgggagtttgagaccagcctgaccaacatgggaaaccccatctctactaaaaatacaaaattagctgggcgtggtggcacatgcctgtaatcccagctacttgggaggctgaggcaagagaatcgcttgaacctgggaggtggaggttgcagtgagccaagatcacgccgttgcactccagcctgggcaacaagagtgaaactccatctcaaaaaaaaaaaaaaaaaaaaagatttgagcaaagacatgcaaagtcacctttaaaaaaggcaggtcccccagcagcccattttttttttcctcccatcacatttaagtcatgtgtatgggatcatgaaggaggtgataatttggggttttgtcagtgtatgtttctgagagtgaatggttcacagctgacgagtatccaacagaaccagttacacaggagattgaggagtggctgtcatggctgtgacagtgcatgatctcaagttttcaatctgagacctcctaaggaaaaaaggaaaaaaaaaaaaaaaaaggcaggcctcaagccaagacttgacttcaaattgactgaagtataacataattgtagaaataacagctcattgcggttggagggtgaggaggaggttggtcagccataaaaacataatttttgtaattttttgtagagacaggattttaccatattgctcaggctggtctcaaactcctgggcctaagcaatccacctgtgtcggcctcccaaagtgctaggattacaggcatgagccaccatgcccagcctatatgtatgttttaaagtgtggttctcagacagcaattttatttctctatttccagagatttttcagggcgattttatgattaactccatatacagcttaatatgtcaaaaagacctgacttaaatttttttcttgaaacagcctttaacatatgtcaaaaatataatatattcctgatacttgtgtccaagcagatataagttctaaatagggcaaaggatctaatgaatgcttgatgtcctcaaatgtgctatgatttaccatctgtcaagatgaaaatacacccatgtatatgcagctatttaaagtatcataggctgggtgcagtggctcacacctataatcccagtactttggaaggctgaggtgggtggatcacttgaggtcaggagtttgagaccagcctggcaaacatggcaaaaccccatctctactaaaaatacaaaaattagctgggtgtggtggtacatgcctgtaatcccagctacttgggaggcttaggcagaattgctttaactcaggaggcggaggttgcagtgagccgagatggcaccactgcactccggcctgggagacagagcaagaaagaaagaaaagaacggaaagaaataaaagaaagaaataaaggaaaggaaggaaggaaggatagagaaagaaggaaggaagggaagaaagagagagaaagaaagaaaagaaagaatcataatggggtcaggcgtggtggctcatgccttgtaatcccagcactttgggaggctgaggtgggtggatcatgtgaggtcaggagttggagaccagcctggccaacatggtgaaactctgtctctactaaaaatacaaaaattagctgggtgtggtcgtgggtgcctgtaatcccagctactgggctgaggcaggagaattgcttgaaccaggaggcggaggttgtagtgagccaagattgtgccattgcactccagcccgggtgacaaagcaagactccatctcaaaaaagaaaaataaataaaataaagtatcataatgggctgggaatagtggctcacgcttgtaatcccagcactttgggaggccgtggtagaagtatcacttgaggacaggagttaatgttgtcctgaaaagatgggcttcagagggaattgaaggagaggaagttgaagaggaagcactagtccacatagcaagatcccatctctgtgagaaaaaaaaaaaagtataataatggagaaattccagcacatgaatcaaacaggatgttgcagattctaaacatgaatccaatgtactgtcaaaactgtacaaggataacttagattttttttcctgaagccttccttcattgaataattataatgaacattgtagatgtggtaattatctgtaaatatgtctccttatgaaagcaaaaactggatataatgaacctaaagcaatttgtttaacttgtaagatgtctgtccaaaaagtagcaaatttggctccactgtcatttatagttttggttataaaaatggatttatgttggacggagaacagcatgctctacattcacacataacaaactacactttattgtggttcctgagcaaagccagcttctccatgccctctggggtggtgtgagagggggaagctggaatctgaatgggaaaaattcttcatggtgggggagagctgctagcctctgatgcctgctgctgtcacatctcaaacttctccaaaagacttgagcgtagaaagctaatgaacttaggccgggcacggtggctcacacctataatcccagcactttgggaggctgaggcaggtagatcagttgagctcaggagtttgagaccagcctgggcaacgtgacgataccctatctctcaaagaaatacaaaaattagctgagtgtggtggcatgtacctgtagttccagctactcaggaggctgaagcaggaggacagattcagcccaggggggctgcagttagctgtgatcataccactgcactccagcctgggagacagaacattacactggtctgaaaaaaaaaaaaaaagaaaagaaaagctaatgaacttagaaataaagtttctattgtagaaaaacttaatagctgttatcagtattgactttgtcaatttcaagaaactgtatagcacaaagaattcttggtaagaggagaccataaagggagatgaaaactgtagcgggagtcttacaatgccacagttttggtgatctgatagccaaatgcctttcctctgattgaatgagttgtgcacacaataaatttgaggaagatcctgggctaacttgtaaaacaagctcagattagctgtggctattaaaaaatcagtcatagttttcactagagaagggagatatttctgtctgattttcaggatggttgattactcaagtatcctctttcgtaaatgtattcttcctcattttctgatcagttttggttgtgcaaaaagaaaacagtggttttatttcatgccagcagaaatgtggttattttgtggtatgttttacaaacactttaagatcacttatgtttatgtatatacacatttggtctatcgtaaaaaatttacattttaagttttaaaagatttctcataatacaggacacttcccccatgtatttcatataaaccataagttttaatgtttcatatttataaaataagaagcctttataatttcaaaataaatacccacggtgaatttggtggagaggaagcagtcatttagaagagcaagcccacatacatgcaaaagaaagcaattaagaggccaaggacagggttgtttcgaaaggatatttaaaactagatgaaagatatttggaccttcaaaaatgccctagaaactgaatgaaagcaacagccttctgtcttttgtcagagctctgactcatagacctgttattggaaggacattatttagttgaaatatatatttaaaaatacttatattcctttaagtagcttatactgtatgtgaagatgtcttttaaggattcagaagcacaggcagaaggatctgtataaatacagaagtgggctgggcgtggtggctcacgcctgtaatcccagcactttgggaggctgaggcggggtggatcacctgaggttgggagttcgagaccagcctgacctacatggagaaaccgcctctctactaaaaatacaaaaaaaatcagccaggcatggtggcgcatgcctgtaatcccagctactcaggaggctgaggcaggagaatcgcttgaacccgggaggcggagcttgcagtgagccgagatcccgccattgcactccagcctgggtaacaagagtgaaagtccatcttgaaaaaataaaaataaaaaaaaagcacaacttaggtggtacaaaacatgtgtattaaaatgcctaatttagaggccaggcatggtagctcatgcctgtaatcctggcactttgggaggtcgaggcaggcagatcacttgagtccaggagttcaagaccagcctgggcaacatggcgaactgtgtctctataagataacataaaaaactagccgggcatggtggtgtgtgcctgtagccccagctacttggggggctgaggtgggaggatcgcttgagctaggaggcggaggttgcagtgagctgagattgtgcaactgcactccagcctgggcaacagagaccctgtctcaaaaaataataattaaataaaataaaatgcctaattcacacagttctgttggagaaactgattcatttggtggagcccaggatttaggttgaaggactctccctaattaatttgtcttatagtagactaagtttaaagtagatggctgttcatctcttggactgcttaagtaacttgtccaaggagagctaggtttacatctgccttatgattccataataaccaccacagctactatctgagagctgactatatatataggggattgtgctgacagctgcccagacaactcatttcgttttctccaggactctgtgagtgtatgtgagggacactgggattcctcacattctagaaggctctgatgagcagtcggaggtagcaggtgggactctactccagaggttgagctcggacactggagtggacactggaccagattaagaactagccaaaacagggcctgggcgaaagtagttttaatcagacatgctcaccagtgtgccatgtcgatttaccactgccatggcaacactcgacagttactgtcactttccatggcagtgatccaatgacctaggagttactgcccattccctagaaatttctgcataaacagctctttaatctacatgcaattatttatttatttatttattttttgagacagagtcctgctccattgcccaggctggagtgcagtgacatgcgatctcggctcactgcaacctctgccgcccgggttcaagcgactcctgcctcagcctcctgtgtagctgggattacaggcgcctgccaccacacctggctattttttgtatgtttagtagagatggggtttcaccatgttggccaggctggtctcgaacatctgacctcatgatccacccacctcaaccttccaaagtgcagggattataggcatgagccaccatgcccagcctcccacttttagtttcaagtacaggctgggtacagtggctctcgcctataatcccagcactttgggaggtcgaggcaggcagatcatgaggtcaggaattcgagaccgcctggccaacatggtgaaaccccgtctctactcaacatagaaaaattagttggatgtggtggcgcatgcctgtagtcccagctactcaggaggctgaggcaggagagtcacttgaacctgggaggcggaggttgcagtgagctgagatcgtgccactgcactccagcctggcgacagagcgagactccatctcaaaaaaaaaaaaaaaaaagtgggtataaatatggctacagaactgaactaccctcagctgctactctctccctatggggtagccctgctctgcaggagcagtcatggagctgtaacacagcctcttcaatatagctgttttcttctacctctggcttgcctttgaattccttcctgataaagccaagaacccagagggctaagcaccactttgggacttgcctgtcctgcactatctccatttctgttgtcacaattattggggatacctgtagtccaggaggaacttgggaaatctggaagctttcaagtttggcaaggggatgtcaaaatgaccacaaagcacatttcctcaaggcagctttccctgaacactctccttccctcatgccctccacgcctaattaagtcagatctgtccaagttctcgtaacagtatacaaatcctttctcgctctcagcagtttgtaattatgtattcgggtcagtctccttactagacggtaagctctatgaaggtgagacattgtgtttattttgctttctattcccgtaaatccagggcctggtatattccatgtacccaataaatatttattgcatatgtgaaagtggcatttctttgtcttttggttaatattgctgacataaacaaacagatgtgcgaatgatgagggaggaaatcatgggagttcaaaaggttctgtaagcaggtgaaatgccctggcgggtacagactgggtacataggtgagccagctgggaagaattttatatatcagaggggaaaagactttcctactaaaaagacaggcatctttgacaagtaggtaacttgagtttactccctgagttttattttattttttgagacatggtcttgtgctgtcacccaggctggagtgcagtgctgtggtcatggctcactgtagcctcgacctcccaggctcagttgatgctcctgcctcagccttctgagtagctgggtgtataggcacacaccacctcacctgactaatttttgtagttttttttttttttttttttttttttgggtagacacaggattttgtcatgttgcccaggctggtgtggaactcctgggctcaagccatctgcctgcctcaggctcccaaagtgctgggattgtagacatgagccactgtgcccagctgattttgcttttaggtttgaattttttttttatagttctgtgtttatttgttttactttgtttttggagacagacttttgctctgtcagccaagctggagtgcagtggtgcgatctcagatcattgcaacctctgcctcctgggtgcaagtgattctcatgcctcagcctaccaagtacctgcacaaccacacccagctaatttttgtatttttagtagagatggggtttcaacatgttgtccaggctggtcttggattcctggcctcaaatgatcttcccacctcagcctagttttgtgttttatattcttttccccactcagtttgaaatgtcatgaggatagacacatgtgtgaagatagacacattattaagagatgctatcgtcatgggttctaagagaatgttttacagagagtagctttgcagagaccaaagtctctgacagatcatcagacattagattcttacaggatggccacctagatccctcacgtgggcattttacattaggactgagcatctttattatgataactttggttgatgttttgcagtttaaaaaactctcagatcatctaattctcacacacgtcttgtgaagcagacagctcagaaccatggctcttagtttacagatgaggaaagagaggctcagatgaggttgatttacccaagttaaagtgaaaacaaattaacattttttgagtgtttactaaatgttgaggcacttattaagccctttatatttatagtatataacatgatattcactgcatccttatgaaataggtaaccattattattatttccattttacagatgaggaaacagacatgtagaggtcaaataatttgcctcaaattgcataatcaagaagcatagagcccagcttaaaacccagatagtctggctcaaagtgcagatgataaactaccatgctaatgagtagcactgggagttctccaatgaagcacacgatgttacttgtatttgctactaacgtcttcttttttttgagatggagtctcactctgtcacccaggctggagtgcagtggtgtgatctcagctcactgcaacttccacctctcaggttcaagcaattctcctgcatcagcctcatgagcagctgggattgcaggtgcaggccatcacccctggctaattttttttgtatttttagtagagaccgggtttcaccatgttggccaggctggtctcaaactcctgaccttgtgatccacccacctcaatctcccaaagtgctgggattacaggtgtgagccaccgcacctggccaactactaacatcttctaacccctggttcaattctgctacttgaggcttttttttttttttttttttttgagatggagtttcactgtgttgcccagcctggagtacagtggcatgatctcagctcactgcggcctctgcctcctgggttcaagcgattctcctgtgtcagcctcctgagtagctgggattacaagcatgagccatggtgcctggcctaggctactaattttttttttttcaaagctgtctgcagttttgccttgacttagaattcatcaactggagcccacagtgatatcattgcacaggattgaagttgtatcaactaaattcagataaagatctcctacgttaattaattaaacaaattgttgagtacatttgctaattttgttagaggtgctcattgcttaataactacaggacacattctattgaatatactgggaaaaagctgtatctttctctgaaggtatacaaaacaatattaagaagcataaaaaatatctgtccataaaaacatgattatggccaggtgcagtggctcacgcctgtaatcctagcactttgggaggctgcagcaggcggatcacgaggtcaggagtttgagaccagcctggccaacatggtgaaaccccatctctactaaaaatacaaaaaatagccaggcgtggtggcaggtgcctataatcccagctactcaggaggctgaggcaggagaattgcttgaacccgagaggcagaggttgcagcaagccgagatcgtgccactgcactccagcctgggcaacagagcaagactccatctcgggaaaaaaaaagtgattatatgagttatttttatttttattttttgatacagggtcacccaagctggagtgcagtggcacaatctcagttcactgcagcctcagcctcccaggctcaggtgatcctcccacctcagcctcctgagtagatgggtctacaggtgcatgtcaccacgcctgtcttatttttgtattttttgtagacacggggtttctccatgttgcccaggctggccttgaactcctgggctcaagccatccacctgccttggcttcccaaagtgctgggattacaagcatgagccaccctgcctggtctatatgagttctttttaaatcattatctcttcaaggagataacaatcatcaataggttttgtacagatccaaactctctgcttgtggattctcttaacatgatactttgtaattgaaaagagaatatgaaaatgccaagctttgtaacttcaaagaacaacaataacaaaaagcctttgcctagagatctagataggaaagtgatcccgccaaaattttgggcctgtgtacagggctgtgacccaagtgggacacctggggtcaatgagcagagttcggtgcagagggtcatttgtgtatcttttgaatattactaactgcatctcaagatcatgttagaacgagtattggctatttggctttttgtgtcatcttgccccttcccgtctccattatggagaattgaggttttaatatacggtagtgacattctagtagatgaaggaagggggctgtccccagtgggcaatctgaacttctgcttcgtatatttactcttgctgttttcgtttctcctcatttgtaattcaggaggctctctgagaagagacagcaaagcttcttagatggatcgaaagaccacgagctgggataccaagttctatgaaaaggtcagctattgaatttactctgctaccttcaggcaaatcatttgatcatcggatgctctggtttcttcctgtgcctgctaaatgtaaatagcatgggtttgagtgtttggtggttattatagagtattttaaatgtatgagtgatttatttttctaggccagctgctcagatataaaacaaaatctgctcctttgagctgttaggcttcgtggcagtcaactgaccccaaaatccttctgactacagcagccatctacttgcttgttcatctgataacattttgcagtctctcagctacagctatgtggtctcactctatagctggggcatacctttttgtctcctttgtcttcagaaaggaaatatgccattttatgcactcctgctgctttcacccccactttaaaaagatgaaggcttccttttgtgacagagttgctttgtctgttacactgatcctaagagacaggaaggagaggtgtcatagtaaataaacagttattggacttgctaccatagttcctttttgatgacttgggccaggaccactagaggtttgaactagatttagtaaggcttgggcttttcggggttttggcaggaagcagtcagggagtatattggaaagagagaacacaaaataccgaaccccacccaccctgtgcctttttgtttgttgttacagcctgttacattaggcaacaagatatccttgttagccaaaggtgccaagctgagattcttaaaagctaatgaaagagctgttgggccaggtgcggtggctcacgcctgtaatcccagcactttgggaggccgaggcaggcggatcacgaggtcaagagatggagaccatcctggccaacatggtgaaatcccgtctctacgaaaaacacaaaaattagctgggcatggtggcgcgcacccgtagtcccagctgctcgggaggctgaggcagaagaattgcttgaacccgggaggcggagtttgaagtgagccgagatcgagccactgcactccagcctggagacagagcgagactccactccgtttcaaaaaaaaaaaaaaaaaaaagctgttgggtaaggaatgattttgttccccatctgtggctcaccaccccactgtttcataaatgaaaatctctgatgtgcaacgctgaattaaccaaaaggcttacttcttttgttttgaacttagacacatttacattatttctggtgcagttaaattaaaagcactttccaaacaaacctaggaaagtattaaagttagggactcccacgaaatgttactccttaattgtggcttggataatagcaggaagaactgcagacaggaacacagtgtaactaacccttcagttctgaaatgttgctaggtctcctcgtgttataaatgatcaaataaatatccgggttaaacactgctcccagagctgagttcactcttaagagtgttgggtccaacttccctgtgctaattcaaggaaacaaggcagccaaggagtctaacttgaggtcttcattcttgggcagggccatcaatacatctaaaacattacttgtgggtaccccagctgcggtagcttccccaaaaggcagaattttcactcattctttatagaaacacgtagccagcaacttctcaggcttggggaacggggcaggcgggtcgtggtggtggggagagtagaggagggagtctggcaggtcggttctaaatgtaaactggaaactacgcatccgagcgggcaaccatcactggcaccattcgtctccgggaagaacctgtgtgtgtcaggatgcacgaaaggaatgactcccctctttgcgcccccggggttaactgcacgaccctgtcaaagtcccgccgtggagtgggatgagggtcgagaggtaaccctgtcaaagtcccgccgtggagtgggatgaggcgaggaaagactggaggtccttccagcaccaccttggaggggcagggaggctgcagttaccgccttcggaagtgatctcctcagccctcaaaaaaattaaaaccacctccgccatttactagaggccaaggcagggccgggacacgagaacgcgctccgggcggatgcgcgctccctttgtcccgcctcccagcggcccgctcattggacggagggagggcgccgggggagaaagcgacgcggccgctcgtaagtgctccggatggaaactggtgcagggggcagcggcgttccgcggccggaagggaagggggaggtgccgaggctgcgcgccggctgctcctccccacccccagcctttgccctgaagggggctggatgggcaaggcggccgcgatggctcgagctcgggcggtggcggcggtggccggaggcggcggtgcctcctcctcctcgccccggcgccggcggtgatccgagcgagcggccgcggcccccgatgagactgctggcgggctggctgtgcctgagcctggcgtccgtgtggctggcgcggaggatgtggacgctgcggagcccgctcacccgctccctgtacgtgaacatgactagcggcccgggtgggccggcggcggccgcgggcggcaggaaggagaaccaccaggtacgggctggggccggggccggggcgggggcgtggcggcccggccttcccgcgctgggcccggctattgtgcgggacggctccgcgagggggcggcccggccctcgcccctccgcctcggccccttggaaagttttccccgcgccttccccgccgggcgtcgactccgcgagccccgggcacccggccgcggccccgcgagcgccttttgttccgcagcgcaggcggggcatggcctcccgggcccgatcgtgagcggcccggagccccgcattgttcctgggtcccgggcggtgactgcggacgcccggcagcgggactggggaactttggggccagagcgtggctgggggcgcccgcctggcaccgaggcctgagactgaagagacccggccagatccattaccccgagaaacaaaacgaaaagccagcccctcttgttgtctcgttgaatcccagaacgtacaaagggtcgtgaagaaatgtaactgtacatcgcaagccattgaactctccaggctgattggggtgacatttctccctaagcacttaaaaaatgggtttgacaggttgtcgctcccatcctacggaaccttcccctcctacctagcagagatctcctttaaacttggatttagtcagcctgctagaaagattgtgtgtgatgaggaggaagattatgcaagttttacaggaagggtttttaaaacagaacgggacgggagggagttttagttatgcatcgtgagcgttacgctgtgaccgggtaggtaggcttttcattagctcagtcttgcgccacttaaacgtgtacaggttaactgtagaattaagtgagatatttcgtatatgaccttaacatagtttgcagttaatgttaaattcattgaaaagaggcttttgaactctgccagagtgttggcttgtcatagctagcatttataatacattttgcttttccatagagtattaattattccctatatcatcttgtgtctcatcattttcatatatttctcattttcctacattacttttttattatgccaggtgttcagagaatttacacccaggttgatttcatgtgttttaatgagggtagagaattgtctaagaaggagatagagcaatttagaaaagtagcatttagtctttagtaatatgtatattgggcttttttctattgttaaaggaatcctaaatttctgtaaatttttttgaaagcctccagccattgcagtttgttaggtgcaatatcagtatcattgatcacttgtatgatatggttaggaatgtatgtaaacttaaattgcaaaaccacatttattcctatggattatttgcttacactagttcattcttatagagacaactcaaaggtactgtaccgttgactgtacagttaccagaatgtcacatatggaacaatggggtagacaatgaattagaaatgtcatttttaacatttttaagcagttgatagaaataaggtcctggataggagaaaaagcgatttatctccattgatgggggattatggttgagtctcttagctattggtatttataacacttatcatgattacccctactgcagccacttggtaggtttttagtgctcataaaagaattgcacttattttaaaattgaaacactatttcaacactgtgatgtgtatggaggcggaattgcagctgtagacatagcctcagaatatctcccagcagaggatactttctgactgtaccttttaaaagctgaatctgttaagttctaatgaaaactaatactggtttcagatacgtttatttcagataccgtatttatattctgtgtgtgtgtgtgtgtgtgtgtgtgtgtgtgtaccccttcactaacaattcagcagataatttctttagggtgaagacttaatatggtgttttctgaatatttgggggatgggtcaactcttttccttagaataatgaatccagacattattttgacatgaatacattcatattatgaaaataatcgtgcatgaataaagattaaaaggaacagaagaaaggtgtgtagaaaccaccatgagataaagtaggaaactgtcctttctgcactgtggctggagttgataatttgttttccacttaatattccaggatcctgggtttgccttataacttcgttgcttgtgaagtaactgtaactgtttttcctccttcagattaatagttttatacaaggtcttctaagtgttcagttgggtgtgtgagttccatagccagccacatctgggccttttggagttgcataaaagtagggttgtggatttgattgaaccatacttagcaaaagtgttccttctggttattttattaaggaattatgatggaggattctgtggttaaaagagagatcttgggcaatgtttattcgttaaaaatggctattttgttagtatagtttggagaggcaaggctcctttgggctaaagctgctctaaaactgtagtagcagtgccattttagtaacttggtttggtgtgctagcttcaaaactgggattatgtttcactttgggcaagcaagaagcagggtttcacttagagcagggaagtggctgggaggccagactggtctcacagacttattttacagcctatgaaataagaatagttttatatttttaaatggttaccaagaaaatatcaaaataacattttgtaatacatgaagtttcatttatggaattcaaatttatttcagtgtctacaaataaagtgttttttttttgagatggagtctcgcttcgtcacccaggctggagcgcagtggcccaattttggttcactgcaacctctgcctcccaggttcaagcaattctgatgtctcagcctcccgagtagctgggattacaggtgaacaccaccacgcccagataatttttgtagttttcagtagagatggggtttcactatgttggttaggctggtctcaaactcctgacctcaagtgatccttcttcctgggcctcccaaagtgctgggattacaggcgtgaggtactacacccagcccacaaataaagttttattgaaagagaactaccacattcatttacctgtggtctatgagctccctggctacaatagcagcatatttgctactgtatggcctgcaagcctaaaacatttactacgtggcttcttacagaataaagactttttccaagagaaattcccagcttccttaacaaacagcttttttttttttttggagacagggtctcactgtgtcacccaggctggagtgtagtggcacaatctcagctcactgcatcctcgacctcctgggttcaagcggttctcatgcctcagcctctccatagctgggattacaggcacgtgccagcacacctggttaatttttgtagttttagtagagacagggcttcaccatgttggccaggctggtcttgaactcctggcctcaagtgatcttcccacatcggcttcccaaagtgctggaattacaggagtgagccactgcaaccagcctccaacagcatattcttaatcacaggttgcagggtgggtagattgactcactgggaagaaatagaggcaggcagtgagaaactagtagatattgtcactttgcaatgttggcagactcagaatttaaaaagacaacaacaaaaaacttaggatctattctttttgatgcattgcacctagtgcttaaagttaatgcaactattatggagctactgaaactttgaaaggacccttaggccccaggttcttggtaataatagcggttcagtagcttctcaattgatggagtgaaaaaattgttatagaactcgctgaaccaaaccacaacgatttctccgggtgacatactgcaaggttttttaaaagcacagataacattcaatatctggaattattaagttgtaacttaaaattgcaagtatgtgtatatttttgtgacttattttttcactttcttatataagctcagaactgcgctatgccacaagtgatgaagaattcaagaaagaattaaaatccttttttttcccccaaatgaaaaaatacttggacagcatagccagagccaaacactgtgctaaaggacagagtgtttcctgtccctttacccctcacttaccctgtggaggcagactggagtcaggcatgagttaacaatgcttcaaggatagtcagccagctaagccggacagacactgatggattggcgtccttctctgaactgccttcgagagtctggaggcctttgcagctgaataccaaagagacttcagaaaggatttctttgcttcctcataatctgtgttgaaaccccaagtgtttgcttcagtttcacagaacactagaatctctttcttgtgctggatataccaggagtctttatgtttctctttgaaggtgccctagaagaccctaatagcttccagtaaaaagctctgttgtgtagaccctctgaagctttgttaaaattttaggattatcctgtcctatggggagtgagtatttagtatttgcaatgaggattgccagtaattggttattaaatcaaagctgaagccatttaatctgttttaattgattcccctcatggatatgagggtgcctgtcactgtacacattgaaatctcacataaagaggttattgggttgagtttatattgtttgtgggaaaatggtgaatggtctgaatatttacgcctatgctgtgcttaaatgcaaggtgtgcatggtgaaatgtctggactgagttgactgcattgtaaaatcttagaatgtgaattttgaatccttagctgtcaagctctgttgatggagttggtctggccaacttagaaaagattctgtgttcatagatcctgagcagtggagcttttctgattgtttttggtagccctgaatgccttgggtctttgattacccatttcttttgagaatggctggatgcctagacctacagtttggtttttaggcattcccttgaactgtacttctcctctgaccagcccttgccttggagagaaaggggaaggaaatatgaagagctactggccttctattgtgtgccaggcacttcaaatatattatccccagtagtccacatagaactcttggaggttggtggtatcatccgcactttacatacagaaaagtgagggtgagagagagaagagacttgctcaccagcacagagttaatggatgatagagttgggctttgcacccagctttggtttcaaggcaacacattttctgctgctttatgatgcccctcctggtaaaccttgtgttgtctgaggggtggtaaaaataggcttgccttctttttttttttttttttttttttttttttttttttttttgagaaacaagttcttactctgtcacccaagttggaatgcagtggcctgatcatatctcactgcagcctcaaactcctggcctcagtacatcctcctgcctcggcctcctgagtagcttctaaatcttttgtagaggcagggtcttgccatgttgttcaggctggtctcaaactcctggcctcaagcagtcctcctgcctcagtctcccaaagtgctgggattacaggcgtgagccactgctcctggcctaggcttgccttctgaataggaaactgccctcattctagtgaggcctctgtgtagacactgaagttaggtagctgtgtgcacaatacttgttgaagattttgtagtttgtgaattagatgagaataagacagctgcttgaagttctggcctttatctggtttgtgcatgctttttttaaggcttaaagttgaaaaaagattcttacatgtattgtcattttttcctgacatcagccattctctaattttccatcaccaagtgggtgtttaattgttcaatcctgttctgacattaactacctggagttagggtcacgctttacagagttaagagctcagtcccacaagactgccctcacttcagaggccagctggaagtcctgggttcccaggctgccagtgcttttgtccaccttgaacaaatttgggagttcccacaactctaccttcaccctaccccaccccaccccctaatttcctataatagaatgactcatagaacttaggaaaacacaggtgcggtggctcacgcctgtaatcccggcactatgggaggctgaggtgggtggatcacgaggtcaggagatcaagaccatcccggctaacagggtgaaacctggtctctactaaaaatacaaaaaaattagctgggcgtggtggcacgtgcctgtaatcccagctactggggaggctgaggcaggagaatcgcttgaaccgtggaggcggaggttgcagtgagctgagattgcgccactgcactccagcctgagcgacagagcgagactccgtctcaaaataataataataataataataaaccacttaggtttactggtttattacaaaggatacaattggggaacggccaagtggaagaggtgcatagggtgaggtgtgggaggtggtgtagagtttctctttcctctgatgagccacccaaccatcatatcaatgtattcagcaaactaaaagctcccaggaccccatagtttaggggtgtcattacataggcatgattagactcagtcttcaactcctttctcatccttggagattggaaggtggggctgaaagtttgaaccttatacccacatcctggtccccatcctgaagctgtctgggtctcccacccctatcaggagtcatcctgttagcatacaaaagatactcttattaccctgagattcccgaagggttttaggaactctctatcaggaacctgggacaaagatcaaatatgtattttttattataccacatcatctaaaatcagtcagtttttaaaattactttctgactctgctagtgtgcttaaatcctttgtattttgggaatgttgtattttggatatgttgtatatcacatgtttgattagttgataaactccaaaaataatttcagaaaaacttttaaccatatttggtctgattagcaaatctaattttataggaaaattgcattcctactttgaacgagtgattcatcaaccaaggttatatataaatattaggaggagttcatgggcttaatgagaaattttttttttttttttgacagtcttgctttgtcgcccaggctggagtgcagtggcacactctgggctcactacaacctctgcctctctggttcaagtgattcttttgccttagcctcccaagtagctggaattataggttcctgccaccacgcctggctaatttttgtatttttagtagagacggggtttcaccatgttggccaggctggtcttgaactcttgacttcaagtgatctgcccacctgggcctccaaattgctgggattacaggtgtgagccatcgtagccagccaggaaatttttaagacagtatgacctaatatttaataacttcggttggcgaatactgtcagacatgcattcaaaacgcgtggcagccacctgatttggctgtttactgcctggccaattattagtatctttgcagttgtgttgccagtagggagaatattgctatttactgtaatttttagatatcacatcctgttctgtacttggcatcagcagatgactgaatggaatcattctcatttgattagaatttgtcatttaaaagattcccttgtttatttagatgaaacaacatttgagtgagctttaaaggcagatgctaataagatgctttttcagacatggtaggctccagccaaggagtccagcctcacagtagagtgggcgtgtagtcctgtcagtgtgtgaatttaacgggcatagtactttgttcttgcctgtgcacctttgtctctgtagtctttaaggagcacacatttaaagaactcacctgcggctgggcgcagcggctcacgcctgtaatcctagcactttgcgaggccgaggcaggcagatcacctgaggtcaggagatcaagaccagcctggccaacatggtgaaaccccatctctactaaaaatacaaaaattagccaggcggggtggtaggtgcctgtaatcccagctgcttgggaggctcaggcgagagaatcacttgaacccggcaggcagaggttgcagagagcctagatcacaccactgcactccatcctgggcgacagagcaagactccgtctcaaaaaaaacaaagaactcacctgcttgaaagtacacaggagcatacagacaagccacccagtgctgcgagcttagcgtagctttttatctaagctggttgtttggagagaggtgaaaccaggagtcctgcccattgggttaaaggggttcctgcagattttttctctccttggtccttggtatttcaccttaagggcaaggtgactgctcctttaaggctctgaagctcctcgccaagatcatagtcacattacttgtttcccttggtttctgattttattttcactctggaatgtaagttctctgaggccagcgagtccatcttttaattcagtcagctggagtccctagaccatagttaggctgggatagtgggaaacactactggagagtcagtacagtgacattttgtgggtaaggccatgtatgggttctcaagcagtggcagttttgcctcccaggggacatttggcaatgcctgggacattttgggctgtcatttggggtagtgccactgtaacctgatggataggcactaggaatgctgctgaacatcctacaatgtgcaggtcagcccctataacaaaggatcatttagctccaaatgtcagtagtgtgaaggctgagaaaccctggcttacaggactttagttactatctagaccagattatcttttctctacacacatgtagttcagtttaattggcaggatagtcctgctttcttttctttagcagacacactgggtagagttaagtgaagagaagcttctttgaaagaaacgcttataaaacaacacgtacctggagcaggagcttgaatcagctggagctgcttagggaccctatgcttcccatttattcagaaattgcaaggtggtaaatgaaatgtaaagcacatggcttggtgcctggtgcatgataggtgctcagttggtgtcttccttcattgcttgcttccttgcttgtggtaatgcaattttgtggtgagtgggtagctgtaaccactggttgcaaaattaggtttaagcaaggccttgcagagtttgagaaattgacagaaaccccatggcagcgatctctgtggttatccttatgtttcctctaggattttgttagaaactccaaattctgtttaggctgcctgttgatgaacatttattgtttgtctgtatctgtgccaggcactgaagccattcattttctctgcctttatgaagctctcagtctacctgggaagataggcactgaacatgcgattgtctacaattattcaattcagagattgtaaatattaccaaagggacaaatgggatgtatgaaagggtattagaacagggggcctagcctagcctttcgtaggtatattttcctttgaaaagaaaatatacctaggaaatatttaggctgaagttgaacgaaccaggtgaagagagagtgggttaggtggtgggaaatgttggggggcagagcaaataccatgtgagacagccacgggaaaggggccttccagaaaaaagaaggaaggggtggagctgtgtgatggagtgagggtccaggggtcatgggttggtagggaatgtcatgaggtgaggctggagacacagaatgaacaaaaatcgtgcagggccttataagccatattaagcattttggatgttatcctaagattcctgttaagcagggtagtgatgtgatcagatttgcatttaaaatttgcattttaagaggttttctaggttacttatgttttcaggccacttttaatttctggaagatctaactgccacctgcatatttagggaggggtgtgtgtgtgtgtttaaaaaacagctttattgggatataattcacataccatgaaatttatccttttaaagagtacaattcattgatttttagtataatcacagaattatgcagccatcaccagtattaattttggaacatttcatcaccccaaaaagaaacctcatgtccattagcagccactccacattgtcccagctccccagcccctggcagccacaatctactatctactttctatctctggatttgcatattcaagacatttcacgtaagtggaattacacagtatgtggtcttttgtgactgacttatttcacttagcataatgttgtcaaggttcatccatgctggagcatgaagcagtgcttcattcctttgtatggcagaacatgctattattttatatgaatctattatcacatcttgcttatccaccatttgatggacatttgacttgtttgcagtttctgacattgctgctgtgaaatcgacatttgtgtcatgcaaatggtcagaaaggacatacgtttcacctttctttttaaagagaagagctttgctctatttttgttctgtagcacattctgttcaataagcagtttctttccagaaagacctgtgtgacagtaagggttcaaccacacgtgttaatgttgatgaattgagaaaaatgctattaaaaacttgagttttcctcttggtgcttgaaagcactatttgcagctaatggtgccagttcctgcttggttctagaagtcagaatctattgttgttctagtccatttacaagtggatgccaaggaattcttagctcctctgtttcacttgaatgacttctcatccacattaataaaatgtacctgattgcctattatcaaggtgatggctttcatcttgattagccatttcagagaataaaaaataaataaaagtcagagtggcctccatattacagagttcagaacgtgcaccaggaggtcatgagtataataaaaaacggtttatgacctgcactggagcataacttcaggcacaataagtattaagaattagaaaatcattaagcaagaacattttcagaccaagggaaaaaatgtaggcagtgaatgtaaaaagcttcatagcttgtcatatagagtaggaaaaataaaaacagttttatatataaagtccaagcagttttgataactgtgatgaaatggcaaattagcacaaattagtccacaactggaaaggtttggtttacccagtttagggaacagagtttgtaaaatgattaatctctgaaatttaacgtgcctgtttgtttgtgttgatttgtaactagttccttttaacgttagcatcaggaatgttacttaagatttcactgaacattagtaagcttaggatgactgtaaagctggtctaccaattgtgcaagcacttatgggacgtctactgctgataaaaggtcgtatttgtcaaggggaagcaaattactcttggccaattgactgggaaaaatttgtgtttcatggcagataatgggttaataataattgatatactttgtagtttcatcactgtacttaaggggcttattcttatttctcaggctatgttagaggaatctcactgctattattattgtaggattctcactacgtgctttgtattatgttgaggacttgcctgcattatcttgtttaatcctcatcgtaccctgccaggatatatagaccccagtgacatctctagtctacaaatgaatggaggctgagagatttaagtgatttgtctgagctcacataggaagggcagagccgggacttgattgtggggctgacgctaaagctgatgtacagtctgcttccccacctctctggtatgctgactcatttattatgaaagattaaatttcatctacaggtgaagctttttgaattttgttctagaatgtggattctgggtagagccaattcctggaaatctggttcttagcatgttactatttggtcttctcgttgattgcagtatgaccttaagtaacttcttaatctttcttgagcacatgttgcctctgtaagaatgtcatatgacctatttgtaaagcatacctcaagatttctaaagatctcttttacatagtccacaagaggaaaggcaacttaatctggtcactggagtgttaaattctgttgcttactttgctatttgggtttgtttggtgattttgagttaaggcattggattatgtgactgttttcttgtctaaaaacaaggatgctgctagctgtttgccttctgatgttgaatctcagtgaaagagaggccagcagagctttctaaatctcgggtacagtgactgaagcactgggctgggagtccgagtgcctgagctgtggtctggttctgctgcctactaagctgaatgacccaaaagcctctccacccttccctcacccactctacctaccttgagggctgtaagagaattaaatgagaagtcatgtctgaagaagtactttatattttataggttatatgagtatacgaaatgattattctcagagtatcatgagatggtaatatttggaaatcttagatgtgatttagtcttctggttttttgtttttggatttcttaggtgacacttcggttgtgtgttttaatttttgttctttttttttttttttttttagtggtatgtgtgcaacagagagaaattatgcgaatcactccaggctgtctttgttcagagttaccttgatcaaggaacacagatcttcttaaacaacagcattgagaaatcgggctggctatttatccaattatatcattcttttgtgtcatctgtttttagcctgtttatgtctagaacatctatcaatgggtaagtgaatcttggacatttatttttttctttatccttaggtttacaaaaggaaaaacacaaaaagaaaagttatcttgttcagcatgttgactacctgagctacaatacttctactagtcagaaccttggcagttggtccagcgttctatctttctgtggttctgccctttaaattcaccataacgtgacagcctcattagtatgtttattcatagcgggagttacttacggtagtgcttcttggctttgatgtacataggaatcacctgggggtcttgttaaaatgcagattatgagttagtacatcaggggctaggtctgagagtctgcttttttttttttttttttttttttttttttttttttaaagacagtcctgctctgtttcccagactggagtgcagtggcaatctgggctcactgcagcctccgcctcccgggtttaagtaattctcatgcctcagcctcccaagtagctgggattacaggtgtgcaccaccacacctgtctaatttttgtatttttagtagagacgaggtttctatgttggccaggctggtctctaactgacctcaagtgatccatccacctttgcctcccaaagtgctgggattatgggtgggagccactgcacctggagagtctgcatttttaacaagctcttagacgatgccagtgatgctgaatgctgctggttctggaccacaaagtagcaagactcctggaaccaagccctgaagctgagggctttacgcccttaggctgaaaagtaagatctttgccttaaacatacttcgcagtggcaaattttttttgggagatataattagtcagcccaacagtggatgatggcttattttgagtgaagagtcctgcatctgttcttaaataatgtctaggttcaccagaattttatgaacttattgtggaattctctgtccccagagtggttccctcatataaatccatagaaaaagctttaggagttttttttgttttttttttttttcaatcctttcttggccatgttttcaagcattcctaaggacctagaatctaaaatgccaaagagaaaagcaacaggctcaatggttaagaagcctcattggaccactcaaaccactggttgggcccacttttcttttcccttgaggtttggagcagtttctactgactgactggatccccagtgtatcatctggtcctaagtcttcaggcaccgcaagccatttctcaagatttctcagttgattttcttcattgtttatgtgaaattgccatacgtttgctttggcaaacagttgttatttttatatgggtggttgagttgatacaacttggtctgacattttgttccttaaattggttatattgaatttctgttctataccatttattcttcctttggaattcagatgagtcactgtagcagagattcttatcctttctggggtcctgtagctctttgaaagtgataaaggtaggaatcctctcttcaaaaagtgcttacattcaacattttgtgtatgattttgggggcttcaaacttttatttcccctttcctctacccataagaccctggttaaaattccgtgctctagaatttcacagtttgatcaaagaggcaatgcagttaataaaccccttttggcttcccttacttaaaactcttctgctttttccttctgatacccaccctgctttcagtccttcttgccttgtgtcccattctcagctaaaaactaaattttagggcccatcagtactttccggtcatggcagtgggagataattactacaggtggccatctctcacagaaatcattactgtagtactgtcttgtattaccttaggatacttatcaaacttcctttattttggaaaggagaaggccaagtaaggaaagacttagtagatgttccagagtttattttataaggaagaggtgcatctctccgtagactcttaagtctagagagaacttagattgtgatcagagaacctaggatggttattaaacactaaagttaaacccaaattagagggtcatatctcttcatggtttgtgtttatgggaaactttgtattgggctcagtattttaggtgatactgtttttcattgtgcgagactgccccccacactgcaggaagtctaacttttctggccttgcccactaaatggcagtagtacccccaggtccttgtgattactggaaactctcctgtctactcccattgccccctagagggcaaaatcaatcctggttgataaacactgggcttgatggattttgatttattttttgacagtgttaatctttttgtagagcccctgttgctaatgttctttcgaaataggacaatgcttcccctctttctctagtgccttctttctttcttttttggagacagggtctcgctctgttgcctaggctggagtgcagtgtcacaatcatggctcactgcagccttgacctcctcaggctcaggcagtcctcctgcctcagtctcccaggtagctgggactagaggctcatgccaccgtgcctggctaatttttgtattttttatagagacggggtttcaccatgttgcccagctggtctcaaacacctggtttcaagagatcctcccacctcggcctcccaaaatgctgggattacagacgtgagccaccatgcccagcctctagtgcctataaatgtagaccagtcagatgaacttgtgagctctgagctcaggtgacctcttgttctagaattttataattatcatgtcaagattcctcacatcccaaggagatggcttgggaagcacgctctgggaaaatttaagcaaaataactattttgtgacttacttttggtcctgtggcaagtcagcatcagtatttgaaattcgcctcccctcagccatgctgccagtagcctctttctgctgtgactggtttctgtgttaaattttgtacagctacttcagcaagttcagatttgcttattttcttactgtaatatatgaacaattgaggattaaaacaacttgtcttttatgagacgtgattttctttggtaagcagttgtagtcggtagcatcacgtttagtggtctctgaggtctttctccaaatttttagcatttctatgggggcagaagatttactgtaaacttggttaaactctcctatggccttaatgggaaaaggaagggggactttgttacatgaactccattatttgtattttttcctaaaactggtcttaccttgggcaccgtgttgcatgcatctttccagtcactgtatagcagcaaacattctgtaccttatgattgtttccagagagcagcagtacagaacaggtttccctgccacttcctggaccagtggtccccaaactgttttctagggtctgaggaggaagtgcctcaggaactgcttcaggctgcagagaaaggcctagaagtgggctggccacagctcctgggctcccaacctcattcgaacagcagcagctctcttaggatcttatgttatctgtgagttccacttcatttaaagaaagggttctgctgcttaaaggagggttgagaatccctgtcctagataaactagaatttcagagctagaaaacaagtcctaaatagggattgcgctttatttcccagagtgatgcttccatgagacttggctggacctatagttgcttttctgagggttctcttcaatctccagttaaactcccctcagtctcttttttcaaaggcatcactatggttttgagtgttttctaggacctttagaaataataggacccagacagttgtaaccatataaactgacataagtacgaatctactttaatgcatattaaccgacatcacaaggaccactcttttccctcttttctctagtgtctcttaaaaatctgttatactaaagctcttttttcctgatccatggtttagttccatatttgaaatcacttttttttcctatttggtttctctgctactgtggtctggctgtgttagcttgtcatctttttcaactgataaacatgttttctgttactccttccacttttccttcctattttgacttaagttcttcacattcatctcttacttatttcttcttccttcccctgtcatcctttccactttccaccttttatttccctcctcccatgcttttttggggcattatttgcaactccaaagacaaatggtatctggaggcattttcttattttattaactttgtcttctaatcatagaaatgacataaaagataatatctttgctgggcacggtggctcatgcctgtaatcccagcactttggaggcagaggcgggtggatcacgagggcaggagatcgagaccatcctggctaacatggtgaaaccccttctctactaaaaatccaaaaaattagtcaggtgtggtggcgggcgcctgtagtcccagctactcaggaggctgaggcaggagaatggcatgaacctgggaggcggagcttgcagtgagcagagatcgtgccactgcactccagtctgggcgacggcagagcgagactctgtctcaaaaaaaaaaagaaaaaaaaaattaggccaggcgcagtggcccatgcctgtaatcccagcactttgggaggccgaggcgggtagatcacctgaggtcaggagttcgagaccaacctggccgacatggtgaaaccctgtctccactaaaaatacaaaaaataagccgggtgtggtggtgcatgcctgtaatcccagctactcaggaggctgggacaggagaatcgcttgaacccaggaggcgaaggttgcagtgagccgagatcatgccactgcactccagcctgagtgacagagtgagaccttgtctaaaaaaaaaaaaaatcttaaccatgtaataagtgattatggttgttggtgctgagtcactatattcactttgtgtgtgtatgtgaggggtgcttaatttgcatagacacttccatttttgtcctttttttctttcaggttgctaggaagaggctcaatgtttgtgttttcaccagatcagtttcagagactgcttaaaattaatccagactggaaaacccacagacttcttgatttaggtgctggagatggagaagtcacaaaaatcatgagccctcattttgaagaaatctatgccactgagctttctgaaactatgatatggcagcttcagaaaaagaaatacaggtataattttcttggttttagatgcatttcttcttgaaagtatattatttaaaggatatgaataaaaaatgatcttccatgattagaaatttaaaaaatcatctcatacataattaactggaaatgtagagaaataatcttctggtagcagtatttttctggagcggaggggttggcactataggtaagaaaagcactagcgagagacaacttggaaaaggcagatcagaagaagggacttcttccctaatcagaatgtggcattctcaaaaaaaatttttttaagtagtggtaaaatacacatagcatagaatttactgttgtaactatttttaagtgtacagttcagtggtattaagtacatttacattgttgcataatcatcaccactattcatctccagaaatttttgtcttccgaaacggaaactctgtacccaataaacaataactccccatttttccctcctcgtaacccctgacaaccaccattctactttgtctatgaatttgactattctgggtatttcgtataagaggaattatatacattagctccttgtgactggcttatcgcatgtagcataatgtcttcaaggtttactcatgttgtaccatgggccaaaattttcttttcttttcttttctttttttttttgagatggagtcttgctctgtcacccaggctggagtgcagtggcacgatctcggctcactacaacctctacctctcaggttcaagcaattctcctgcctcagcctcccaagtagctgggattacaggcatatgccaccatgcctggctaatttttttgtagttttagtagggatagggtttcactatttggccaggctggtctcgaactcctgacctcaagtaatccaaagtgctgggattacaggtgtgagccactgcgcctggcccaaaattttctttaaggatgaatgataattcgctgtatgcatgtaccacattttgtttacccatttatctgtcagtagatatttgggttgtttctaccatttggctgttgtgaataatgctgctatgaacatgggtgtacagataccgacttgagcccctacttttacttcttttgggtatagacccagaagtggagttgctggatcacatggctaagtctgggtttaattttttgaggaattgcaatacttttccattgctgctgcaccattttacattcccaccagcaatgtagtacaagggtttcagtttctccactccttgacaatacttgctattttctgttttgttttgcttttagtttatagtcatcagtgttaatcttggttttaaggtcatctggagtttgaaagactaggaagaagggccttttttttttttctggagatgaagtttcacttgcccaagctggagtgcggtggcgtgatctcagctcactgaaacctccacctcctggattcaggcaattctactgcctcagcctcctgagtagctgggactacaggcacatgccactatgcccggctaattttttttttttttttttttttgtatttttagtagagacagggtttcactatgttggccaggctggtctcaaactgctgacctcgtgatctgcctgccttggcctcccaaagtgttgggattacaggcgtgagccactgcacccggctggaagaagggtattcttatttcagtatgatttattgattgggagatttctatatattggctcagtgcagaatcagggaggtagagctggagtcagcctttctctgtgatatttttggaagtctggttagccttagaaagaaaggagaagaaattatgtaatcactcactttcctatccacatgtttctacttttacagattaatcctagagatagagcatcagtgtagcttttggagcaggactggtttgagcatttgcaaaacatggagatttttagcctggagaagggaagatttctgtgaacagatacgctgtgggatttttatatggaaggaaaggaataggtatagtctctggtgtaatcaggcacagctacgccttagaagttgagttacagcttagggagatcgaccttcctagcttgaactgtttaagtccttatcactgtcagtgtttaaattgctgttagggttgttataggaagagacataaggaaggtgtgagtttgaactgagtgatttgaaagccccttagctttagcaagctgtctcagataaggttctggtgggtctgcatggtgataattgacatgttttccttcagttagagattaattcggcatttcaaaacttagaatgctttgacctttgttataacagtggcttaagtcaggctgaattcctaatctgattccacctcccccccttaaaaaaatccatgctttgaagtgggtcgaagaggaaggtgttaaacccatcttcagatgattgaccgccccagccttcttttgctttgatgctaagtgcctaaatggaattttcagggaaacttcagatgtttgaaattagtaatatatctggagtgtacatggtatgtaaagatatctaccacataaaaaatacttggtttaattttttccctaatatacagcacataagccaaaaatctgcagtttgacctgcatgggaaattcatactgattggcattcctttcataatattagtatgaagtgaaaacattttcacaaaagtggtaaattttgtgactattggtgcagtttgaggttttaatgaggaagtagtatctttatttcctaagattagaggtcacccaatccaagatggcaaggcagactttcagctgaattttacatttttttcttccttttgagattagagctattttctatttctcttcaatatctgggccatgaaaaacaggctttttattaatttatatatatatatttttagagacgggtctctctctgtcacctgggctagagcatgtggcgtgattatagctcactgtagccttgaacttccgggctcaagtgatcctctcacctcagcctcctcagtagctgggactacaggtgcctgctaccatatctggctaatttgagagagagagtgtgtgtgtgtgtgtgtgtgtgtgtttttgtgtgttgtgtgtgtagagacaggagtttcattatgttgaccaggccagtcttgaactcctggcctcaaacagtcctcctgccttggcttcccagagtgctgagattacaggcatgagcaaaacacacctttttaaataaaggttctgtaattttttttttttttgagacaaagtctcgctccatcaccaggctggagtgcagtggcacaatctcagctcactgcaacctctacctcccaggttcaagtgattagcctgcctcagcctcccaagtagctgggattacaggcgcatgccgccacacccagctaaattttttgtattttagcagagataaggtttcactgtgttgcccaggctggtctcgaactcctgaactcaggcaatccgcccgccttggcctcccaaagtgctgggattataggtgtgagtcactgcgcccagccaaagtttctgcatttcaaaaataggtcaataaacagaaaatggccaggtttttcctttgtattcgcaagttgtcattgtttatgccagaaaacccaattgtaaaactaaaggatgtggttttgatttttacagcaagacagttttctttatattgttagtgtttcattttttatttaggaattatcaaaatacagattgcttatttcctaagtttagagctctcccaacccgagatggcaaggcatctttttttttgggagacggaatctctccctgttgcccaggctggagtgcagtggtgccatctcggcttactgtgcagcctccgcctcagcctcccgagtagctgggactacaggcgcatgctgccacgcccagctaagtttttgtattttagtagagatggggtttcactgtgttgcccagctggtcttgaactcctgagctcaggcaatctgcccgctttggcctcccaaagtgctaggattataggtgtgagccaccatgcctggcctttttttttttttttttttttgagacaggatcttgctttgtcgtccaggctggagtgcagtgacacaatcatagctcactgtaacctcaaactcttgtgttcaagccatcctcctgcctcagctgcccaagtagcttagctaggactacaggtgtgtgccaccatccttggctatttttaattttttatagagatggggtcttgttgtgttgccccagctggtctcaaactcctaggctcaagcgatcctcccaaagtgctggaattacagatgttagctactgcacctgactgctttatcattctctaaggagaaatatattttacatccttctggaagtattaactcattttcttgaaaataataatcacttgaatagataccctcattctaggtttagaaatactgttttagaaaaaggaaaattctgacaacttgttaggattcctgggctaatacgcagttttagtggggctaagcaatttgtcttcatcagtggaactgagtgagtttacaaataaaaatcacaaaacagaagtaagaatgcacttgagcttctataggtatagatttaactgtcttagtgttagtcacctttttgtgttatgagcatatatttctcttccaaaattaccaacacagaggctacctatctgaaactcattctgaggtaggtttagtgagattattctagattagaacatgctgatgatgtttggcttctgcttcattgcagatagacatcagattttttttgttgttttgtttttaaaaatcaaatatataatttgtgttttacaatttgtgtctttaaattggctgcttagctaaggcgttaatatatacaaatagtcctttctttattcatttccattttttagaatgggaattgatgacatttttgttctgaaagtagtcttcttagtaatgtttggaaactcttggaatgagctaaattgaatttccaaaattgctattacagttgacttagtacaacaaagtgattttaaagcctgaatgctctacttatttcaaacagtatttagtgcaatgaaacacctgcaccagtaaggaatctgactagtccctggaagtttgttaggctgctatttggaagaggctttagtttgacaaaaatatagattgaaaagaaaatgcagctaagtgctttgtgtttttaaaattctgctattcagaaatgctctaaatatcattatgctaatgaggttttcaaaacaaccctcattatacttttagaattttctgagctatcttactgtatctgctcaacattactaaagacttgtttaccaaagatcctttttttatgtttccttttttacctgtctctatcataacatatctcacctaccacattctgattggtataaccaagcaggagtaagtaatttgtaaaattgcctaattgtgtggctaacaaagactcttgatataaaaactccccctttctagagataacaacattgtagaggactgaaaatgttctctgtgttctgtgtacgtgtgtatgaaagtgagagattgaggatcgagagtggtttttttttaaaccatgctcttaatgttaataggatgtcctgggctttatcttttctgtatagtttttgttttgttttgttttgttttgagatggagtctggctctgtcctcaggctggagtgcagtgatgtgatctcggctcactgcagcctccgcctccctgattcaagcgattctcctacctcagcctcccgggtagctgggattacaggcacgcgccaccacacccagctaatttttgtatttttagtagagacagtgtttcaccatgttggcctggatggtctcaatctcctgacctcatgatccgcctgccttggcctcccaaagtgctaggattacaggcgtgagccaccgtgcccggtccttttctgtatagttattcagatatgaagattctcaagtatgaaatatgtctttcctgggaacggaaatgtgctcaaaggtcataagttatcaatggaaattattttataccactcccagccatttttaagaatagaagggatcctaggaatagaaaacattaattatatgatgcattttttgattaagttccaatgaatggtaaaaagctggactcttgttcattaactgatattcaaaagaatttgatgttttagtttcataactttgtcaggttacatcttcatacttattaaacatgattagttcttgtaaaggaaacttcgtatgtgttgagatttggaaataggtgaaatgctaaatttaaagaaatatgggccagtcgtggtagctcacacctgtaatcccagcactttgggaggccgaggcagtcggatcgcttgaggtgaggagttcaagatcagcttagccaatgtggtaaaaccccgtctctactaaaaacacaaaaattagccgggcatggtggcaactgcctgtaatctcagttactggggaggcggaggcaggagaatcacttgaacctgggaggcagaggttgcagtgagccgagattgctctactgtactccagcctgggcaacagagtgaggctgtgtctcaaaaaagaaaaaattaaaaaaaaaaaaaaatggttgctatttttctcttccttggccatgtcattattgcaaacataaattataacagaagattttgaacttaatttagaagacaaagttaaagcctttattgtcatctcagttatttttaaagatgtctttagagggactttatgttaatacagttatttctgatttttctagagtccttggtataaatgaatggcagaatacggggttccagtatgatgtcatcagctgcctgaacttgctggaccgctgtgatcagcccctgactttgttaaaagatatcagaagtgtcttggagccaactagaggcagggtcatccttgcccttgtcctcccctttcatccctatgtggaaaacggtaagtgtggtcagtcaggctagctcttactgaggatagctgtttattggtatttgtgattttgtgctgtgtacaattaaatattgtctagtatgtcttataatagcctgcagtttaaagtaatccagttaatccatgtaaaacaccatcttggttaatgttcaccttaaggtggactttatagaggtctagcattccccttgcagtggtaataattaatatttagctgggtctgactgcttgagattgaaagctaaaaatgcaactgtatctctggttttaaatggagcttgaaccatttatttattagctttacaactgaatcgagcaataaacagtgcctttaaatctggtcgtatatacttgctgaatgtcatggctgttttgttttccgttttgcatctcttgtgccagactctaaaaatgataaatgcttttatctgtttttttctcttttgaagaccatgtgtgttgttgcagcatgtatcatttctttctgtaacatttgattttttgattgcatggtcttgctcttcagcaatattgaatgaagaatatgttagaagaaacgggttgatttcatatcacttcatagttactgtgacttctggccattctgacttaatgccacattaagttatagttttagtttgtgtggtttgcattttaggtcatcttgaaagttatgattttaagtctcctgcattttcataagttaatgtacattaatataaaattatttattttatgaataatacaagttactatttaaaaatcttcagtgtttcatttatttttttgagacagagccttgctctgtcgcccaggctggagtgcagtggtgcgatcttggctcactgcaacctctacctcgtgggttcaggcattctccggcctcagccttctgagtcccaagtaactgggacttcaggcacatgccactatgcctggctaatttttgtattttcagtagagatggggtttcgccatgttgaccaggctggtctctaactcctgatctcaggtgatcctcctgtctctgcctcccaaaatgctgagattacaggtgcgagccaccatccctggctgaaaaatcttcagattttctatttcactgcctcgattgaccttgacttcagaaactcttaagagctcacagacattttgaagaaatctattaggattttgcaaatgtcattattatcaaatatgaaaatctatgtcttaaggaataatgcccgtttcatataaccattggattctgtgtggatttgtggtgtcacaaattaatttaatttcttgtatgtgttttttctccccagatcttagtgccttcagatttaatgcttgtcttaatatttaccaaatggtttcagatttgtgttgataatggggaaaatggggaattctttcgatatagaagggtgtggaaaagagcagagagaacagatctcccctttcccatcttagatctccatttttatgttcctgttgtcgagtggtttgtcatggtaaagaaaaaatgcttttaaatgtgagtgtatatatatcatctatatgttgcaaaatgtcctccttcgtgattcagcaacctgatcttacttcagtgctactccttcctgtgtaattaagcctcagctccagctctctgtattgcactcactagtcatcaggttggaaggtcctgggttcctgtgtcctgttgggcaaccgcatgatagaactttaatgctacttcctggcatagcaggagatgaaagagcagggggaagaaacatcaatctaaccacgaattttatttccttgtgtttctgatgctaaaaatggagaggaagtcaaactagacaagagggaagtctccatgaagtgtggaaaacaagctccttgattgtggatgtgcagagctgcctgttgagtctgaggagtctggcatgtgacacactgcagacctgagacaagaagccttgttgctatgggtgacttttagtgacctataaattttgcaggcgcgccacggcactctattattgctttctttctctgagtcactaattagatcctgatgatttccatgtgaaaccatgaggactgggagatgcaaaatggttttgctgtgtagattcatgaatgctggactgttggaggatatctgagtgtgctttgcatacttggcttaatttgtttttttttaactaaaagtagttgtaggtgaaatgattacttaggtaattgttttggtaaatggcttgaagttgaaccacagcagttttgctatttggaaaaaaaatgaaaaaaataccattctaatttcagtttatttggtttactgacccagttttggctaggggttattgaatctagtgagaattattttaagcaccccccaaagaaggaaagatatgaagtcaagagaaggataattatattgtaaaaataaaaatttaatgatgtttaatttttcaaaattgtaatttttattaaaaagtaattcagtaattaaaaaaaaatacttcaagcaacttactagagggtttacaataaaaagtttctgggctgtgcgtggtggctcatgcttgtaatcccagcactttgggaggccaaggcaggcagatcatgaggtcaggagatcgagaccatcctgagttaacacagtgaaacaccatctctgctaaaaatataaaaacaaaattagccgggtgtggtggtgggcgcctgtagttccagctactggggaggctgaggtgggagaacggcgtgaacccaggaggcggagcttgccgtgagccgagattgcaccactgcactccagcctgggtgacagagccagactccatctcaaaaaacaaacaaaacaaaaaaagtttctcatccagtccagttccacaatcttgttcaggtttcttgaatattctttaaaagatagtctatgtaaatgtaagtctgtatgtacattaaaaaaattatacaggcagttcccaattataaataacttctgttgcctttttccacttaaatgtatctaggaaagtagttcttaccagcacatatgtctccacatggttgtctacatgtaagctgtagatgctggagctggcgtggactggttcatgagagctgattgttgttttggtaggaatttaagtgaactggttgttaaacatggccattattgaaattgaccatgatgggagtatttacactatagaaattggcaaacactgcaaatagccattttcttctccaagctggtagttacacatttaccagcacaccactagatgtataactttactagaggaggtctctagatagcaatttgcttagtaatgtttaaaaacaaaacaccctcccctgtcctcccccacttttttttctttctttctttttctttcttttctgaaagggacttgctctgttgcccagacgggagtgcagtggtgctgtcacagctcactgcagccttgacctcctgggctcaagctattctcccacctcagcctcctgagtagctgggactacaggtgcataccaccacacccatctaacttttgtatttttttggtagagagggcgtctggcggcgttgtccaggctggtcttgaactcttggaatcaagtgattggcctgccttcgcctcccagcgtgttgggattatagatgtgagccactgcacctggccttgtttctaactttaatgaaaatattactactttaaatatgatgctaattttttttttttttacttgaagttgctgttgtttggcttgagatgtttcttttttttttttttggagatggagtctcactctgtcaccgaggatggaatgtggtggcacgatcttggcttactcactgcaacctccgcctcctgggttcaagtgattttcctgactcagcctgctgagtagctggggttatagatgtgtgccaccacacccggctcatttttgtatttttagtagagacagggtttcgctatgttggccaggctgatcttgaactcctgacctcaagtgatgccccctcagtctcccaaagtgctgtgattacatttccctcttaaagttgtgttatagactgcgtgtttgtttgtgttcctcccagatatatattttgaggcccccaccccccatcgtgatggtattaggaaggggtctttaggaggtgattaggattagatgagatcatgagagcagagccttcctgaatgggatgaatgcccttttaagagttccgagagaccttgcttctctctaccttctgccatgcaaggatacaacaagaggtcagcagcctgtacctagaaagagggtcctcaccagaactcataaatttctattgttctgtgtctggaattggtgggttcttggtctctctgacttcaggaatgaagctacaaacctttgcggtgagtgttacagttcataaaggcggcctgtctggaggtgttagttccttctggtgggttcctggtcttgctggcctcaggagtgaagctgcagacctttgcggtgagtgttacagctcttaaaggtggcacggacccaaagcgtgagcagcagtaagatttattgcaaagaacgaaagaacaaagcttcctcagcatggatggggacccagcaggttggtgctgctggcttgggtggcctgcttttattcccttatctggccccacccacagcctgctgattggtccattttacagagagctgattggtccattttacagagagctgattggtccgttttgacagagcgctgattggtgcgtttacacctttagttagacacagagtgctgattggtgcgtttacaatcccttagcaagacacaaaagttctccaagtcccctacctgattagctagacacagaacgctgactggtgcgtttacaaaccattagctagacacagagtgctgattggtgtgtttacaaacttttaggtagacacagagtgctgattggtacatttacaaacctttagctagacagaaaagttctccaggtccccacccgacccagaagcccagctggcttcacctctcaatggcactggctgcgggactttgcggcacctagcctgggcactccgacagcccagtgggagcttgtcccccgatcaagcccagcaggcgctggctggtggcgccaagtgcggggcctgccgagcctgcgcccacccggaacccacgctggctcccgcctgcacctctcccttcacacctccctgtgagcagagggagccggctctggcctcggccagccccagagaggaggcccctacagtgcagccgtgggctgaagggctcctcgagcacagccagagccgacgccgtggccgagggggcgccgagagcgagcgagggctgctagcacgttgtcacctctcaatcccccgtctaaacaggatacccccaactgctgttgggaatttggctgatgaccactctagctacttcctgctggataggggcgaagaaggggccctgcagttgtagtgtcctccagaggggaactctttaggccagtggaagggccagcgggttggtccaggggtcctcggtagaagttgttagttgagctcatttggggttccatttgtaagaccatctatagcttgatggcctccattctagaggaaacaaatttgacaagaaggttaaaattacagggcccaaaggtgagtaacagcaagatggctgccacaggacctagaaaggggagaagccatgttgcccaactccagaggttggtacaagagtttgaaaggtggtgtctgatttcagaagccttttcctgtaaacgctgggcggcatctcgtactatccctgcctggttagtgtaaaaacaacactcttctcctaagaaggtgcagagtcctcccttctcagcagtgaggaggtctacgcctcaggggttttggagagtcactattgccagagagtctatttgggattgtagagtatggatagattttgttatttcttgcaaactatctgagaaatcctttgatagtgtgtaatagtaggataatgaagtagataaactggctattccggttcctgtagcagtagccattcctaaccctataaataggggtattagttgtatggctctgtgctgacggacttgagctttgaagagtattgatagggtctgatttccacaagattagaagttaggataatatatgtttacactgttaacttttagcaaactttacttttgttgaaaaccttttaagtttgggatttcaattattctttgctattaataagacctcgtttagtgtatattaacttagaattggtatagatggctccttcctgattctgtaagtactttaaggctcagctgagtgcaaacagcttgcaagtttgagcagaccaattattaggcaattttcctaactctgtttctacaagagtttccttatcatttactgaatactcattgtgtcgtttttccttaatcgcccgggaggaaccatctatcgtcctgtcctgaagggagttcctcctatgtctgattggacctttgtatggtgattaagatttagatcccctgttaggaaacctgctgggttaaggatttttgataggaaggctatgggttgtcagtggcctcagtgctttcgcgctacgcccttgtttacactgacaacaaggtggtattggagtgttacagggttacagagaagaccttcaattatcaattataggttttaactttaccctggcttttaaaggaatagggtacactgttttttctttactacttccatctctctttctctttgactttttctttgtctctctctctcactgactccctctttgtctctgtctctttgactttgtctctttctttctttctctctgactccctctgtctcttcctctcttccctttctgctggtttttccctgcctctgccagccacttatcctgctgttctcccctctccttccccttttgatggctttggcagtgtaagactgccgcctccttgggtttttgcactgcatgcaaaaactccataattgccttgtggtatttaatgggggttccccccagaggttaggaactccctttctttccatattgcagcattggcatgtaggattacataagcatacttgctatctgtatacacatttattctttttcccttttccagttctaaggctcaggtaagtgccactagttatgctaactgggcactggtccctgggggaagaggcttactttcaagtacggttacatcatgaactatggcataatctgccctttgtatcccattctccacaaatgaacttccatcggtatataggttaaggtcaggattagctagggggccttctaagagatcatctcgggccacataagtctggactataatttattggtagtcatgctcgattggttcctcatcctctgggagaaaagtggcagggttgagggccacgcacatacgtatttgaagcactggtccctcaaggagtagtgcctggtatctaagcaggtggttgtctgatagccataaacttcctttggcacctagtatgccacttacatcatgagtagtccagacagtgagatcctttccttgtattattttgatagcctctgacactaagatggccaccgccgcaactacccgtaaacaggccagccttttgctactacatcaatttccttacttaggtatgccactggttgtggggtcatcccacaagtctgagtaaggactccaagagctatccctgctctctctgtgatgtataaagagaagttttgttctgtgggaaggcttaaagtcagagcttatactagggcctgctttaaggttttgaaggctatttctgcctctggttccccttctactagatgagtatttgctctctgggtctcctcgattagagtatagaggggcctggctatctcgctgtatctggggatccatagtcagcaaaagcccgtgattccaaggaacccccgcaactgttttaatgtcttagggcaaggataagccagtataggctgtatttgttccttgctgagggccctcattccttgctgagggccctggtccctctggctaagattaggtctggatatttgacctgctgtaggcaaagctgggcctttgacctagacaccttgtacctttgattagctagaacgttcaagagatctagagcagcctgctggcacgaggcttctgaactggtagccaaaagtaaatcatccaaatactgaaggatcagagtgtctggacttgagaagtgtcctagatcttgggccagtgtctgaccaaacaggtgagggctatccctaaacccttggggcaagactgtccacgtaaattgggatgtgtggtctgtgggatcctcaaaggcaaagagaaactgggagtcagtgtgcagggtaatacagaagaaggcatccttgaggtccagaacagtgcaccattctgcctcctctggtatttaagagagcagggtataggggttgggtacaactggatatagaggaattactgcctcattgatgagtctaagatcttgcactagtctccactgaccgttcagtttctgtattcctagaattgaggtgtttcagggactgctgcatttccatactaagccttgagcttttaaatgtttaacagtatcctgtaatcctttatgagctttaggccttaagggatagtgcctttgataaggaaaagtggtggggtcttttagcctgatttggactgggcgggcatttttttgcccttccaaattgtccttccaatgcccagacttcagggctgattccctcttcaagtaggggacaacagatgggtaacttgttccccatattcatgtagataatagctccagctttggctaatatacccctccctaataaggatgtgggactttcaggcttaacaagaaaggcaagtgaaaagagcaaagtttccaattacaactgaggaggtgggagaaatacctggttacaggctgtcccaggattcctcggatggtaacggaccttgaggacagtcatctggacaggagattaacactgagaaggccacaccagtgtccatgaggaagtcaatcctggcactcaatagttaagcatacctggggctcagtgagtatgatgacatgagctggcgcttgccccgggcaccctcaatcctgttgttggatcatccggttgggggcttctgacccagagaacctttgtcttctggggcagtgcaccttccagtgattgccccagcatagtggacatggatgagggggcggcttatttctcattggacaatctttcttaaagtgtccttgtaaaccacattgataacaagccctaccgggtgattgacctgccccattttctgtcctctctgaaccaccaaggtttgtttgtctgaaggctatgactaaggctgtggcctttctctgatctcacttttccttttgggcctgtccctattatagaacaccgaggttgccaggttaataatgcctccagattttgttcagggcccagggcttgcttttggagctttctcctgatatctgcagccgattgggtaataaacttaccttttaggatcaattgacccttgagtgatttgggcgacgggagtatattttcttaaggcctcctgtagctgctcaaggaaggcagaaggattttcttcctttccctgagttacggtggacagcattgaataattcatgggctttttcctaattctccttagtccttctagaacacaggtcaacagatgtttacgactccagtccccatgatctgcatcaaggtcccagtggggatctgtactggggacggctggctgaccagtagggaatttatccctttcttcggctgtcatttacttgactaggataccaggtatctccaaactctcgggctgcagctaaagccgtattcttttcattaaaggccagggtttgatctaacagtagcatgacatctctccaagcgaggttgaaggtttgccctagaccctgtaggacatctgtgtacctatcatgatcatctgaaaacttccccaggtctgccttgatctgctttaaatcagagagggagaaggggacatgtactcaggttgggccaaattcccctccccctacagcttgaagggaacataaccgatagcctggggaggtttgtggtcctttggagatttctttgcttatttccttctgggcaggggagattagaggaggattatcattaataggagggggagctatagggaggctaggatatggggggtaagctgagcggtcctcctgtgggatgtaaattgcaagctctgtatagttgtgtattctcgtgtattctccttcaatgaaaagaaagcttggacataaggtatttcactccatttgccttccttcttacagaaaaggtcaagctgcaggatagtattgtaatttctacttccctcaggtggccatttttccccatcagagagagaatattggggctaggccatagtgcagaaaaaaatgagccgcttctttttcagggtttgtgggtcaaattggtcccagtggcttaggatgcatttcaagggtgagcctgttgatgcctgtttcccatctgaaagacaaaaccgcctgtgtttttggtttgttttgtttctccccctgcccaagaacctgcagcagtccccggaccctgctaattggaatagttgcgctcaccgaagcagcagcagaaacggtagttttcctcccagaccacaaggaggactgaggaaggccggatttagtggcccttactgacgcattctcgaaaacctgcacccttgcctgtcctcgtagaccacaaagactgagaaaaattggatttagtggcctttactgatgcattctcaaaaacctgttagagtcctaagcattctcctgttagtattgggaccttacctgtgtcctataaagatgttgtgcctcaaaaatgaagtggagggccataccctgagggagggaagggatctccagggttggaagagtgacaccttttgtcctcacttatatgaataggaaggatacaatttctgaggctccccatatcctagcttcaggaatagcatttgttaggcctgcttttctaaggagggatcctaaaattccagagttccccctatgacggggctttgggcaaaaattatgtctttctgattggtgagcccaggtgcctaaagaagggagtagactcctggagtttatactagaaatcatcctcataggagaaactggaaaagcaccagagacagggagtgattttgagaagtgggactagcctcagagactccaagaggtgagaggaagtttgtctgacaggcgttaggacccaggaggcaagggtcagggtagatagaatagatgggctagtctcgcttgggcgacattgagagttctgctcatggccgcagggtcaaccaacttcttgttgggaccccggagctgaatggctttcctctctgtcgaccctcggttcagcccagaagtactggaaaggcggaagctggttccaggccaaccaccgctcccaactctgaagagtcgggggttgttagccctttcccagaaagcctgacacccatgtctttagcccggtggctgcgctaatcacttttaactggctgacaggtgcccagtatttagcccccgaactctaaggaaaaataggacagaatagcaagtgaaaagggtccgatggtacttaccgcttggcgataggcgatagtctcaccacttggcgataggtgatagtcccatctgggtcgccaaaatgtgtctggaattggtgggttcttggtctcgctgacttcaggagtgaagctgcagacctttgcagtgagtattacagctcttaaaggtggcacggacccaaagagtgagcagcagcaagatttattgcgaagagtgaaaaaacaaagcttccacagtatggaaggggacccgagcgggttgctgctgctggctctgttggcctgcttttattcccttatctggccccaccaacatcctgctgattggtccattttacagagagctgattggtccattttacagagcactgattcgtccgttttgacagagcgctgatttgtgtgtttacaaacctttagctagacacagagtgctgattggtgcgtttagaatcctttagctagacacaagttctccaagtctgctacccggctagctagacacagagcgctgattggtgtatttataaaccattagctagacacagagcactgattggtgcgtttacaaacctttaagtagacacagagtgctgattggtgcatttacaaacctttagctagacagaaaagttctccaggtccccacccgactcagaagcccagccagcttcacctctcaatggcactggctgcgggactttgtggcacctagcctgggcactccagcagcccagagggagcttgtcccctgattaagcccagcaggcaccagccagtggcaccgagtgctgggcctgctgagcccgtacacacccggaacctgtgctggcccgcgtgcgctgcgcgcagcccggctcctgcccgtgcctctccctccacacttccccgcgagcagagagccagtccggcctcggccagccacagagaggggtccccacagcacagcggcgggctgaagtgctccttgagtgcggtcagagcggacaccgaggccgaggaggcgctgagagcgagcgagggctgctagcacattgtcacctctcaataagccactcagtctatggtaatttgtttttgcagctcgaagtaaaacaagttgtttcagtattaattcttttttaattgtcataggaaacccaaatctaaacagaaagttacagcttaggctgggtgcggtggcttatgcctgtaatcctagcattttgggaggccaaggtgggcagatcacctgaggtcaggagtttgagaccagcctggccaacagagtgaaaccccatctctactaaaaatacaaaaattagccaggcatggtggcagatgcctataatcccagctactcaggaggctgaggcaggagaatcacttgaaccctggaggcagaggttgcagtgagccgagatcacgccattgtactccagcctgagcgtcaagagcaaaactccatctcaagaagaaagaaaaagttgcagtttaattcttttctggatgctcagatagcaggacaattagtactgttggggtttgttgaatggtctttatggaaaggggtgaagcttcatggtgagggactgaagtatgctacatatctcaatttaaatgctgaaggaacatttttctatagaaacattgttcaattgcatttatagaaggcatttgagggcctactgtgtaccaagtggaaatataaagataaatgagaatcacgcttttgctcttaaaacacagaatagtacacaatatagatagaaacagataatggcaggaaattgtggtaagaaatatgtcaaactaagtactgaagaattagagacgaatagatctgttagcctgtgggtgagttagggaaggtttcatgttgaggtgagctgtgtttgtagtctgaagcattttaccaggctgaggggaacagcatgtgcaaaagcatgaaggtgtgagtaaggtttgtgtgggggtggagcaagttcagtatgacccgaggatagtttgcaaaagaggcctttgattgtatagtgtagcactcagtaaatagtgttggcgcctgaaatcaatgactgtacatcccaaactaatctcaaagctatttccttttggtgtgggtttggttttgttgttaattttgaaatatacttttgaacactgaaatctctgaaactgctaagatctctagaagtgtaattgggaaagaaacttgcttgtagctttaacaaaataagaaactcttcccaaataaaacttattttgaagtttgaaaatatatacttttggtgagatagatgaataaatgaatgaatactgtgtatacaccagatattcttatataagacctagaggaatggaactctttgcgaaagtatattccgtatttcagcttcaaaatcaatctttgaaacacggtccttgcttacatgggaaaggcatattgtgagtcaaatactagtttatctgagggattttgtctcctggttagacaatgaacagtgtattttcagtcctggaattcagtaccaaaatgtaatgactcccagaaatgaaaagcaaatgatcgaattcaacacttctgttcatttcgatggtattagtgcttgcccttttttgcagtctggcttagaagctcattactttacctgagctagtggtctcagagtggggaagtacacactgcagagtacacaagacagtttattttggaatatggcaggaaagtattagcattttttatttatattgctgcttatgccattgtttaatttgtttttgtgtataaggtacaaaggtacattttcatgcatataccgtatacaaaacacatgtggccccacacatatacacatgtgcactcacgtgtacacacagatacacacaaaaaaatgaggttccatgctgcctcctttcccctgcccatttttctgggcacataggatcaggaaagtttgatatcactgatttaaaccatcaatgcaaaaacactttcaaaggaatcttaaaatatttaacaattctaagttttataaagaatacaccttaggcaataccagtttaaaagaaacactttattttatttatttatttatttatttatttatttttgagacagtcttgctctgtcacctaggctggggtgcagtggcgtgatctcagctcactgcaacctccgcatcctgggttcaagtgatctcctgcctcagcctcccaaatagctgggattacaggtgtgtgccaccaaaccccgctaaatttttttgtatttttagtagagacgggtttcatcatgttgttcaggctggtctcgaactcctgatctcatgattcacctgcctcagcctcccaaagtgttgggattacaggcgtgagccaccacacccggcctaaaagagacactttaatgaaataaacatagtaggttgtaaggttgtaatttgtgtctaataatgaatgcatacttatgggcactttagatttttttataccaaagtagctttcaaaggacaatttatatcatgttttcttagtgaagtggtaatgaattccataaatatccttgtaccatgcctcctatctgacatttccctcctaaattggttaaaaatcagtattatagactgtgcgcggtggctcacgcctgtaatcccagcactttgggaggccatttcaggcagatcatctgaggtcttgagtttgagaccagcctggccaacatggtgaaaccccgtctctactaaaaatacaaaaaaaaaaaaaaaaaaaaattagccgggcgtggtggtgcgtacctgtaatcccagctacttgggaaactgaggcagaagaatggcatgaacccgggaggtggaggttgtagtgagccgagattgcaccactgcactccaccctgggcaacagaacgagactctgtctcaaaaaaaaaaaaaaaagaaaagaaaaaaaatcagtattacaaacgtgcttgtaaagtagatgtgttgcccacatcttccctggtgctgttatttggcacaacactgacatctagagtccgttgtggcttatttgttctgaagttacctctgtttaaccttcagctttggattttctgtattttggcttttatggtcttactctagccactatattattctcattttgctgatagcatgatgtaagttactttgcataccctggcaggcaaatgtgcgttaccccactgccccattacaacatcagaggaaataactttactaaggtgcttttcaaaatgaatgtctctaactcaaattttgtcacgttgtccctcccaacttattttaattgtgccatgatttccacaaaccataaaggtgattcttccactcaagactgaggcacatggtttggcttcagatcttcaggatggcagtcatcacacatctcatgttgaatgaaacagactcaggatacaagtttaaaatagaattttttttcttggcaaatttggaaggtatttttcagttgcattttgttgggttttagtattttggtaatgactattagttatagtttccttacattctgacatccttctttgtagccagttgtcttttcagtttacctttatttttttttaagacctgatgatatatgttcattaacactgccatagctcctggagttggattttcagtgacttcattgaaaattaaaacgtttctatggcctttcatagttggaaagtactcttctgttttcataagtgttgttatctttctcctgcaataataaataaatagaaagccatgtttaaggttatgtaaccaatgaagccaactgccaaggaacatgcaaaccactgggccatcttggattctgggtcctaagtgtccatatggtaatcttaaaggccagattaccgttttccccatccgtatttagagtaggatgtgggaactgaaaaatactttttttttttgtttggatgctactgtcaaaatcgtggctgggagctttacaattctcacttctaagactgctttcaggccacatacctcggccttgttgttgaaaacatgtcccagcctcagaaagaaaaatgatttgtaattactcagcatggcatcttagtaattagaccacctatctttatgtattcatatatacactgtaggatgaaacgactacttagacaatattctttccttggcaaaaatcctttgtgaaagttagatttttagcgcttgctttggcagcacatacactaaaattggaacaatatagagaagattagcatggcccctgggcaaggatgacacacaagttcgtgaagcgttccatatttttttaaaaagaaaacaattaaagtaaaagttggacttaaaaaaatcgccttatttcagtctcctgatgcatttgccctcttggctgctgtttaagaggaaaatatctttactagtttatcagttcagcttattttgtgctcgctttggcagcacttacactaaaattggaatgatacagagaagattagcatggcccctacacaaagatgacatgcaaatttgtgaagcattccataaattttaaaaaataaataaaaataaattaaccttattttgtatacattttagcttatttgagctatctcatcatgcatcatggaaacaaagtatctgttctattggcattaagataatattttgtttgaagaacctgtttatataagactttaaaggaatactttcaggatgtattatagatatacatgtattcttttcagttcaactccagacactggagaaatacttgttttttaatatcattagctgcatcttttctaatgtgaatttatttttgccttataagtaacaagtaattttttttcataatttgacccacaaacatttgcagtatctactgaacgcctaccactgcatgcaggatactgtacagagtagcttttaatctatccttttaaagcatcattgtctgtattgaaaacattgctcgtgtctaatgtgtttctgaaagtttccatgtcactaagatgccagcctggggctatttaatattgtatcagatgtcttttgttatgtatttattaaaacaggttctatataaaaatacattcttgtgaaagttctctttcagactcttctgaaggaaaacatggttcttgacagctccttggcagcttagttttttcaaacgtgctttatatctgtatttacatttttttttgacattttacacttacagattgctgatttgtttccacatgtctcttatggtatagttcttgagcaatttcctgaaaaatacgccgagcactcttcttctataaagacaaatgagaaaaaaaaattctcttttgggaatataagcgatgataacgacgcatcatcagaacttttcttgctctattgccaccggtcccaaaaactaccccctcccccaacacatatgtgcctacagttaactcttttgtatttgagaactttaaatataatttatggttgagaactgtccaatttaagtcacagtttaccccttgagattattttgtcattgagtttctcaacaataggaaatagtgtctgcagttgaaagttaccttgatattctgtttaaacttaacatttaaatatttaaaagctaaaaaatatttcagttttgaaatcgttacaaccagccacaatttaaaaaatatttttcaagtgttggtctgtaccttttgtgagtcttcttttatttctttgtttcttagagggttggattttgactgccaagaagagaaggaaagtctatgaaacattttatgtactcataacaatggtggcagatatctcatgccctaataagattaaactaacttaatatttaagtgatatacaatgagacttaatttttacatcatttttgagatgcttttactccattaaaaactaattgaacaaactgacgttgattgtaggatttatagtaatcctaacacaatggtatacatctcccttcttatacacatagccaaaaggtattcttttttaataactttagccctttttgaagattttaaggcggcttttagtttcttcatcaacccatttttgttcttaaagactgttcttaaggctttcgtagataacagtaatatctcgccctccacctgcccacacctcacccctacagcagaaagatagcatagtggatggctctcttcttaatcccatgctactgggctttaaagagaaaacagcaaactatgtcccctggctaataatttcagtgatgagaatgtatgatgccttcttccaaagacctcttctgcaggtggtgttccctgcagatgcacaggaaaatgttaattagggagctcttgctgaggcccataacttgtggagagatagaaattatttttcttttgataatattcaaggatatagggacattccatgcaagaggatttgacttactttggagaggagtatgaaggccacgcacacaccggtcacatagacagagagcagtgatacaagagctgtcaggaagctccgcagttccttgctgagcagcttaatttcttaatgacaaaaacagaaagaagcacattgactattaaagcctattctttcaaatacatgtgtaaagtatccttcacactgcgttttagaggtgaaacgtgaacttactctgcttgcctattcgtataaaaactagacctcaaaaggtactcaagtatgtaatagttaaagccagttcatcagttctttaaatgtgttaaaccaaaaatgttactcgtttttaaacattaaaaaaattcaaccaaccatttgtcatattgctaagcatcactttttagataaaggattatttgaagttagataaacatttccagacagtttgttcaagggcatctaaaatctcttttggtagaaacggtttaccagtatcatcaagagtctgcctatgtggttaagatattttcatatgtatttgttaagggtgatatttatagccttggaactagtacacatagctgaagagtcccatctgtgaaagaacctgggaaggccatacattgaggagcgcagtgctcactgcgtgcttgaaagacaggcacttttgccaaatgtgctcttctttctttatgataaaattctggaaatagagttattgaatccattttcacattcggaatttctctctccttgcagaaattgtcttgtgctctgggtagggattaagtaacatgccatgtcttcaattacctgactatttggagtacaaaatacaattagatttgtacttactgtctgaatagcctgtactttccaactaaatatcccatagatgagactgagtgtgatggctcatgcctgtaatcccagcactttgagaggccgaggtgggcagatcacttgagatcaggagtttgacaccagcctggccaacatggcgaaaccccatctctactaaaaataccaaaattagctgggcgtggtcgcacatgcctgtaatcccagctactcaggaggttgaggcaggagaatcgcttgaacccggaaggtggaggttggttgcagtgagctgagatcacgccacggcactccagcccgggcgacagagcaagactcttgtcttaaaaaaaaagaaagaaaaatcccatagatgcttatcctgtgaatgcagtttatgcagcatacatttttatttgtgaaactaacaaattaaccacatctatacaactaaaataaaaaagcttcagtgtgaaaataggagttctgtagaagagacaggaagttgccatgtctgccttaacactttcaattctgcctttcactttcacttcactttatataagccttgcagctttgagaccttcatctttttacaagccatttttccctttgactaacatgtttttagaaggctaatgcagtgagacatacaaatctctaaagctgtgtgtgttttcatatcagtagctaacatttgttatttgctatatgccaggcactattaaaaatgctttaagtgccttaacttatttataatttagctgacagatgagaataaactaaggttaaatgacatttgaatatcaaaagcccattagaaccctcgtagtttaaaagcacaggttataatactggatggtctcccttcctcagagtcctattttgaaatcgaagggctggttgattttgagttcatgttttaacaatctctgctcatcataccagggtccttcctaagggaagagaccccaacaaggcgaggagttgctgctgttctcttttttccttcagaatcatgtaaagctttttctctgaaattccccctttttttttctcgggaatgtcttaatctcagtttactcaagggaatgacttggtgaaattactgataggatttagctatgtttgatgtcctcgctcggctgaggaattgtcatgggttttatcaaatctcaggaagtgagagtcatcactttccgttcactgatgtccaggcagaatgggaagggtcagggatccctgagtagcttctctccaaatctgtgcttattctccatgttgcatagtttctgtgggtccaatttattgatcttttacacttctctagtgctttgttctaggtggtgcattaccagactagttcctgagaaagctgatagttactcaccacaaggttccctttggacatggtactttacactaaatcactgtaatatacaaaagaggtgaacatggttggttaaacatcaccatgtagggagaatagagcacccagcaaatcactgactttgtgttagtggatgttcgagatggattggagtagttcttttgtttttctgagatggagtcttgctttgttgcccagactggagtgcagtagtgcgatctcggttcactgcaaccttcgcctcctgggttacaagcgattctcctgcctcaacctcccaagcagctgggactacaggtgcatgccaccatgcgcggctaatttttgtattttgagtagagatggggtttcaccatgttggccaggctagtcttgaactcctgacctcaagtgattcgtccacctcagcctcaaagtgctgggattacaggtgtgagccaccacgcccagccagttggagtagttctttagtccaaacctcatggtgacttgtgttcagatcacacccatcactggctagggtattaacttagcaaatttatctcctgatttctacatgtgagtgaggtaatgattttacaggcctgaacaagatgcaatgatgcactgaaataaagcctcgctgactgacctcttaccaccagtgtggtccctcctcctgtctgtttagctctcgcttccggcacactggggaatgctattccacagatgtaaattgcactgtcatttgaagtcactctgtttacagtgagggaaacttggttttctttgagggcctccctcactgtgaacttgtctgcctcacttttgcacccgtccaagcacaggttctcaggctggtgagcaccgtagcgaaaccacaggcatgttggttgctcagaagggcatccggttgcggagaaggtacactttatggtgacggcctcatgagtgtagtccacttctaggtaccacggttgtgtgacagagagagtacaggcgcccacagcacctgtgggaggaagcagatgagtgggttaatgggcctgccacctcactttgtgcttttattatatttttgaggtaggaaacccagccattctgttatttttcttaccttaatcccaatataaataagactaaaaataaacaccagtggtcctcacttgccccaactcctcctgttttctgaccttgacctgctgggtcacatgatgtctgttcactggaggccagccctagagaggcttcaggggaacagagtccctgtgcaggaggcctgcatagaggtggcaccgtattggactcagaagtttggggtccatctgtgactcttgctccttacaagctttccttcgatccaatcacttaatctcctgcctgctttcttgtccgcaccctggcctccccagagtgctgtgttcagtgtggtaacctgtgtccccagacgaacgttgctgccgctgatggagcctatgagcagcagcgatgtttgtgctttgtgggagttgagatcgccaggaattcatggccattcacaattgtttctttgtgagcctggtgtccctttgggaaacatgataaaaggcaacatgtacacctgtggaaatgcagccctggcttagcctaccatgtctttgattactgagcagggaccatatgagctcgccaggccatagctaagcagatttggtttctccctggcgtgtgtgctgctttgtaggcccttgtagcatttatcttatttaattaacaatattgtgataaagagcacagacttgagttcaaatcctagctctgcctgttcccagcattataatctcagtatctcagtttcctcattagaaaatggggatagtattgttgacctcatgcagttagtgtgacgttcaagatgatgcctaggaagtgtttacctgcctaagctatagtaagtattaaatacaagggagcgattgctgctgcagccgccactgctactgttcccacagtgtcagatggctgttggagagatggttgtggacgtctagccacaaggtgttcacagagctgggattagtcacccactccagtgtactgtccaccatgtggtgctcttccaagttatgaggattgagtcccccaccttggcctttatatcccaggcatgtgaagctggaaagccactcgagtgcacaaatggaaagacccgccctaaacccttcttttgcggcaggggaggccataggtaaaatagtattggttgagacaaattggaatttgtcaagtttttggtctgagttccgcctggtcatatattcccaaatggtcctatttgtgtgagtttgtcctttgctactgtaaatgaaactgaaaagtcatccaagtggtctgatgcttaattttcagacaggggcttttttctcttagcgtttctcttatggatccccattcataacagcagaggaattaaagttagaatcatggcgtttgtgatgcgagtctcttctcaccatgtttttttgtttttgttttcatttttgttattgtttttggacagagtctctgtctcccaggctggagtgcaatggtgcaatcacggcacactgcaactgtgacctcccaggttcaagccatcatcctgccttagcttctcaaaagtagctgggactgtaggcctgcagcactgtgcccagctaatttttgtattttttgtagagacagggtttcaccttgttacctaggctgatcttgcacccctaaactcaagcgacccgcttgcctcggccttccaaagtgctgggattacaggtgtgagccactgcgccttgctctcttctcatcatgttatattttagtatttgtgcaacatgagatgagctgggagctctgtggtgacctgataaatgcaaaccagacaagagggtgcagtcacctggaggaggcctgcaagcttctctgagcttcgtgtctgtgggaggcccagctcagctccatctccagccaaggggattggattccctctcaagtctgagaaatacaacctcatgtctcctgcccagactcaagcaccttacaagtacagtgaaacattttatagtatatactgagtggaaatttaaaatggaattgggtctgccaaaacttagcaaagttaagcactgtctcagtctcaagtcatctttcagataatgtttttatttttatttgtaaaattatttttaaaaagtggacgattccattatttacacatttttatttttgagatagggtcccactgtgtcgcccaaactggaatgcagtggtgtgatcttggctaacttactgtagcctttgtcttctgggctcaagcaatcctctcactgcagcctctggagtagctgagactataggtgtgcaccaccacgcctggctaatttttttatttttagtagagacagggttttgcgatgttggccagcctggtcttaaactcctgggctcaagcaatccactcgcctcagccttccaaattgggtagtgtttttaaaagggaagccaaagagccaggcgtggtggtgtggccattagtcacagctactcaggaggctgagaccggaggctgattgagcccaggaattccaggctgcagtgagctgtgatggcaccactgcactccagcctgggcagcattgtgagtccctgtctctattaaaggaatagagtctggacgtgcactccagcctgggcagcattgtgagatcctgtctctataaaaggaatagaggctgggcatggtggctcacgcctgtaatcccagcactttgggatgccgaggcgggcagatcacctgaggtcaggcgttcgagactagcctggccaacatggtaaaaccccatctttactaaaaatacaaaaaattagccaggtgtggtggtggacgcctgtaatcccagctacttgggaggctgaagcaggagaatcgcttgaacgtaggaggtggaggttgcagtgagctgagattgtgccactgcactctagcctgggtgacagagtgagactcttgtctcaaaaaaaaaaaaaaaaaaaatagaggttggggtggcggggatagctgactttcaacacttttctttaaaaactagtagtataggataaaaacaggtatttgtaactttggaatttcatatctctacttatttccaccttcttcccaattaggctatgtgtgggagaaaaccaattgtaatgatttcctctgtgagcaggaacttgtgatgaaactgtggttccctcccccaaccagttaggcaacctattaacaaaaaagagaagtttggatatgtcacaccacagcctgcttctgtgaatgatttcttttaagaatcctcatattctaggaattgttttttaaacacagtatccaatgaaaaggttgaagatttatttcctccatggagggaatagaaagattattcttattattttaaaaaaccatattgaggctgggcatggtggctcatgcctgtaatcccagcattatgggaggccgaggcgggcggatcacgaggtcaggagatcgagaccatcctggctaacacggtgaaacgctgtctctactaaaaatacaaaaaattagccgggtgtggtggcagatgcctgtagtcccagctactcgggaggctgaggcaggagaatggcgtgaacccgggaggcggagcttgcagtgagccgagatcttgccactgcactccagcctgggtgacagagcgagactccgtctcaaacaaacaaaaaagccatattgaaagtaggaagagaactaattcttgacatttaaacaaagctgtctctctatctagtaagtaagaagtaagtaaatgtcttgctctgttgcccaggctggagtgcagtggcacaatcacagctccctatagcctgaaagtcctgggctcaagtgatcctcctgcctcagcctcccaggtgggtgggactgcaggtgcagtgcaggtgccatcacgcccagctatttttttttcttgtgtagaaatgggggtctcattatgttgttcatgctggtcttgaactcctgagctcaagtgatcctctcaccttggcccccaaagtgctgggattacaggcatgaaccaccacgcccagcccaaagctttattatattagatttcaaatttctaacatatcaaagtagcgaagtagtacagtcaaccccctgccatcacatggcttcgacccaatcttgtttcttttctcctcccacctactccctcactcccatattattttagagcaaatcccagccattttatctgcatctttcagaatatatctctaaaagacaggaattcttctttaaaataatgctaattaaaatagtctatgaaagtaatatatacttattagcaaaaaacaggttattaaaagtagaagcaaaaagtcacccatagtccttttgcctgaaataactcccattaacattttgatatatttcttcacagatgagaaaaaattaagaactttccccccttccctgccctataatccaaattgtgtgggcaaatctgagattactagatgtattggaaatcctttctctttcatagataaaaaaacagaagtagacagaattttaaaaatagatatactatgggatggctattggagtcatggcagttttttttttcttaaatgaaaagtacttttatagaaattgttctttgaaaatattcagcaaataatcatttattgctttctatgtgcagatcaagtttgtatgataattaaattattgataacttatacctacgattttaagaatattttcaaccctttggtcagattgtctccaattagcataatagcaaagagacttttcaaggttaatatgaaactttttctcagctatttttttattgtctatttctcaggggaaaaaggaaacttatcctcttaggcagttttcataatgttatacatttaaaaattaatctgaaggagcttaaaatataaatgcattaggtgaaaaatagcagttgatttaaataaaatgaaggaggagaagaaaaagaaccttaccgacacaaaatagaatgagattggtttgcagatggcgagcgatgttgcttctgctcgcagtccccatttctgtgtatgccggggcgggttggggtgtgtatttgaaaggaaagttggctttcttttttcagaagggaagaagagctgaagagaggaacctcttatgaaggaaccataatcaggaactttttgaaattgtgcaaggatggcttcaccatttaacattgagattttggcctggagcacatttagaaatgtgcatatcttttttttttccatggattttacagttgtcataggtgttagatgtttctgggtgagattttgatttacacctagcacatatttccaggaaggagtattgtttgacaaataattcgtacttggatttttcagaacagttcagtcactgtctagggtacctgctctgggtgccactctgggccagtaactgctgggaacaaagaacagcagaaggagaagtggctttgtgtagagatgagaaaagttagtaaacaacacattctaatgcagcgaataaataaattgtctgttattaactttttgtactccagttttgaatccaaagacacctgccttccccccttttttgacagggtctctatcacccaggctggaatgcagtggcaagattgcaggtcattgcagcctcagcttcctgagtagctgggactacaggcatgcaccaccacccctggctaatttttttttttttttgtagattctgtgttgtctaggctagtcctgccctcaagcgatccccctgccttggcctcccaaagtgttaggattacaggtgtgagccaccatgcctggcccaaagacccccttttaatgtgttgagaaacaaatatgtgggccctctgtcctctgtgtcctctcccccagcacttagtggtgattcagtaagggtcttctttgtaaagcagcagaaacagactcaggctgacttaaaaggaaatttatgcaaacatttgaaggtagatcctagagtcactgggagggctagtgaatcttgtgtggggtccacagccaggaagaatgcctcaaatcacaccataaacaggtctgaagaggatgctactgccactgccaaacactaggtgccatcagccctgttgtcagcatcgctcaaccactgccccagccccttggtctcactgccattgctccacccccagagaaggagaagctcacatccccactactctgggtcactggctctccattccagggcatgggcaagtgtgcctggcttaggctgcgtgccagtgcctcagctgcacggcaggccaggaaagcggctcccaggccttgtgtctctcccagactctgggcaggcaattccccagacatgggaagagcgtcatctgcaccactgaaaattatgaaaaatctccccaccatgatatgatgtctgtgcccttggcatctgctcatgatatattttctcattaacagaaagttattctcagtctgttttgtttttttttttttttttttttttgagacagagtctcgctctgtcgcccaggctggagtgcagtggcacgatcttggctcgctgcaagctccgcctcccgggttcacaccattctcctgcctcagcctcccaagtagctgggactacaggtgcatgttgccatgcccagctaatttttttgtattttttttagtagagacggggtttcactgtgttagtcaggatggtcttgatctcctgacctcgtgatccgcccacctcggcctcccaaagtgctgggattacaggcatgtgccaccacgcccggcctcaatctggttttaacacttcaacagatgtatgtagtttttgtatcaccatagcacctaaaaagtacccccaaagttaaatatactgtcatctctgtgtgtgtgtctgtagtcagtgccaggtttgtatgtgaatttgaggaccttccctagtccccttgtcccccaggcatctcctgctcataggtttggaaatgactgatagaggcttcatctctagtccaagaaatgctggacggtgtatccatcctactgttccatctctctctggtcctggagcttaatgtttatgaaattgttctgaaaaggcaaagaatgagtcaacttccctagaaaaactccccaatgatctgcttttctaaattaaaatccttcatgagcctgtttttattttcagcctaataaatctctctaggtagtaagttgcataagtttactatgccagtggtattttcttgcatttgtccaaaactgtccttcagatattacatgttgctctctgtttcagtattccagcatttaatgaccagttttccaaacccattaaccattacaccctgcagtcagtctattggcagatactacccaaaactgtcagagaagataacagtgtggggccttggatccagacaaacctgggcttacatttccatactgacactcattaaccttgcaagcgtgggcaagttcttcaccccttctgagtctgttctttatctgcccacctgtctcaaagagtacctgggaagtacaaaagaggtaactcatgaagccctcaggcttggaacgtaccaagtccttggtagatatggctcctccctgcttccctctttaaatcacttgtttgttcaagaatttaactgaatgttcttatttgtattagtaggtggcaagtgggagaaaccatcagaaattttggaaatcaaaggacagaactgggaagaacaagtgaatagtctgcctgaagttttcagaaaagctggttttgttatcgaagctttcaccagactaccatacctgtgtgaaggcgacatgtataatgactactacgttctggatgacgctgtctttgttctcaaaccagtataaacacgtggaggtcgaagtcttcagagtccgcaccctccgggatgtgcccttggaagagggtctgtgttcacaattacgtgaagggaggacccttggggaccgccattctaaatatcatgtaggaatttaaaaagccaaaatactaattatttctttgtagtgtgtaaaggaatgtttttaaaagacaaaaacccaactctttgtggatttttatcaactctttactcagagccactctccaatgcaggtcacactccaattatgatggaagatattttttatacttaattgcagtagggactcattcccagacaaagcaatagtcacgacttcatggaaccaatcaatggattgttttttgaagactggcaataaagctgtccattcaattccaaatactggttttaaggtatagccactgatattctttcatgtttagaaattctttctgttattattcaagaaaatgtttttaatcatgctaataaacttttttggagatgactttggcatcatgtttgaattcatataaagctcccctagcattttttattggtttggcttcaggagtacccaaatagtagcattatgagaatgacgcagacaatttgaataggggggaaggaaggcttcagacttgggggaaggggagattattgcaaattgcagtgaacactgagtcagtaaaaaaaaaaaacagaaacaaaaacccagcctcattcagatacagaacttcagggacccctccccccacccccccagttaatgctgctgtgaaaaatgcaaaataacctggttctgactttgtgatcactcatgtcccatacactgaactttgtttttttctggacaatctcaggttctcagaattgaaacattcagttttgtctactgacaaaatgcaactaaaaatgttttaattcaacttcttactctacacttatatacctctctcccagagcttggctcttccctgaaatccttaaaggagtttattatttgccaagaatatggtttgatgaagaccgtgtcagactcatgcattctggaatccgtgagtgcctccaaccataaacccagaaatgctgccatagaggaacccattagcaagatcaataaccatcgtggatattccaaagagcagagcatttaacccagaatctgaaatctcagtaataacagaaatgtcaatatgagattgtggttattaacaatatgttatcctcactactttatttcttttttcatccaggtgtttcattaagtattctcatttatatgctcatagaagtcatcagatcaacacattcactccaacacctgggtataaaggcgaattaaaacctgaagaattactttattattcattaagaactgcattcccacatcctcacaccaatatcttccactgttactgtgcagtcataataagagttgggttatgtgatttatgcaaaattgttattggtgtgttctaatgatttttttccaggaattcaagtaagtgaagtacaaatacttagcaccatagattgtaaaaatagaaagaggaaatgagaaaacttaatgtcgttcttgtacagttgagttttgcttctttataaactgtctgttaaaatcaggggttgctgttagactgtcaagcagaagtgatggatgttcaaggaggcaggttgccccaaagtgttttctaactttcaagtagagaactttatgctctaataagaaaaatacaactcattcttaaccacccccccaaaacagagaaaacacatacatttatgcattttaaagataaaaagtagtttctcaaaaaaatctgaagttctctgaaaaccagcttattaaaagtgctgttttgtggtgaaaattgaaaccaaatccactcacatttcctatcgggtcttgaaattcttggtggtgtgtcaccattccactagatggcagtgttgcttactgagtgtcaatggcttttttccccgtaaatggaatcatgtttttctcccccaaagtacaataaagctgccttgtctgcaccattcctcgtgtaagtgcttcatatcaagttaagactgtactagagaaattaagaagagctttatttgtggtaaaagcaagctaaccaattgaccttaaaggttgaaatgcaagccacacctctgattcctagctccctgcacctgcattttaagctcctaaagtgctcagaccactgatctcagagaaggggaggaaaggaggtacagtgcccttagtcatttatcccttgtacagagtagttaaaagcagtactgtattttctgccatccagtgtgacctgtcatcagtttttacatggttggcttttaacagaaaaaagttgagttggaaaataaagtgtagatgtttcaagtcttcctgagcaaagctttgttttcacttggttctgagtatagtattaataggctatactgcgtatgttatttacagtattaatgaagcaagatgttttcattaattgcttcccactacttggttactgatggaggtgttacatgatcctttttctccagcaatgtcagtatagtatcatgggcttccagtgactaaagtgacctaccatgttagtgcagatgcttaagcacccccagttaccttatatccagtgcttccgccggctagaagatagtgcatggaatcagggcagcctggactgagttgtactgtctaggagtgcactgagcacaaaactgggctcataagtaacttgagacaaatcaggactatgttgcctaggctggtcttaaactcctggcctcaagtgatccttctaccttggcctcccaaagtgttgggactgcaggtgttagccactgtccctggcctagcactccctttatcttgcaaaactgaaactatgttcataaacacaactctccattgtctccaccccaccctctagcaactatcattctactttctgtccctttgactactctaggtagtcatgatccgccccatgatccagtcacctcccatataattggaattacacagtatttgcctttttgtgaccggcttattcttctttttttttttttcctgagacagagtctcactctgttgcccaggctggagtgcagtgatgcaatctcagctcacttcaacctttgcctcctgggttcaatcaatcctgccttagcctcctgagtagctaggattacaggcgtgcaccaccactcctggctaattttgtatttttagtagagatggggtttcgccatgttggccagattggtctcgaactcctggccttgtgatccggcctcctaaagtgccaggattacaggcgtgagccaccgcgcccggcccatgactggcttatttcacttagcacagtgccctcagggttcaccgatgtagagggtgtcagagtttccttcctctcttttttttttttttttttttttttgagacggagtctctttctgtcccccaggctggagttcagtggtgtgatctcggctcactgcagcctctggctgctgggttcaagccattctcctgcctcagcctcctgagtagctgagattacaggcgcctgccaccatgcttggctaatttttgtatttttagtagagacggttacaccatgttggccaggctggtctcaaaactcctgacctcaggtgatctacctgcctcggcttcccaaagtgctgggattataggcgtgagccaccgcaccggccagaatttccttcctttttaaggctgaataatctattgtatggatagaccatagtttgcttatccattagtctgttggtgaactcttggattgctactaccttttagctgtctgaataaccctgctgtgaacatgagtatacaagtatcttgtgaccctgcttttaattcctttgggtatataaccagaagtgaaattactggatcatgtggtaattctatttttaattatttgaggaaccacaatgctgttttctgcaccatttaacatttttgccaacagttcacaaccgttccaatgtctccacatcttcaccaacattatcttgttttgttttgggatggagtcttgctctgttgcccaggctggagcgcagggcatgatctcggctcactgcaaactccatctcttgggttcaagtgattctcctgcctcagcctcccgagtagctgggattacaggcacctaccattacacttggctaatttttatatttttggtggagatggggttttggggtttcgccatgttggccaggctggtctcgaactcctgacctcaggtgatctgcctgccttggcctcccaaagtgctgggattacaggtgtgagccaccatgtccagcctgttttgtttttttagtagtagccatcctaatcggtgtaaggtggtagcttgtggttttgatttgcatttccctaatgactagtgcatcatttgtttttataatacaacttgtatggcatttggcttcatttactagtaaattgtgctttgtagcttgctatctatatcagtatcactgaattggactcagtattcagtgataacaaaatacttctttttcactgtgaaattgtatacttttggagaacagggagaatattattacataaccgaacttaagaattccctctggatttgggtcagtatgctgtattcacatgaattaaataatatgcttttgttagaaagtcactttaaaattactttcaatacatgtaaaatgaaaagtaagtattttttctctcaagtaaatgcccatgtaaattgggatgtcttatatacctgtacttcttaagttctggaaaataagaacagatagagtgcccaaatgctattttcttatatcctgtttaggattcaacacagaacgctggttttaaacgactgtgaactctcaacacttttccaaatgctagagttcaagtgaatacattggcaattctttttttttttttttttttttttgagttggagccttcctctgtcgcccaggctggagtgcagtggtgcaatcttggctcactgcaacctccacctcccaggttcaagtgattctcctgcctcaacctctcaagtagctgggattataggcatgtgccactatgccctgctaatttttctatttttagtagagatggggttttgccatgttggtcaggctggtctcagactcttgacctcaggtcatccacccgcctcagcctcccaaagtgctgggattataggtgtgagccacctcgcccagcctccatcttgtttttattatttatagggtggccatgactgatcgtaaagccctactggtttttccattataagtaacacgtttgtattagtcctttctcacactgctataaaaacacacttaagactgggtaatttataaagaaaagaggtttaattggctcatggttctgcaggctgtataggcttctgcttctagggaggcctcaggaaacttacaatcatggtggaaagtgaaggggaagcctgcatgtcttacatggtggaaggagaactaagagagaaccaaggagaaggtaccacacacttttaaacaactgagcactcactcactatcacgaaagcagtattgagggggaagtcagccccatgatccaatcacctcccaccagacccctcccccaacactgggattacaattccacacaagatttgggtggggacacaaagccaaaccatatcaacgttcatcgcagaaaaagtataaaatgaaaattaactttacttaccccataaacttgagagaaccactactgacagtttggtttatgccttccagacttttttttttctgtgcatgtatatatacacacatttataaatgtttaaacattaaaatatgtaaaaatgaaaaggtccttttattgttctgagatgagtcatgtgagactcctagacacctatattctaaatcaaaaattgacaaaggatggaagccatttcctgtcatttaaagcttgaggttaagcttttttttttttttttttttttttgagaaagagtctcactgtgtcacccaggctggagtggtggcatgatcttggctcactgcaagctctgcctcccgggttcataccattctcctgcctcagccttctgagtagctgggactacaggcgcccgtcaccacgcctggctaattttttgtatttttagtagagacggggtttcactgtattagccagatggtctcgatctcctaaccttgtgatctgcccgtctcagcctcccaaagtgctgggattgcaagcatgagccactgtgcccggctgaggttaagctttttatttaaaggattaaacaaagaccctggggataaaaggatgtttttgaggatgctggacattagcattatataaattactatcagatgggcagcagaatgctgcaattggtcatttctgaagataatgttttaattgtgccactgacaaactaatgttagcgttgggcatttcaatgattactttgaaatattacgggtattagatgtgtttcgttaaatgtgaaggattgcaaggaaacttcttgagtccacaactattttcattaggaaagatgcaaaacagttatgcataatcctatcatgcaaagctaatattttaatgcattgcctaccagattttttttaatttttttttttgaggcagagtctcattctcttgcccaggctggagtgcagtggcatgatctcagctcactgcagcctctgcctctcgggttcaagggattctcctaccttagcctcctgagtagctgggattacaggacgtgcgccaccatgcaagctcatttttgtatttttagtagagatggggttttgccctgttggccaggctggtctcaaactcttgacctcaagtgatccacccacctcagcctcccaaagtgttggaattagaggtctgagccaccccacccagccttgccttctagttttttgttttgttttgctttgtttttgagatggagtcttgctctgttgtccaggtgggagggcagtggtgccatctcagatcactgcaactgccacctccccagctcatgcaattctcctgcctcagcctcccaagtaacagggattacaggtgcccacgaccatgcctggctaatttttgtaattttagtagagacgaggtttcaccatgttggccaggctggtctcaaactcttgacctcaagtgatcagcctgccttggcctcccaaagtgctgggattacaggtgtgaggctccacacccagcccctagcttctaggttcaataaaagttcaaatacatctatttcttaccattggcttttttgttttggatataaaattatttccttgtgctaattatgtggtctttgttaagaacaattttaatgactgtgtaatccacagcgtttatgtatccatttatttaagcatttcattattggtggacatttaggatgaatttttttctaccactctgtgtatgtatacatctattataggtcatactattatttttattatggaaaattccaagtacataaaaaagaaaggtaataatgaatcctccccaaccagcctcagcaattatcaacacatggcccaccttgtttcatccctactcccactactccttggttccactattgccaagcaaatcccagatgtctcatttcagttttgtaaatatataactgtaaaagataaccactctgaaaagatagccacattacaattattcattaagaaacccggcagggtgcgatggctcacgcctgtaatcccagcactttgggaggccgaggccggcggatcacctgaggtcaggagtttgagaccagcctagccaacatggagaaacccggcctctgctaaaaatacaaaaaaataagcggggcgtagtgatgggcgcttgtaatcctctttacttgggaggctgaagcgggagaatcgcttgaacctgggggcggaggttccagtgagccgagatcgcgccattgcactccagcctgggcgacagagcgagactgtctcaaaaaaaaagaaaaaagaaatgaaagaaacccagccattaaatatccagcgaccacattgctccaattttcttataatttttttttttttttttttttttttgagacggagtcttgctctgtcgcccaggctggagtgcaatggcacgatctcggctcactgcaacctccccctcccgggttcaagcgattctcctgcctcagcctcccaagtagttgggattacaggcgcccgccaccgcgcctggctaatctttgtatttttagtagagccggggtttcgccctgttggcgaggctagtctcgaactcctggcctcaagtgatccgcccgccttggcttcccaaaagtgctgggattacaggcgtgagccaccgtgcccgtcctataacttcttttaacggtttgaattcagatctaaataaaggtcccatgtagcgattggtggatagctctctagtgctccccatcctcgcttcctagctgccgccccgaagagtggctggggagcaggcatttgtgcgtcttgcaagcttcgacagataggaagtcccaggcggggactgtgacccccgccgctgccctggctgagttcccacctgggccgctgcagggaggaggtcgcagagctgccggctggcgccgccccgccgctctcctgcctgcccgctccccgcatgagccccgcggccccgccctgcgccacccgcccgcccgtgggactcagtgcggccaagccgggctccgcaggtgaggcgcgcgcgggggcctgggcggaggactcacggggcaaagcgctgggggagcgggtgggcgcccaccgctgggcctccctagggaaggggtgcaggtgatggatggcgtgggggacagaccgagagaaagagggtgggcaaagtgtgggtgcagcggctttaagggctcctgggattggagggcacttggaggggggggacgatgaaacttcgagaaaagggatccaaaactacttagtaatataataacagcgatgacaactgttgcaataactatcacaatgattatttgttataataatatagcagcagtaaaaacaatagcattagtaataatagctacgattcattgcattcttatatgtgccagtgctgggcttagttctttatgtattttatgtataaagtaatgcctacctcataacagttgtgtggaagaaatggaaaaatgcaggtaaaggccggggctcacacctgtaatcccagcactttgggaggctgaggcaggagaatcacttgaggccaggagttcgagaccagcctggccaaagtggtgaaattccatctctactaaaaatacaaatattagccaggtgtggtggcgggcgcctgtaatctcagctactccggaggctgaggcaggagaatcgcatcaatccggcaggtggaggttgcagtgagccgagatcaggccactgccctccattctgggcgacacagggagactctgtctcatgaatgaataaataaataaataaataaataaataaataaataaacaaataaagttgatagttttttgccagggaggtatgagtgccatgcctactatgcagaggaggaaatgcaagcctatagaggttaaggaatttgcccaatagcacacagctggttaaggtttggttcaggttaaagctggggtcttatccctggggtggcacctgccacctggagttttaggttcagggctgctgagctgacactggagagcaaagccagtgagcgttggaatcatttagctctgggtttgccacctggctgtgcatgcatagctgtgtgaccttgggcaggtcacttgacctctcagaacccatttgctcatctgtgaagtagagataatggtaatgcttgcctcaaagattctacaagaattaagcgagacaatgtatgttagagaggcgtgtacttagttctgtctcattaaatgactgctgggattaaggttactagggagccccacagccctgcatcataaccccctccctgccattcgcttgctgtgtgatcgttcatgtgcactgaactcatctgtgaaactgagtacggtaacccttcaaggctggtggaaagagtaaatggcagggaggagggtttggtgtgatgcccggctcatagaggatgctcagtgagaccagtttcttcctttctttccttcttttcctcattgaatccaaagccatttgttctccggagacttaggagagaagaaggggaatagctgtgcctaaaatctcactattagtggcagggctgggacaggaactcaagtctgggcatctctagtccaccaagctcccatccccttgactgcttgaattttttttttttccagccagggttttgctctgtcacccaggctggaatgtagtgacatgtgatcgcggctcactgtggcctcgacctcccaggctcaggcaattctcctgcctcaacctcctgagtagctagggctacaagcatgcacccagctaatttttaaattatttgtagaaatggagtctccctatgttgcccaggctggttttgaacttctggactcaagtgatcctcccaccttggcctcccaaagtgctggggttacaggagtgagccacaaagcctgggcctactggacttctacaaccactgtgagctgggccattccaacaccaagcatttgtaatcaggctggtattctataagccagacacatttacctattttggattaatagtcatgaaatggcattttttttttttttttttggtggaaaatctcccagctagtgtcagtatgcctagagttatgtgttcatgacccagagcttaaatggagcagccttgcagacagtgaaactccatgtaattgtgaattaatggtttgtgtctgggctggggtgtcccagcaggaggggaacctcctagcatctttgcaaatttcacagaagatgaagtgactctgatccatgggttgaccaactcctccgggtttgcctgtgactttctggtttcaaaatggaaagttttgagtcctgggaaaccttttggtcccgggcaactgggaaagttgatcaccttgcacatccaaacattcatagtttctcaggaaattgtcttcatttcaggtttgtggttattgttgctgttttcgagtagttttcaccacagggatccttgcctgactgatttcctccagtctgcagtgggggaatctttcagtggggaaggggtatggcccatagagaaagctatcgacctccaaatcatcatcgccctgcccagtcctttcagtccttttgaccaatctgctaaaaaagtgacccaaagtgcctttaatgaaaaccagatcctgatgggctgcagtttctcgctggaaaaaggacattatgcacagcagaaagcaaggcgtctgtttcagtaacctgaaacctctctgtagggttaatagaggggcccgagcaaagagcacaagaagccacattgtctgggaaactggagaattgtgaatggggccaatgtcccagggcagctgcccaaagggaagggagaaaaaagggtcaaaggttccccaaagccccaaatgacccaaaccaggaagacttctaattggagttgagcattccagttacaggatggtgatggtgggccaacacacctacaaagtgctttgggatcaggtttgctcaaaacctgttagaatgcagggcttttggtgtctgggaacttcaaaagttttactgtttttgtcctgggcagtaaagtaagcataattgttttcaaagctggttgtggaggtccccttgggggaaaaataatccatttgcataacaagttagacaatacgagggaaatctgtattaaagaatgctgggatggcggctgggcgcggtggctcacgcctgtaatcccagcactttgggaggccgaggcgggcagatcacaagatcaggagatcgagaccatcctggctaacacggcgaaaccctgtctctactaaaaatacaaaaaattagccgggcgtagtggcgggcgcctgtagtcccagctacttgggaggctgaggcatggtaaccccagcgtgggtaacagagagagactctgtcttaaaaaaaaaaaaacaattaaataaatacataaaataaaagaagggctggcaagctttttcagtaagggaacatggaatacatattttgagctttggaggccgtgtggtccctgtcccaagtactcaactctgctatggtagcaggaagctgccatggacaataggccaatgaatgggcatggacatgtgccaataaaactttatttatagacacttaaatttaaatttcacacaggaaattttcatatgtcaataaatattattcttttggttttaaaaaactatttaaacaacctaaaaaatcattttaagctcatgagccacgcaaaatcaggtggccatttccatttggtccgtgggtggtactttactaacccctccttgaaacaataaggactcctttaaaaatataaccacagtttcattatcaaacttaaaactattaacaataattctttaaaatcttcaaatatctaatcaggggttcaaatttcctcaattgtctcacaattttttgggtttttttgagacaggatcttgttctgtcactcaggctggagtgctgtggcatgatcatagctcactgcagccttgaattctggagctcaagagatcctcccatctcagcctcctgagtggctaggactacaggtgtgcatcaccacgccaggctaaattttaaatgtttttatagagatggagtcatgctgtgttgcccaggctggtctcaaactcctggcctcaaacaatcctccgccttggcctcccaaaacactgggattaggtgtgagccactgtgcctggcctaattttttattttattttatggtattttttgtttgtttgctttgtttctttctttttttttttttttttggagacagagtttcactcttgtcatccaggttggagtgcaatgggatgatctcgggtcactgcaacctctgcctcccgggttcaagagattctcctgcctcagcctcccgagtagctgggattattagcatgcgccaccatgcccagctaagtttttgtatctttagtagagatgggttttcaccatgttggtcaggctggtctcaaactcctgacctcaagtgatctgcccgcctcggcctcccaaagtgctgggattacaggtgtgagccaccgtgcccagacatgacgtgtttgaatcaggatccaaataaagtctagattctacaagtgatcaatcttttgtttttgagttaataggttctctttctctctctctctgtaatatattggctaaagaaactaggttgtttgttttggggagttttccacagtcttgatttctctggctgcacctagtctactcaacgtcttggcaatgggggtgccatgggtctcagtccttaaaactcacctaatttctccgtaaatttactttcttggtgatatcattcagggtttaaatacatgctgactatctggggccgggtgcagtgggattacatgcctgtaatcccagcactttgggagcctgtgtcaggtggatcccttgaggtcatgagtttgagaccagcctggccaacatggtgaaaccccgtctctactaaaaatacaaaaattagccggtgcggtggcacaagcctgtaatcccagctactcgggaggttgagacacaagaatcacttgaacctgggaggcagaggttgcagtgagctgagatcgtgccactgcactccagcgtgcgtgacagagtgagactctgtcccccaccccaaaaaaacccccaaaacagaagaacaaacaaaaaagcaaacacaaaaaaccactgactatctctgtttagatagctgcttctgacagcacctctcccctaacctgcaggctcaaacatcaaactgcctacttgctatgctatctgcactctaaaaggcttctcaagcttagtatgtccaaaactgagctccagggatccttccctaaacttggaactcctatggttttcccatctccctctctacatgctcaggccaaatccttggcgttgtctttgacctgtctatttcttttattccctacattcgatcttttggttccgccttccaaatacctccaaaatccaaccacttctcaccaccttcactgctatcaatgaccaagttattgtcatctctttcctagattggtctgcctgctacagccattgttccactccagggtattctcaacacagcaatcaatgtgcttgatccagttaaaataaaagtcagggccaggcacagtggctcacacctgtcatcccagagctttgggaggctgaggtgggtggatcacttgagcttaggagttcgagaccagcctggccaacagggtgaaatctcgtctctaccaaaaatataaaaattagctgggtgtggtggtgggcacctataatcccagctacttgagaggctgaggcaggagaatcacttgagccggggaggcagaggttgcagtgagctgagattgtgccactgcactctagcctgggcgacagagtgagacaccatctcaaacaaaacaaaacaaaaacaaaaacaagtcagagcatccatcctggctaatatcccttcagtggctcccacctccctccaagtaaaagtcagagcgctcacaatggcctgaaagaccctactcactctggccctgatacctctccaaccccatgtcctactgttatatcctcttcgtgcaatttactgaagaacatgcaaattatgctcctaatatcaaagcctttgcactgtcattttcttttctttctggaactttctttctccagatattcccgtggttcattccttcacttcctgaggtctctgcttaaatgtcacctcctcaggtcttccctgaccaaactgtctataatagtacctgctccttctttggctcctttttcctaccctgttgtatttttctccatggcactcatcactccctgacataatatagttatttgattatctattttctgcctggttcattccaacacaccagcagggagttagttttgtaaactgctgtattctcagagcatagaataatgcctggctcacagcactactcaacaaatatttgaagaatgaaagcatgaaataattacacaaacataaatatgtattatagctgtgcttggtgctataaaagagaagtattggccttttcttctggctaattgctttggcctggtcagagaattcagggaaggcttcattgaagacttgaaatttacaatgaattgatcttagccgggcaaagaggaaggggaagaatcctctgggccgaggaacagcctgtgagagggtcttaatctggggaggatagcaccttggagggacagacagatggcccgggcaggaaccttggggaatgaggggcaaagaggagggtgatacagccactggaaaagctttgggctttatcttgagggtaatggggagaggcggagggtgacatgagtttattgagatggtgtttttcaaaacagcatctgtttgaaaacagcaatctggtttctttgcttatttaataaacttgtatacagagctgactttgtgtcaagccctgtttgaagtgattcactattaacaactcattttaccctcatacgacacagtgatgctggtaccatcattaatctcattttacagacgagaaaattggagtgcagagagattaagaaactcgtccaaggccgggctcagtggctcacacctgtaatctcagcactttgggaggccaaagtgggtggatcacttgaggtcaggagttcgagatcagcctggccaacatggtgggagcctgtctctactaaaaatacaaaacttagcctggtgtggtggtgggtacctgtaatcctagctactcaggaggctgaggcagaagaatcgcttgaacctgggaagcagaggttgcagtgagcctacattgcaccactgcactccagcctgggcaagagagtaagactccatatcaaaaaaaaaaaaaagaaaaaagaaaaaagaaaaaaaaaaagaaagaaatatgtccaacattgcacagctagtaagtggcggagacgtgattcagaacaggtgactggctccacagtccatgcttttccatttctgtttgatactgacttttgtgaggtataaatttacaggcaatacaatgcacactaagtgtacagttcagtgagatctgataaatgtatgtatctgtgtgacaaccaccacaatcaagatacaaaaaatgggggctgggtgcaatggcatccacctgtaatcccagtactttgggaagctcgaagggaggattgcttgaaaccaggagtttgagaccagcttgggcactatagtgagaccctatatctacaaaaaaaatttttccatcactccaagaagttcccttgtgccctgttgcaataaacttttcccattgtaccctaataatgccccagaccaatcctaatttgtttcctgtcactgaagattattctaggtaacctagataacctagaatctagatattctagataacttagagtttcacagaaatggaatcatatgttatgtggtcttttttgactggcttcttttgctcagcataagcataatgtttctgaggttcatctgtgttgttgcctatatcagtagtgtattccttttcctatgcatataatatgggttttttccctttgggtgcttaaaaatttattattttatttatttaaaaaattgacatatacgccgggcacggtggctcacgccagcaatcccagcactttgggaggctgaagtgggctgatcaccagaggtcaggagttccagaccagcctgaccaacatggcgaaaccccatctctactaaaaatacaaaaattagctgggtgtggtggcgcatgcctgttatcccagctactcaggaggctgaggcaggagaatcgcttgcacctgggaggcggaggttgcagtgagccgagattgcgccactacactccagcctgggtgacagagtgagactccatctcaaaaaaaaaaaaaaaaattgacatataataattgtacatatttatggggtacataaagatgttttgatgtgtataatgtatggtgatcagtcagggtaattagcatgtctaccatctcaaacatttctcatttctttctgttcagtatcttccttctagctatttgaaactatatattattgttaactattgtcatcctacagtggtacagactactataactaaattaaaaaacaattgtgtggccagggatggtggcccatgcctgtattcctagcactttgggaggccgagatgggaggattgcttgaggccaggagtttgagatcagcctgggaaacatagcaagaacccatttctacaagaactaaaagaattagctgggcatggtagtgcatgcctgtagtctcagcttctcaggaggctgagaccagaggatcacttgaacacaggagttcaaggctgcagtgagccatgatcatgccactgcactgcaggctgggtgacagagaaagactctgtctctcaagaaaataaaaaagaatttgaaataactacagattcataggaagttgcaaaagaaatatcctgtgtactcttcacccagtttcccccattggttacatgttatgtaacaatagtaccatataaaattcaggaaatcatggtacaaattcagggcttattcagatttcactagttttacatgcactcctttgtgtgtatattttatatcgttttcttcaattttgtgacatgtgtagactaatgtatcagctaccctaatcaggacccagaactctcctggtgatcacaagcctctttcatgcatcccttgacagccttatctccctctccccatggcaaataccaatctagtctgcatttctataattttatttcaagaatgctttataattggaatcattagtatataactttcagtgattggctttcttccctctgcataattccctttaggtgcatcaaagttgttgcctgtatcaatagttcattccttttcattgctgagtagtattcaatggcgtggacataccacacacagtgagtttaaccattcacctacggaatgacatttagattggttcaatttttcagctactatgaataaagatgctatgaacatttgtgtacaggttttgtttgtttgtttgtttgttttttgagttggagtctcacactgtcacccaggctggaatgcagtggcgtgatcttggctcactgcatcactgcaagctctgtctcctgggttcatgccattctcctgcctcagcctcccaagtagctgggactacaggcgcccaccaccacgcctagctaattttttgtatttttagtagagatggggtttcaccatgttagccaggatggtcttgatctcctgacctcgtgatccacccgcctcagcctcccaaagtgctgggattataggcgtgagccaccatgcccagcctgtgtacaggtttttatgtgaacataaattttcatttttctgggataaatgcccaagagtgtaattgttgggctgtacgttaagtacacatttaattttataagaaacaacaaaactattttccagaatagctgtaccaccttatattctcatcagcaatgtgtgagtgatccagtttctcctcattctttctagttaatggcattatggttacatttatttatttatttttgagttgaagtctcactctgttgcccaggctggagtgcagtggtgcaatcttggctcactgcaacctctgcctcccagtcactgcaacctccgcctcctcggttcaagcaattctcctgcctcagcctcctgagtagctgggactacaggcatgagccaccatgcccggctaatatttgtatttttagtagagatggggtttcaccatgttggccaggctggtctcaaactcctgatctcaggtgattcacccacctcggccttccaaagtgctgggattacaggcatgattcactgcgcctggcttcattatggtttttttttttttattttagccatctgataggcctataattatactgtggtttcagtggtcattttcctaatggctaacagtgctgagtatcttcccatgtgtttatttgctatctgtatatatactttgatgatatatctgcacatatcttctgctcgttttctgattggattgcttatttattttttagttttaagagtttttcaatatagtctagatgcaactcctttttgctggattttttttaaaaatcttttttttttttttttttttttttttagcaatttgattattatatgccttggcgtggctttattcatgattcctctgcttggggttggttgagcttcttggatctgtggatctgtagttctatcaaactttacacaaatttggtcatgaggtcatgttttctttctgtctttctttctttctttctttctttctttctttctttctttctttctttctttttctttctctctttctttccttctttctttttctttctctctctctcttttttttttcagtctcattctgtcacctaggctggagtgcagtggtgcaatcttggctcactacaacttccgcctcccaggttcaagtgatttttgtgcccagcctcctgagtagctgggattacagccaccacacctggctattttttttttttttttttttttttttttttatagagatggggcttcaccatgttggccaggctggttttgaactcttggcctcaagtgatttgcccacctcaaccttccaaaatgtgggattacaggcgtgagccactgtgccctgctaatgatttattcagatatttttgtgccaccccctcctttcctgggactccagttacacatatttcaaatagtttcatattgctccagagccctcttaattttttcagtctttttccccctgcattttactttggataatttattttgctatgacttcaagttcactaatttttcttctgcagtgtctaatatgctgttaactctatcccgtgtattttccatttcagatattgtatttttatctctagaagttcctcttggggtttttttcgcacctaccatgtctctccctttaacatgctcgcagttttccctactttcttgaacttccagagtgtatttataataaacatccttgtccattaattggatcttctgtgtcatttctggatctgttctattgattggatttttctcctgataatcagccatattttcctgcttcctagtatgcctggtaatttttatttatttattaaaaaatttctttgagacaggttctcgctctgtcaccctggctggagtgcagtggcataatcatggctcattgcagcctcaactttccaggcttcagtgaccctcccacctcagcctcctgagtagttgggcacctgccacatccctggcaaagttttgcatttttggtaaagacagagtttcaccatgttgcccaggctggtcacaaactcctgagctcagacaattcaccttccttggcctcccaaagggctgggattataggcatgagccactgtgcttggcctgcctgataatttttgattagatctggacacttcggattttacattgctggattttttttttcttttttttctttctccatcttctggttttctgaagtttctgggttttatgatactgctttaaatattgttgggttttgttctggaatgcaattcagttacttggaatcaattagatccttccaagacttgcttttgagatttgttagggcagatctggaataaactttagcctagggctaatttggcctatcatggaggcaattgttctttgatgattgaccctgatgcccaatgtgtttggaggtttttccattgcagcttgcaggagctattctcattcccctgtgaggtccaaggattgttctgcctactggtggttcattctccagcctcaggaggtttcttacatgcaaaggtagataaatattcagccaaagtctcaaaagacccttcttcagatctccagaactttctctctgtgcaacttcctcctctccaagtattcttcttatggattctagctgccttgatttccctgaagttccactccgtctcttctgctcagtgagacctgtaggctctgtttggattctccctccttgtgctgttggatggagactccaggcagtgagcaggagcaattatagagctcagcttgtttgccttccttgctcagggatctcagtcttgtgctacctgctgcccaatgtctgaaaaacctttggatgcacatatttcagccagctttttaattgtttaaggcaggacggtttatccattgccaattactccatcatagctagaataaaattatgatgaatttctttttattgttattactgaatggtatcccactgaatggagatccatgtttaacctttcacctgttattggatatgtgattgtttccaatatctggctactatgaatgaagctatataaatctttgtgtagacatgttttcatttctcttgcttaaatacctaggggtggcatttcttgatcatagggtattgtatatttaactctgtaagacactgtcaaacagtttttccaagcagctgtatcagagttcctgttgttccatatcatcaccaacatttgatagtcagtctttgaaatttttgcccattctagtgactttgtagtggtctcgttgtgagtttaatttgctagttcttgttagctaatgtgataatcatttgtgtgcttattggccatttttacatctgtttttatgaagtttagcttcatatcttttttttttttttttttttgagacggagtcttgctctgtcgcccaggctggagtgcagtggcgtgatctcggctcactgcaagctccgcatccagggttcacgccattcttcttcctcagcctcctgagtagctgggactacaggcgcccgccaccacgcccgtctaatttttttgtatttttattagagacggggtttcaccgtgttagccaggatggtctggatctcctgacctcatgatccgcccacctcagcctcccaaagtgctgggattacaggcgtgagccactgcgcctggccaacttcatatctttttaacattttttccccttggcttgtctatcttcttattgaattataagagtagtttttgtattctggatataaatttcttgcagataaaatagagtctatacttttttttttccagagtctcgctctgttgcccaggctggagtgcagtggcacaatcttggctcactgcaacctctacctcacagattcaggcacttctcctgtcttagcctcccaagtagctgggactacagacatgcaccaccatacccagttaattttttatttttagtagagacagggtttcactatgttggccaggctggtctcgaactcctgacctcaagagatccacccaccttggccatgcaaagtgctgggattacaggtgtgagccaccatgcttggcccagagtctacttttgactatacctttttgctggattgagaggagttgggggtagtggtaagataaacaggccattgtagtcaccaaggagagagatgatagtgtcttagacaagaatgggggtttagatggaggaaagtaggtgagttttaaaattatttttaaaaaagacttcaagggattctgggtgtacttggtttttccttttgtcttctgaatgtccatatatatatatatgtttatatacatgtatatatatgtgtgtgtgtgtatatatatatatattaaaaaaacatgaatcacttctatgcttaaattaactacaggagaatgtctcaggaacctacgacatactcccttttcctattcctttttctgagccatggagtgtcgagttatacagtgccaaattccaggcagggtaagtcctgagggaagaatcaccctttgtggtttccacacagtttagggaatgaggtgggatagatacattaggtacatgatgctgtaagttgtttttgggctgtgtgtgtgtgcatgtatgatttttcaggattattctaagaggatttttcaagccacggttttctcagagtggacagttataattaaaattcactaaaaatttccttcatgagtggctttctggggcttttcctctaacccatatttgtagttttgaaggtcacacaattcaattctagttatacattcaatggctttcttacagatttgcatccattgttgcaaaacatggcggtgagtattctattttctgttaatcagagtcccctctactggaattgccaacttttggttgttatacttgatgttatctctttgccttttaggaagaaataatagatggaagctatctgaatggtaatgtgcccccttgatctccacttgcttcttctaagaatttcaaacagaatgtagctgtgatctctctggaatgattccttttaaagatgtcttttcattttactcccattgtagcactgctggatctcatacagtttcaaaggtaaaatgccctagaggagaggggaagggatggtatagatttttaataaaaattcttaatggaagtctcttaattgtaaaaagtaatatgtgctcattacaaaaaatgtcaatcaatgcacaatgtgttaaaagtcaacaaacacccttgctccacgggcatcattcctcctcactctagcataagggccaattttttttctttttttgaatggagtttcgctcttgttgcccaggatggagtgcagtggtgctatcttggctcactactgcaacctctgcctccggggttcaagcaattttcctgcctcagcctcctgagtagctggggtaacaggtacctgtcaccatgcccggctaatttttgtatttttagtagagatgggttttcaccatgttggccaggctggtctcaaactcctgacctcaggtgatctgccggcctcagcctcccaaagtgctgggattacaggtgtgagccaccgcaaccggcctaagagctgaaatttattgagtgctttctatgtagtgggtattctactaagcgcttggtatagaaacaatctaatcctcacaagtgccacacaatgtagttcccattgttatcccattgcacacaatggtgaaactgaggtccaggaagggtaaatcaaggacacacaactgggatgtgaaccagtggcctggctccaggacccattccctttactgttgcattataagctgcatacagacagataccagggacatggggcagggaactaggtagtgtggaaacgccaatattaataaacaattctaatatgatgagtactatgatcgataagaaataggggtcttggggcctcatatcagggatacccagttatgttaaagtgaaagactcccataaccactcctttccctaagataacaccaatgggtacttttggatatattctttcagtctaagtattttatttgtttattaatttatccatccatccatccatccatccatccatctctttataagattacaggccgggcgcggtggctcatgcctataattccaggactttgagaggccaaggtgggcggatcatgaagtcaggagttcgggaccagcctggccaacatagtgaaaccctgtccctactaaaagtacaaaagaattagctaggcatggtggtgcatacctgtagtcccagctactcaggaggctgaggcaggaggatcacttgaacgcgggaggctgaggttgtgataagccaagattgagccactgcactccagcctgggcaacagagtgagactccatcgcaaaacaaacaaacaaacaaacaaagaagcaaacgtaagattacaaaaggcttttcataggctgggcatggtggcttatcctgtaatcccagcactttgggaggccaaggtaggaggatcgcttaaggccaggagttccagcccagcccggccaacatggcaaaactcagtatctactaaaaatagaaaaatgagctggatgtggtggtgcacgcctgtaattccagctacttggaaggctgaggcaggagaatcgcttgaacctgggaggcggaggttgcagtgagctgagattgcaccactgcactccagcctgggtaacagagtgagactctgtctccaaaaaaaaaaaaaaaaatgagaaaaggctattcatgggcatttactgtgtgttgggcacagtcttacgcaattttcatgtgtgaacaaattttaatctcacagttgttaaccatatttcatataaagggaaactgaggcacaagaaaatttatcaaattgtctcaagccacacaactaagtgatggaactaggattcaaatccagtttggagcccacactcctaactatgctattccagcctctcatggtgtacctagcgtctgcttttaaatgtacatctttctaacacaatcagtttggattgtagtcaatctaagcagattgttacgggaattagaatattgcatacagcttagaaatttgggaattggctttgagagaatgggatccaggcagattcctagaattggaaactatcctatcactgtgcctggttaagaaattttttacttcaggctgggtgcagcagctcactcctgtaatcccagtactttgggaggcagaggtgggaggattgcttgagcccaggagtttgagaccagcctgggcaacatagtgagaccccatctctacaaaaaattagctgggtgttgtggcatgcacctgtgatcccagctgcttgggtggctgaggttggaagatcacttgggctggggagattgaggctgcagtgagccgtgatcgcgcaacagagcaagaccctgtttcaaaaaaagagaaaagaaaaaaggaaagaaaagaaaagagaaacctcccacttccaagtacaaagtcctaacacccctggtccatccctacctgtcccctgggcacttagctagtacagtagtgcttgtaggagaatctgtcattgtgatcttttcctgtctgtcttcaactgaagctcccacgtgtggacggatgacctgtcccacagagtcctggcctatctgaattcccggaatgttgccttcaccatccccagcctgcaggtgtgtacctgagacccatctatatgttcccatctcagtgctcagggattgcaaactcaggggccaggtaagttggagaagtgggctggatgtagagatagtctttgcttctgcaaggaaaagggttctgtccagtttttcttgaaacatgatataagctattttgtctttctttcattttcccacctttgatggagacatggtatattaggatataggctgagctgctataacaaaaagacccccagatgacagcagctcaaacaatttagtttatttctttctcgtacaatagtccagagctaagtgggaaagccacagagaaaaggcagctctattccatgaggttatccaaggacccaggttccttttatctttttgctttgtcatctcctggggagttattgcccatgtggtggaaacacctcttcctttctccaatccaggggatgggtgggaagaagaagacaagggtagcatcttctcttctgaggatatgacgcaagttacacaattccctctgcacacattagattggctcacacaccatagtcacatcttactgcaaaggagccatgtacccaactaaaagttgaagggttcaattgataaagagcagtgagagagtggatatttggatatagtgatcagtctttctaccatgggtccaagaaatgtactactgtaatgaaaacaatagcacaagcgtgttgataggtggcaaaggatatttgccttaaggggcaatagggctcgtgcctgtggtggtgactgcggtgaactgcacagcacctgcctgactgttagcctagtgtggcatgttgtgtctttatcatcacactgtggataacacagaaaattggagaaaaattctttcagtattgagaaagttattcagtttagcaaaagaccatttatgtcattaattaatgaataaagttctgacatatgtcttcattgtttccatttttacttatgtttgaatgaaaatggaaacatcaaccaacattgatatcacaaatatactcagagagcttgttgtctgccaggtcccaggacagccactagctggaggtggctgttggccccacatggcatctgcttttcttttcttcttcatcagtcagggaaactgaaagagaagcaatgcttgccacttttctctctagcagtaatggatactcatgagatgtatccactttaatctgatacgtttcttcctgtgtatataccatatttatttattcatttaatatctactgagttaacatctgctttctgccaggcatagctctagacactgaggactcagtagggaacaaggcagtcatgatactacccacaaggacctttcattttaggggtgaggctttaattaagccattattcaccttggtcaagatagagaataatagctggcactattgagcacttactgtgtgctagcaactattgaaaacactttacacactgaatcctcgtaataactctatgtggtaagtccttttattgcctccattttgcagataagaaaactgaggcccagaagaaatgttgctgatttagcaaataaaaatacagatgtgactctgcgtggtggctcatgcctgtaatcccagcactttgagaggcataggtgggaggattgcttgataccaggagttggagacaagccttgccaacatagcgagaccttgtctctacaaaaacaaacaaacaaacaaacaaaaaattagctgagtgtggtggtgtggcctgtagtcccagctacttggaaggctgaggcaggaggattgcttgagcccaggagtttgaggttacggtgagctatgatcataccactgcatttcagcctgggcaacagagcaagaccccgtctctaaaacaaaaacaaaaacaaaaaacagatgtccaatttcgtttgaatttcagataaataatgagtgattttttttttttttgagacagagtcttgctctgttgcccaggctggagtgcagtggtgccacctcagctcaccacaacctcctcctcccaggttcaagcaattctcctgcctcagcctcctgagtagctgggactacaggtgcatgccatcatgcctggctaatttgtgtatttttagtagagatggggtttcactatgttggccaggctggtctcaaactcctgacctcatgatccgcctgtcttggcctcccaaagtgctgggattacaggtgtgggccaccttgcctggcaaacaatgagtgattttttaagttaagtatgtcctatgcaacatttgagacatacttatactaaaaaaaaaaaaatgtgtagtttttcccgaaattcaaatttaactgagcatcctgtattttacccagcaaccctagttaagtaactcgtccaagccacacagctagtaagtgtcaaggtggggatttgcatgtggcttgtctgggtctagagttcaccttttgcccatgacatcacactgggcatgtctgtttaacggagatttagagaacaattccccagacagcagaggaaatctctttcaggagaggctgatggcttctgctccttgccctgtagggggcgccacagagtatgttcatttcgcctgtattttgctcctgcgctggtagcttgggtttgggcacagtgccatctggggttctaaacttcctggacaaaggccagctgctgctgatgggaaactcaatcacctacagggaccaggcaggccatggaatgggggaatcgggctggctgggcctgagagttacttcaacaagcagctgtcccttggcttgccaattattgcctaaaaggggatgtgcgcccggtgttgccaaacctttactttttcaagagaagttggaaatcttgatcttgtgaggaatccccttattattattattattattattattattattattattattattattttttaggtggagtctcgctctgtcaccaggctggagtgcagtggcgtgatctcggctcactgcaacctccgcctcccgggtttaagcgattctcctgcctcagcctcccaagtagctgggactacaggcgtgcgccaccacacccagctaatttttgtatttttagtagagacggggtttcaccatgttggccaggatggtcttgatctcttcacctcgtgatccacccgcctcggcctcccaaagtgctgggattacaggcatgagccaccgcgcccggcccctcatttttaaatgttggcggctaatgaggaaatttggaggtggccaaaccagactgctggccactagttgtggtctctgcagggaatgagggggccgggctgggccgctggccatggtgctgaccatgtgctcctgctctttctgttctcaccgactctcccaacaccccaaatacaggcagccgtggaaaaccacctggagcagcgtctgcaccagccccagaagctgctggaggacctgaggaagacagacgcccagcagttccgcactgccatgaaatgcctcttagaagacaagaaggacggcttggtgaggagcccttggcatcccggggatagaggaagtccagcaccacgtggtgtttgttgaattgaataaatggagcctgacttaggccttggcacttcattgtctcttcctctctccttctgcctcctccaaccccctgggggctttaggacctaagttttctcacttactttctccaaagttaaaatgaagagccttacaattttttattttatttttgttttagagtctcactctgtcactcaggctggagtgcagtggcacaatctcagctcactgtaacttctgcctcctgggtttaagtgattcttgtgcctcagcctcccaagtagctgggattacaagtgtgcaccaccatgcctggctaatttttgtatttttagtagagacgagattttgccaggctggtctcaaactcctggcctcaagtgatttgcctgcctcggcatcccaaagtgctgggattacaggtgtgagccaccatgcctggcctaattcatatttttgtcagtactaagaaatgacgggtcctaattaaggatctgagaatctcctggttgtttgggtcaataaacatccactagtaaaaattactatgcaccagtggacacagagatcctcctgcactcaaggagctcacggtctggaggggagacaaaaaacaggaacagttaatttccacaaaatgagtttagtgatccaagaatatcacaaagcaaggcctctgagaccttaaaaactgggacttaaaaaaggtaagtcatttgctcaggacacacagataatggaggccctgggactggaacctgggaatgcctgaccctagtacccatggggcttaaccggtaggattgtcatgagaattaatcagatgatgcgtttgctccaagcttggcacagtagagtcaatgctcagtaaaatggaggctttttttttttttcttagagacaggggcttgctctgtcatccaggctggagtgcagtggtataattatagctcactgcagccttgatatcctgagcccaagtgatcctcccacctcagcctctcaagcagctaggactacaggtgcgcattagcacacccagctaattttaaaaaatttattttttagggacggggtctccctgtgttgcctaggctggtctcaaactcctaggctcaagcgatcaacctgcctcagcctcccaacatgctggggttatagatgtgagccactgttccaggccaatcagtccttttcaaaatctccccagatgggctgggcatggtggctcatacctgtaaccctagcactttgggaggttgtgggcagattgcttgagcccagtagtttgagaccagcctggacaacatggcaaaactccatctctacaaaaaacagctgagcatggtggtgtgtgcctgtagtcccagctacttgggaggctgaggtgggaggatcgctcaatcccaggaggttgaggctgcagtgagctataatcacaccactgcactgcggactgggtgacagagcgagaccctgtctcaaaaataaaataaaactttaaaaaagctccccaggtgattctgatgtgcacccagagatgagaaccacgggcttggaggaaagacgcatgagtccctttaatgcattatagagtttggttcaagatgccctggggccacataagggagggaaatctgatctgaagtaggaagttggagggatcagagacttcacgaaggtgatggcaatggagcccagacttaaaggatgagctagatttcaccagaaaaaggaaagatgcagaattccaggtagaccaagggcctgatgtatgctggtcaggtgtatctggagagtggggaggctccacagtgagtggagcaggtaaaggccttgactttgttctgcagggaatggaaagttctagaagtttcaacatagcagcatggtgttaaacagtgatcctgactttccccactgttgcaatgtgtggtccctcccagggcttccaaattgagaggcagctctcaaactgaccctggcttctgtcattgctttaggacctgaaagacatcatcatcgacttaggagagattcgagaacgagccttgcagagccctggcgtgaaccgcagcctgtttctcatcacactggagaggtgtttccagatgctgaactccctggagtgtgtggagatcctgggcaaggtgctgagggggtcctcagggagctttctccagccagacatcacagagcggctccctcgggacctgcgcgaggatgcctttaagaacctgtgagtggttcctccgaacttttttttttttttttttgagatggagtttcactctgtcgcccaggttggagtgcagtggtgcagtctcggctcactgcaacctctgcctcccaggttcaagtgattctcctgcctcaattccaagtagctgggactacaggggcgcctaccacacccgactaatttttgtatttttgtacagatggagtttcaccatgttggccaggctggtttcgaactcctgacatcaagtgatccacctgccttggcctcccaaagtgcttggattacgggcatgagccactgcacccagccactcccaccttcttaactcatcacagtatccttcaggggctgccgtgagaatgcaaagagatctcacctggcagcagggagaagacaagtggggacaggttgatatgcacgttttggagcaaaagcttaacatctgtagagttaggctgggtgtggtagctcacacctgtgatcccagcactttgggaagcagaggtgggtggatcatgatgtcagcagttcgagaccagcctggccaacataatgaaaccacgtctctactaaaaatacaaaaattagttgggcatggtggtgggcgcctgtaatctcagctacttgggaggcttgaggcaggagaattgcttgaacctgggaggtggaggttgcagtgagctgggatcatgccactgcactccaacctgggcgacagagtgagactccatctcaaaaacaaaaacaaacaaacaaaaaacaaaaacaaaaaaacccacataaataaatacagtgggaaaaaaagtgttactaaatcctagctagatatgttgcttgcttaagtgtgttagtcagattgggctgctgtaacaaaaataccatagactgtgtggctagtaaacaagaagcatttatttctcatggttctggaggctgggaagtccaagatcaaggtgctgacagacttggtgtctggtgagggctcgctttctggtttataggtggcaccttctcgctgtgtccccttgtggtggaaggggtgggcaagccctctgggatctcttttataagggcactaatcccattcatgaggtatccagcctcatgacctaatcacctcctcaaaactccacctcttaataccttcatgttgggaattaggatttcaacacatgaaatttggggaaacgcaaacattcagtccacagcacaaaggctctgagcctgggtcttgttccattgatttaaaaacaatctgagtgtgttttaaagattcactggcactaaactgagactttgttcttgagggacaacagaaggagtgacagagcactgaaaaaggaggacttctccttttgagatgccatgccagcttagattggttacacctagccctgcatgaaattgcgctttgatgtaaaccaaattcgaggattgtgtctaggacttgaagggccataggcattgcaaccaccgccaactccctccttttactaatcgtagtgctttatggccataaagcactctttctaaatctaaaaatgatttagaagaaggaaaagaccaatatgatgataacaatgtgggagattccttttatcttttgtagccaaatgacagtaaggaaaacagacagtatgctgacctcatcgtttctctaggttgccagtttttttcactaagatgtatataaatgaaacccttttgctctgcaggctattatactattccttttaaattcagcatctcttccctcctccgttcatgcagattgtggaagagaacatcattgggagagagagtttattggttactgctcacctgagtaagcagtaagcccaagtggcagaaaaacccattcaaactggcttgaagcaaaaagggaattattggaacatgtaattgaatagttttaggtgtagggctgacttcagacgcagctggatccagagactcaaatgatgccatcagaaacatctttggctctttgtcttatatgctgaaaaccactgaattgtgcactttatttatgtaatttttttttttttgagacagagtttcactcttgttgcccaggctggagtgcaatggccccatctcggctcactgcaacctccacctcccaggttcaagtgattctcctgtctcagcctcccaagtagctgggattacaggtgcatgccaccacgcctggctactttttgtatttttagtagagacagagtttcatcatattggtcaggctggtctcaaactcctgacctcaggtgatccgcctgccttggcttcccaaagtgctgggattacaggtgtgagccactgcacccggcccaattgtgtactttaaatgggtgaattgtaaggtgtgggaattatatctcaacagagctgcccccacttccccaaaaaaggaccaagaggtgaggaagtggagacaatatgtatggaatattctttggaaggtgtttagctgtgaaggggaagaggaaaatgggaaaaatagttacatatacctaaggagtgtgtttgggggtattttttgtttttaagttctggggtacacgtgcaggatgtgcaggtttgttacataggtaaacgtgtaccatggtggtttgctgtacctatcaacccaccacctaggtatcaagcccagcatgcattagatatttttcctaatgctctccctcccccaccccacccccacaataggacccagtgtgtgttgttcccctccctgtgtccatgtgatctcatcgttcagcttccacttacaagtgagaacatggggtgtttcattttctgttcctgcgttagtttgctgaggataatggcttccaggtccattcatgtccctgcaaaagacataatcttgttcatttttatggctgcatagtattccatggtatatatgtaccacattttctttatccagtctattattgatgggcatttgggttgactacatgtctttactattgtgattagtgctgcaatgatcatgtgtgcatttatctttgtgacagaatgatttatatatttttgggtatatacccgataatgggattgctgggtcaaatggtatttctagttctagatctctgaggaatcgctacactgtcttccacaatggttgaaccaatttacattcaagaaagggaaggttttttttttttaaatatactttaagttctagggtacatgtgcacaacgtgcaggtttgatacataggtatacatgtgccatgttggtttgctgcacccatcaactcatcatttacattaggtatatctcctaatgctatccccaccccctccccccaccccccaacaggccccggtgtgtgatgttccccttgctgtgcccaagtgatctcattgttcaattcccacctatgagtgagaacatgcggtgtttggttttctgtccttgtgatagtttgctgagaatggtggtttccagcttcatccatgtccctgcaaaggacacgaactcatccttttttagggctgcatagtattccatggtgtatatgtgtcacattttcttaatccagtccatcattggaggacatttgggttggttccaagtctttgctattgtgaatagtgccacaataaacatacgtgtgcatgtgtctttatagtagcatgatttataatcctttgggtacatacccagaaatgggattgctgggtcaaatggtaattctagtcctagattcttgaggaatcaccacgctgtcttccacaatggttgaatcaatttacattccaaccaacagtgtaaaagcgtttctatttctccacatccaggagagggaagggttttaacacaagacagctttgggtcacatttgctgttgtgactccctttttaatgcagcccccacctgcttgttattagctgatgcctgtgtttgtgtcatttagatctgcagtgttcaaagatctctacgacaaaacctcggctcattcccagagagctctctattcctggatgactggaatactgcagacatcctccaatgccactggtgagcctgtacttggaggtggggtcactttttgggggaagaatatcttcagaagaggtgtttcatctctgaaaacatggatttgatgttgttctcttctgatttttaccacctcccactgcttcgaaaaacagtttgatgtggcttatggagtaaaacacatactccatttcgtcaatgcaattcgcacatgtggaagtctgaaataatgatgtgtttgtatttcataatctatgttgtgtcctagtttttcagtggaatataaataatgatggtaacttagattcaatgtgaaccttgagtaggggtacaagttcaaaatctgtataaaaaaatctatattaaaatgagagaagaggctgggcgtggtggctcacgcctgtaatcccagcactttgggaggccaaggcaggaggattgccggaggtcaggagtttgagaccagcctgaccgacatggtgaaaccacatctctactaaaaatacaaagattaaccgggcgtggtggcgggcacctgtaatcccagctactcaggaggttgaggcaggagaatcgcttcaactggggaggcagagattgcagtgagctgagattgcaccactgcactccggcctgggtgacagagcgagactccgtctcgaaaaaaaaaaaaagagagagagacagaagagaattttattaggaaatctaggcaataaaacacagaaatttaactctgagcgtcctggctaccaaagcaggtaggtcaggatttatttatttgatggatgttgcttaaagcctccttgtgtcctagagcagtcaaattcatagagacagaaattagaatggtggtacagtttcgattttgcaaggttcaaaatattctggatatggctggtagtgacggttgcacaatagtgtggatgtgaatgtacttactcccgctcaactctacacttaaaaatggggccaggtgggccgggcatggtggctcatgcctacaatccagcactttgggaggctgagtcaggcagatcaactgaggtcaggagttcgagaccagcctggccaacatggtgaacccccttctctactaaaaatacaaaaaattagcctggcgtggtggttcatgtctgtaatcccagctatttgggaggcagaggcaggagaatcacttgaacccaggaggtggaggttacagtgaactgagatcatgcaattgcactgcatcctgggtgacagagtgagactctgtctcaaaaaaaaaaaaaaaaaagaaagaaagaaaagaaaagaaaattggggccaagtgcggtggcttacacctgtaatcccagcactttgggaggctgagacgggcagatcacttgaggttaggagtttgagaccagcctggccaacatggcaaaactctgtctttaccaaaacaaacaaacaaaaaaacaaaagccaggtgtggtggcgtgcgcctgtggtcccagctactcaggaggctgaggtgggagaatcacttgagcccgggaggcagaacttgcagtgagctgggattgtgccactgcattccagcctgagtgatgtagtgagaccttgtcgcaaaacaagcaaacaaacaaacaaacaaacaaaacagcgatagaaaagaatggctatatagattagcaatacaaacaatttctcagatagcttcaatttgttaaacctttaatgtcagtaatgtaaacagaataaactttttaaaagcccattatgtatcaatagctgaagatagagaaggaaacaaaacaaagtctctgctcttacggccctattgttttattgtgggagtgttggtggagacaatttttttaaacatgtaagtaaataaagagagagagagaacttagaaatttagatactggtagcggctatgaagaaaataaaatagtttgttgagacggagtcttactctgtcacccaggctggagtgcagtggcacaatctcggctcactgcaacctctgcctccagagttcaagtgattctctcagctcctgaatagctgagagtataggtgcctgccaccatgtccagctgatttttgtatttttagtagagatgtgattcctccatgttggccaggctggtctcaaactcctgacctcaacagatccacctggcttggcctcccaaagtgctgggattacaggcataaaccactgcacccaggcagaaaggatattacaggtactttagactagaagagcgcttggcaaatgttttctgtaaaggaccaggtaaatattttaggctttgtaagcctaccatctctgcctcaactattcagctctgacactgcagcttgaagacagctgtagacaatagatgaatgagcatgcctgtgtcccagtaaagctttactaatggatgctgaaatttgcataattttcatgtgtcaccaaataggattcttcttttgattttcctttcagctattaaaaaaggtaaaaagcaggcagggtgcagtggctcatgcttgtaatcccagcactttgggaggcccaggcaggaggattacttgaagccaaaagttcaagaccagcctgggcaacatagcaagaccccatttcttaaaaaattttttaaaaaatagccggtgtcctggtacatgcctgtagtcccagctaccctggaggctgagggggggaggatcccttgaacctaggagtttgagactgcagtgagccgtgatggagccactggactccagcctgggtgacagagcgagaccttgtctctaaaaaaaagtccaaaataataaatgtaaaaaccacttttggctcatgggctgtataaaaacaggtgatgggctgagtttgccccatggattgtagtttgccaactcttggactaaggaatcagggaagacctctcaagtgggtgacatttgaatcaagaccaaaatgaggagatggaaccagtcacgtaaggctctggagaaagggcatcccagagagaaatcccaggaaatacaaaggccctgagatgggaatgagctcggtgtggggaaaacataaggaaagcagatggggctggaggatggggaatgccaatcaatcttttcctggaattcagctctgagatttgtgcataatgaacattaaacaacatcataatcaaagtctcaaatgcatagtagaattccctctgcctggtgcataattgtggtctccaggaatcagagtctcacactgggtaaccatgagaaagcctctctaccttcagacttctctgtctttattgccagagtttaattaggcacagactttccttctaaaattcttatacggtgcgcttcattattaaactacagtgagttaaaattaattctgtttggacttaaattgttttttcatgaaggcccttgagggaactggaaatactttggctgttaaaaatatcccaaccttgctggccaggtgtggtcgcttacacctctaatcctagcattttggaaggctgaggaaggaggattgcttgaggccaggagttcaaggccagcctgggcaatgtagtgagaccccccccccccatacaaaaaaattaaaagattagcctgatgtggtgatgtgtgcctgtagtcctagctactagggaggctgaggcaggagtttgaggcttcagtgagctatgatcatccaactgcactccagcctggacaacagaggaagaaaaaaaaaaatcccaagcttggggatgattgatctacagaaatacagtttatgcttagtaataagttaaaaaataaacaactaagcttggttctttgtgaatgtgtggttctagcctcaaaagtttccagccctctatataggcaaggcaaatgtccagggtccccatctagaggatcgtaggagtctgcctgtgtcaccccaacatctttgattcctggtttgggagaggcactccatattttcttgtgaatcagtctatataaaagttgatttctccatcttgttttggcatctgtcattgcccacggcttctgcaaatagctcttgatgttagagtcactgcaccctgtaaatgctccccacttccttcattttccccaaatgcctccaatacaatatcgtgtgtaaatgtcttttgctaaagagctggggagcattggcagccacttccagctcagtgaaacttgaagtctgatcctagacttgagatatatatatatatatatatatatatttttttttttttttttttctgagatggagtctggctctgtcactcaggctggagtgcagtggtatgatctcagctcactgcaacttctgcctcccgggttcaagtgattctcctgcctcagcttcctgagtagctgggactacaggcgtgcgctaccacgcctggctaatttttgtagttttattagagatggggtttcgccatgttgaccagtatgctctcgatctcctgaccttgtgatccacctgcctcggcctcccaaagttctgggattacaggcttgagccaccgcacctggctgacttgatggtttttaaaattccactgacatctcagtgatggggaatttcaaaagccagaacggggtgtcagagagagtcctctgggaattcagtggagggagaaagtacttctcgtgaaggagataagagaaggctttaagggagaggaaaatttgagcttgatcttaaagtaggatttggatgcagaaggggtaaggaaaagcattgtaggtggtgagcagggccaaggccagccaagatttggagaatgttttggggaggtacaagtagtttgctttggttcaagtatagtaacatggtgataatcagtgaggatgatccttactagtggtagtgatgcaagacagtcaaacatatttcatgttgccagattattatcattattattattattagacagagtctcgctctgtcacctaggctggaatgcagtgatgtgatcccggctcactgccacctccacctcccgggctcaagagattctcctgcctcagcctcccaagtagctgggattacacctggctaatttttctttgtatttttagtagagacgggatttcgtgattacaggtgtgagccaccacatctggcctcatgtttccagattatttagtaaccaatcgaatgaaaaaataaaactacattttgtgggttttaagtattaaaaataacctgcatttcttatttatttatttatttttaattattattacttttttaaagagacagggtctcactctgttgcccaggctggagtgcagtagagtgagctgtagcctcaaattcctggtttcaagcaatcctcccttctcagtttcctgagtagctgggactacagctggcttttttttttttttttttttttttgtagcgatgagggtcttgatatattgctcaggctggtctcaaactcctggcctcaagcaatcctcctgcctcagcctcccaaaatgctgagattacaggtgcctggccagaaagaataatctgtatttctaacaagtggccaggtgacacagatgttgcaattccaaagaccacactattgagtaacaaggtctgaggtggtgcgaatctgtgttcacatcctacgtgtgatctcacaggtaggccctacgtatatgattgttgaatgagttaataacaaattaatgtggctgggcatggtggctcatgcctgtaatcccagcacttggggaggcaagaggcgggcagatcacctgaggtcaggagtttgagaccagcctgaccaacatggtgaaactctgtctctactaaaaatacaaaaattagctgggcatggtggtgggtgcctgtaatcccagctacttgggagactgaggcaggagaatcgcttgaaccggcaggcggaggttgagatgagctgagatcacaccactgcactccaacctaggcaacagagtgagattctgtctcaaaaaaccccgaaaaacaaaataacgaattaatgaatgcaagaagtaggtcttgacagcaaagatgctgttgactatcacataccagtgtaaaggcttttatttatgtatgtactcatttattcatttctttattttttgtagatgactctgcttcatgggtcagtgcggaacacttatgggttttgggcagatacatggttcacctatcgtttgaagaaattacgaaaattagtcctatagaagtaagttggaaaagtacatttatatgtcaccattactaatacacttggggtaaggtgtattctcaaactctaatgttcatccagccagtcaaggtgccttggaaattgtgtaccctcctcagcccaatagaccttgggcctctgaagaaaactattggaagaaagtttcaagtgggcagtcatgggattgttttagtgtggaagggctaagaaaagaaaaagaattgtggacaactaagatcacatctctgatgtgagcaaacatgatttaaagggattgttggctatgaaccaaaaatcatttaagggtatttttgtactggagaaggccaaggacaaaagatataaagtttcccatccttgggatcatgaactcaaagcaaaagcaaaatggattaatagctacttctatttatagctacttctgttaatagctacttgagcatgagcaatggttagattttaattctagagtttacagtggagaaatacacacattctaggattacttaactcactagtcaacctgtccctctccttttgatgttgacccaatgacactaaaatcccttgggcatcatgattcttgaatgcggtctccaaagaatgctgccaacacaaagggattcatgaagagactgtgggccttgcttccaatttttcttcttcttcttcttcttttttaagtcatatgtgccctgactcttctggccagtgagagaagtgtttgcatcaaatgactggcctgttcaaggacccattgacccagcaatgtgtggttattatgaaaccagaggcagaacgagctttctctcttttacctagggggctgggagtatttcaagtgtcttccgatttttataacccgcagtcctagaattaaccccgcaccccactgccatttactctctcaatgtagagttgctttgagtaggtaacagcttaaattcttagaaagctgagccccctagaggaaatttctaaggtcaagcactcatttgcaactttttattcgctaaaaatgtagagaagggagaagtcaagaataacactgctaaaagggaattttattttattttatttgtttatttatgaaatggagtctcgttctgtcgtccaggctaaagtgcagtggcgtgatctcagctcactgcaacctccttctcccagattcaattgattctcctgcctcagcctcttgagtagctgggattacaggcacatgccaccatgcctggctaatttttatatttttagcagagacgaggtttcaccatgttggccaggctggtcttgaactcttgacctcaggtgatctgccttgcctcagcctcccaaagtgctggtattacaggtgtgagacaccgcacccagcctaaaaaggaattttatatggacaaagagtacgatccacaaaggagagacaactttatgagcccctttgagcacagcataatactgtctcaaaatatagaatgtgccggctgccgtggcccatgccagtaatcccagcactttgggaggccaaggcgggaggatcacttgagcccagaagtgcaagaccagcctgggcaacatagtgaaacctcatctctacaaaaaaatttaaaaattagccaggtgtagtggtgtgtgcctgaggtctcagctacttgggaggctgaggtgggaggatcacttgagcccaggaggtcgaggctgcaataagccatgatcacaccactgcacccaagcctgggtaaaagagtgagactgtgtcttggccgggcgcagtggctcacgcctctactcccagcactttgggaggctgaggcgggtggatcatgtgaggtcaggtgttcaagaccagcctggccaacatggcgaaaccccgtctctactaaaaatacaaaaattagccgggcatgtttgcacatgcctgtaatcccagctactcaggaggctgaggcaggagtatcacttgaacccgggaggctgaagttgcagtgagctgagattgtgccactgcactccagcctgggtgacagagcgagactccatctcaaaaaaataaaaataaaaataaaaataaaaacaaaaataaaataaaaagagtgagtcagtgtccccccaaaattatatatataatttataatctgctagaaatacaaggaagaatagatagatatgagtcctgtagtagtagaagacttgcacgtggcacccttggacatgtgggccaaaaaggaacaagaatgttgggaatctgaatagtatatttaataagttgaatatatatgcaccaaactttgtgtcttacaaagagaacacatactcttttccatcacccaagggccatttataaactcattcatctattaaaaaaattctgattcttcaaagcagaaagtttgtggaccacattctctgacctccatataacaaatctagaaataaatgtgcaaagattagcttttaaaaagcccagtttctcagatattaaaaaataattctttcctaaagaatagttaggttgaggaggaaactaaagtagcagttacagaccactaagaaatcaatgacaatgaggccaggcatggtggcttacgcctgtaatcccagcactttgggaggccgaggcgggtggatcacttgatgctgggagttcgagaccagcctggacaacatggtgaatccccatatctactaaaaatacaaatattagccaagcgtggtggtgggcacctgtagtcccagctactccggaggctgaggcaggagaattgcttgaactcaggaggtggaggttgcagtgaactgagatcatgtcactgcactccagcctgggcgacagagtgagactccatctcaaaaaaaaaaaaaaagaaaagaaaaaaagacatcaatgacaatgagaaccaggaggtgtatccaagtgtccatgatggggcacagtgcagaccaccagggtggggccacactgggccacttccaccctcctcactgatattctcgtccttgtccaccaactagattgggctgtttatcagctatgacaacgccaccaagcagctggacatggtctatgacatcacacctgagctggcccaggcgtttctggagaggatcagctcctccaactttaacatgaggaatacctccaccatccacaggcaagcgcatgagctctgggccttggagccctttcccaagatgtgatctaagcatcagaattctctgagcagcaaaacacccagggagggaagggaggtggctggtccatctctttgaatagtcccatatttctctgtgcatgtgaggagaggtgtctgcaactttttttatgaagaggttatgaagctgggtgaaaggataaatgctttctgagcatctcctgtgtgccaggcattttatgcaaccttatcaagtgctaattctgtctctcagcacagaaatgaaacattttaaatactcaggactgggtcctgttccaaagtgaatgtgtgatttccgtttaagttgagtcaagtgttggaaataactcatgggtccccatatatgagaaccgcttgttatcagactcttagctggggagcccctggatgagatcagctctagaatttagtgactgtaatgtgatcctccctaaaaccattcccagcaggggaggagggacaggaactctacattccaggggtgtcaggaagggagtgggcaatgggaaggaggtggtgagtacagctcaatactccctccttttccttttatttatttatttttttgagacagagtcttgtcctgtcacccaggctggagtgcagtgatgtgaccttggctcactgcaacctccacctcctgggttcaagcaatcctcatgcctcagcctccagagtagctgggactacagatgtgtgccaccatgcccagctaaattttttgtattttcagtagagatggggttttgccatgttggtcaggctggtctcaaactcctgacctcttgaactgctgacctcaggtggtctgcctgccttggcctcccaaactgctgggattacaggcatgagccaccacgcctggcccattcaatcctgttttttttttttttttttttgagacagagtctcactttgttgtccaggctggagggcagtggtgcaataccagctcactacaacctccacctccagattcaagagatcctcctgcctcagcctcccaagtagctgggattacaggcgtgtgccaccacacccagctaatttttgtatttttagtggagactgggtttcgccatgttggccaggctggtctcaaactcctgacctcaagtgatccacccatcttggacttccaaagtgctgagattacaggcgtgagccactgtgctgggccatcattcaatcctcttgtgtccgtctctcaaggtcttattattgccacactgctcccatcccatattaccttaaggtttttcaaatgagccactcttagggaatgtactcataggaaacaattacatctgtttcacctacctttagtaattttcacttattagcatgtgtctcatttttctatggtttcacacacacaaaaatagcctcatgattaagaacatgggacctcgagccagacttcgtggcttaatccttccctgctgcttactaatggtgtgatctttgctatttttacatcacctctctatacttccgcttccccatctgtaaaatgggagataaaaatatgcctactgcattaaggtctttgtagggatttgcacacttgacacatagtaagtgctcaatgaataatattttttctttttatttatttatttattgagacggagtctcactctgtcgccaggctggagtgcagtagcacaatctcggcttactgcaacctctgcctcctgggttcaagtgattctcctgcctcagcctcccaagtagctgggactacaggcacacgccaccacgcccagctaatttctgtatttttagtagagacggggtttcaccatgttggccaggatggtcttgatctcttgaccttgtgatccgcccgcctcggcctcccaaagtgctgggattagaggcatgaactaccacgccaagcctatttttcttttataatttatttttttaaattgataaataaaaattatatctatggtgtgcaacatgttttgagatatatattcattgtggaatggctaaatcaagctaattaagttatcattacctcacatactttttttgcggtgagaacacttaaaatctactcttagcaatttttgagtatatgatacattgttattaactgtagtcagcatgtacaatagatctccagaacctattttcctatttaactgaaacattgtgtcctttgtccaagtctctccaactcccttcccacctccagcccctggtaccaaccattctaaggctctgcttccatgagtatgacgtttgtttatttgtttttcagattcataatataaatgaggtcatacagtatttgtctttctgtgcctagcttattgcacttagcataagatcctccaagttcatccatggggtcccatatgatagaatttccttctttttcaaagctgaagagcattccattgtgtatccaccaaattaaaaaaaaaatccattcatccactgacgtgttggacacttaggatgattccatgtcttggctgttgtgaatagttattctcaacgtggttattaacgttcagccctcacttcccctgagtcttctttactcgaagttaagcagatctcttttcctcatgagacacactttcaaatcttttccctggacctggcagctctcctgtgggcatgtctgaatatgtcaatatcgctctgagagggtggagccaggctgactgtggtcaactaggtagtcttcattctaactctaagagcattcattaatgaatgagtgcttggtttccaccaggatgtatgcaaatcagttggtataccacttctcatttaactttcacaatcatcctctttctttcactcatgtttattatgatgtgctacgatgaacaaagaaaacctcccatttattagaggctcagagagggagaggcaccctgtctctgtacagtatgggagtacagagtgtgcactgcagaactgtgtatagcggcctcacagagaagttaagtaacttggtggagagcaaacatctcacagagctgggcttcaaactgcagtaggcctgaatcaatgctcttaatgattagaaacattgctctcagttataccagggttccaatctcacttctgcccttccattgttttcctccagtcttttttgttttccttctgaaatctttgcatcatctgggtgggtaccagaaggcatcctagaaacagatctctgcctcagagaatccctcagggtgagatcagctctagaatttagtgattgtaatgtggaaaatggggagttttctgtggctaccggcacctttctttccttattccctttattcatcccaggtggagagatggcataggtggatggatctacatttaagtcccagctccaccgacttgccttggacaaatcaaatctcagtttccccatctgtgaaatggggctaatgagagcacctgccttgtagggttgctgtaatgagataatgcaggtaaacggctcagtgcaagacctgataagtggtagctgctattaatataatcaagaccccattggtttggactggggagggggtgtcgtgtccaccagctctcagcgctctgttatggaaccaaactgggtctgtttgcccatgcgcaatggaaaaccaaacactgaagcactaggtttttgtagagagaaacggttactgtgaatcaactgccaaggagacagaagacagtgctcaaatctgtgtctctgagctggggactggggcaggttttataggcggagggtaatgagacttgatctgattgggtcttgctacaaggtgatgctgggaggtgtgatctgattggatcatgccatgaggtgatgccaggactcattctgattggatcgtggaccatgccatgtggtgtccacttcataattcagcccccattccttggtctcgtctgagcagttaggttccgcctgtggttgcacatttggttcatctgaggatgttcaggttatgtgaccttcaacctgggagtccgtggcaactgaaaaacaactcaccattttattacacaaaattgaaccagaatgggctggttctgcggttacacctccaccaccatccctcctcttctcacacaggctggggctgctggtttgtttctacaatgacctggaattgctggatgccactgtggctcaagtcctgctttaccagatgatcaagtgcagccacctgaggggcttccaggctggcgtccagaaggtacagctggggtgcaaggccctgaggcctctgcctcagtgtcactagccagagaaatggggagaacagcctagcttagcctttgggagaaaacacacagcattagtcgggatttaagtccagtcacagcagatggcatctcaaatactgaggtaagtgtaacatcgaagcccagacagaaaatagcaaaggaacagaccctggggagatcaaaatttaatcagaaagctgtctcagccaggcgcggtggctcatgcctgtaatcccagcactttgggaggccaagatgggaggatcatttgaggccaggagtttgataccagcctggtcaacatcatgagacccttgtctctgcaaaaaatacaaaaaaatggctgggcacggtggttcacacctgtaatcccagcactttgggaggccaaggcaggcagatcacctgaggtcagtttgagaccagcatggccaacatggtaaaaccctgtctctactaaaaatacaaaaacaggcgtggtggcatgcgcctgtaatcccagctactcaggaggctgaggcaggagaattgcttgagcctgggaggcagaggttgtggcgagctgagatcgtgccactgcactccagcctgggtgacagagtgagactctgtctcaaaagaaaaaaaaaaaagccatgtgcctatagtgccagctacttgggaggctgaggtaggaggatcgcttgagcccaggagtgccagcctgcagtgagctatgatagtgactttgcactctagttggatgacagagcaagaccctatctaaaaaaaagaacagaaaagaaaagaaagggacagctacttcgaacttaaatatgcatacagatcacctggggatcttaaatgcagattctgattcaggagctcttggttgaggcccaggactcccatcttcctcttcttcctccttcttcccttggcctcccaaagtgtttggattacaggtgtgagccattgcgcccagctgacgctgcacttccaacaagcttccaggtgattctggaaccgctgctctggtgagcacacctggagcggcaggagataaagcagtggttctcaaacctgcctctagattagtaacatccctgccaggtgccaccctcagagaatctgatgttattgttctggggtgtggcctgaggtatggcctgattttaatgcttctcaggtgatttcaatgcagccaggattgagaacactggattgcagggtggttatgagttcccaagaccagatgagcaaacacgctctctctcattttccttcctctccatctctctcttcttccttccagtcaagtctcaattctacccccttccattccactttttgtggcccttttcaatttgcttaaaatcgaaacgatgacatgaaaataatattaaatgaaattttgataaagccatcaataatttcacagcagtttcccacacatcaccataaagtccccaaacacatttgacatttgagagtgtggtcatctattttggtcagcgcatctttttttttttttttataagattcatttttttttttttttgagtttcattctgtcacccaggctggaatgcagtggcataatctcagctcactgcaacctccaccttccgggttcaagtggcacaatttcagctcattgcaaccttcgccttgcctcagcctctggagtagctgggactacaggtgcatgccaccatgcccggctaattttttgtgtttttagtagagatggggttttaccatgttgactaggctggtcttgaactcctgacctcaagtgatccacctgccttggcctcccaaagtactgggattacaggcgtcagccaccgagcctagcctgtgaatgcatatttttgtttccaaggaaaagaatccgtcctaagcaagctcaagcaaaaataagaagataaatgtattttaaggcccaggggtctcaacatgtggcagccctgaccaaggagaaggtggcatgcaattagatacgagggagccctttgggatcatctagctcagttgttctcaaactggagggtgcatctaaatcacagggagggcctgttcaaatacagcttgtggcagcgctccagttttgtggaagacaattttttggcatcagggaccggttttgtggaagacaatttttttccgtggactggggccgggggattgtttcaggatgattcaagtgcatgacatttattgtgctcttccttccttccctcccttcctccctccctccctccctccctaccttccttctccttccttttctttctttctttctttctttctttctttctttctttctttctttctttctttctttctttctctttctttctctttctgtctctctctttctttcttccctccttccttcctttctttcttctctttctcactctctctctttctttctttcctccttccctccctccctccccctcccccccccatccctttccccttcccctctcctctcctttcttgatggagtgtcgctctgttgccaggctggagtgcggtagcacgatcttggctcactgcaacctctgcctcccaggttcaagcaattctctgcctcagcctcctgagtagctgggactacaggtgcacgccaccacgcccagctatttattgtatttgtagtagagacggggtttcaccatgtggccaggatgatctcattctcttaacctcgtgatccgcctgccatggcctcttaaagtactgggactacaggcgtgagccaccacgcccggtctgtgcactttatttctattattacattgtaatatataatgaaataactatagaactcaccataatgtgaaatcagtgggagctctgagcttgttttcctgcaactagacggtcccatctgggggtgatgagagacagtgacagatcatcaggcattagattctcataaagagcgcacagactaggtcccttgcatgcacagtgcacaatagggtttgctcttaggagaatctaatgccgcttctgatctggcaggaggcagagctcaggcggtaatgctcactggcctgctgctcacctcctgctgtggctggttcctaacaggccagggtcccggtggtccccatctgtgacccggagtctggggatccctggatttcggagccccacccagtctctgattcaggaggtccgggagcagcctggcaatctgcgtttctaacaagttcccaggtgttgcagatgccgctgggtgtgctccacactttgggagctgccactgtagtccaccccttcgttttacagatgtggaaactgatttctaggtaaggcagttgccgaacttagagaacccaggcgctttgacagttgtttcttctacttcactctgctgccccccagtggctatttcaatattgccagaaacccgttttgtgcacctgcctgaaatgactacgttattacgtaaattcgggtgttaaaatatgaaccattcttgttttttgttacagagctcattgtatagtaggtgactttatcacattccttaccgaaagcagctgtaacgcacactttactatcattaggcaggcatattgcaataaaataattattaaaatgatcatagaaatgtgcaaagaggtgcaagagataattttaagaagagtaaattgtgcttctgttcatattacaactctgtaaaaactatgtagtgtctctatatttataaaggtataagaaatcttggaagcatatacacccaattgctaatcatggttatttttatgtggtaggatgttcaggagacttttactttcttgtactgtgaagagttatttttggctggatgtggtggctcatgcctctaatcccagcactttgggaggctgaggcatgtggattacattaggtcaggagtttgagaccagcctggccaacatggtgaaaccctgtctctactaaaaatacaaacattagtgtggtggtgggtgcctgtaatcccagctactcagaagactgaggcaggagaatcgcttgaacccggaaggtggaggttgcagtgttgcagtgagccaagaccacaccattatactccagcctgggtgacaagagcaaaactctgtcttaagaaaaaaaaaaaagttatttttacacagattataaattatcgtgaaaaggcccctggctatttaatgaaaggaaaacagcctgtatatatggatatagagttcaaggtcaccagaggacaacagatgctataagagtgtggtgtagttataaaaggaacatttctttctgacatggattaaggttgatttaataacaaattaatatttaaatgaagtacaaagggaatttttggcacatgaaagctaaggccagaagaggtgtcctccgtgtggtgtctcactgtctgggcatggcaggagtccctttccttcatcgtttctgagcccaaaagctttgatggaacagggtcaagggaggtgctgtggagtcctaatagccctggatatggtcagagggagccaccgccctgcttcctgtcaacactcattccagtttgctctccttccagctcaaagcagaactcctggacattgccatggagaaccagaccctcaatgagaccctgggttctttgtcggatgcagttgtaggtttgacctacagccaactggaatccctctcccccgaggctgtgcacggagccatctccaccctcaaccaggtctcaggttgggccaagagccaggtcatcatcttgtctgccaaatacttggcccatgagaaggtcagctggagttttaaactcttttttattcccctaagatgacctaagtgtattagacctgccaggctgccataaaaatatactgtagattgagtgacgtaaacaacataaatttatttctcacagttctggagactgggaagtccaacatcgaggtgtcagaaaggtaggtttcattctgaggcctcttctcttggcctgtaggtggccgccatcttgctgtgtgctcacctgaccacatgagagcaagctctctggtgttgcgtcttacaaggaaactaatcccattggatcagggccccacctgaccctcattatctcatgacctcatctaacccttaaaggcctcttaaaggtctcacctcccaatgccatcacattaggggttaggactttgacatatgaattcttgggagacacaaatatttaatccataacaatcagttatacacacacagcagggggcaaccaatcagtaagaagatgatgctgaggaggactgcctgggttcaaatccttgctctgccatttactagctgtgtgacactaggcaatttgctattttcactttgactcagtttctctatttgtaatatgtggacaacaatagcacttactgccgggcaaggtggctcacacctgcaatcccagcactttggaaggctgaggtgggaggatcacctgacgccaggagtttgggaccagcctgatcaacatggtgaaatcccgtctctactaaaaatacaaaaattagctgggcgtggtggtgcatgcctgtacttccagctacttgggaggctgaggcaggaggatggcttgaacctgggaggcagaggttgcagtgagcagagattgtgccaccacactccagcctgggcgacagagcaagactccatttcaaaaaaaattaaacaacaacaacaacaaatcagtagcacttatcctgtagcattgctgcgaatattatgtgagttggtacacatgaagaagctagaccaccaggtgacaccacagagtaggagctcaaggggcattagccatccctgagtgggatcaacgtgtgggactcatcccaggattttcctgcctgctgttaagctgctattaggttgatgcaaaaagtaattgcggtttttgccattactttgggattagggatgatgctattttattccaatcttgggctgcagagagggaactgtcaggcagacagtcctctttggtggggacaggagtcttaatctgtgttcttgctgctcctggggtggaaaatggacattcttttggggacaattaatgtccctgggttgggtccagtccagagggctccaaatctgggagacttgagttctaagcattttggtgtcatctaattttttttttgatacggagtcttgcccttgtcgcccatgctggaatgcaatggcacaacctcagctcattgcaacctccgcctccgggttcaagcaattctcctgcctcagccttccgagtagctgggattataggcacccaccaccacacccagcgaatttttgtgtttttagtagagacgaggtttcgccatgttggccaggctggtctcgaactccagaccttgtaatccgcctgcctcagcctcccaaagtgctgggattacaggcattagccaccgtgcctggcttttggtgtccttctcgtttagtccacactcctggccacttcccaggatgcaaactggctcacaaggattggattaggacccattccaatcaaataataataacaaacatttgtttatttttggcttctggatattaattttaattactttgaaacaacataatttactaccagatgtttaacaagcacccattataattgctaaactgtgaatttagttttaactgtgtctgaccaactatacaaaactcatcaatttttattttgacaaaaggtagtaggctgggcatggtggcttatgcctgtaatcccagcactttgggaggccaagatgaatggatcacttgaggctaggggtttgagaccagctggacaacatggtgaaaccctgtctctactaaaaatagaaaaattagctggccatgatggtgcacacccgtaatttcagctacttggaaggccgaagcagaagaattacttgaacccaggaggcagaggaggttgcagtgagccgagatcatgccactgtactccagactgggctgagctacagagcaagactctgtcttaaaaaaaaaaaagaaaaaagtagtaggaatcccaaagaataaaggagagactactccttaaaggtcatgtttactaacctagcaccgtaattctagtgttagtacctcccatgcagcttgaaggaggatatgggaagaggtgaagatgttgaaaatgtaaggggccccattttgcttgttctaaagcaaaataccacagtgtctcacaaggaagaaaatcactaggccaggcacgatggctcacgcctgtaatcccagcactttgggaggccgagacaggcagatcacgaggtcaggagatcaagaccatcctggctaacacggtgaaaccatgtctctactaaaaataaaaaaaaaaaaattagctgggcatggtggcgggtgcctgtagtcccagctactcgggaggctgaggcaggagaatggcgtgaacctgggaggcggtgcttgcagtgagccgagatcgcatcactgaggttggaaatgaaaacaaaagcttttgattcaggtggtaaaatgaaaacaaaagcttttgattcaggcggtaaaggggtttaagagttatagagtagaatccatgcatccagaaggcagtgctggagtcggcctcaggaactggggggtttcttcttctttttttgttttttgagacaggttctcactatgttgcccaggctggagtgaagtgatctgatcttggctcacttcagccttgaccccccaggctcaggtgatcctcccacctcagcctcctgagtagctgggaccacaggcacatgccactacgccgggctgatttttgtatttttttgtagagatgggattttgcaatgttgcccaggcagatctcaaactcctgggctcaagcaatctactcgccttggcctcccaaagagaaggagtagggaatttcttcttggcatccaagtctttttaaatttcttcaagtttttaaagctgggtttggtatgtcatggttctgagccagatatattccaaccacattccccaaagtaaatccaagtgggaactggagcaggatgtcggtagagagggcgagggagggatgaagggcagctgcagctccgagggctggtcctagcctgcttcctccatcgcggggccaagggagggagggtgtggaataacaaacatttactgaacacttactatgtgccaggttgtgttctaagtgaattaataacttaatccaacaatcctctgaagtcagtagtgctgtagtcttcattttccagttcattcttgtgaggtacagagtgtgtaagggaactggaaaaggccacgtgaaagttacgcagctgggattgaacccagggcacctggcctcagagccatcttgtttaactcctgtgctcactgtctccattatggcaccatgaccaatgcccacgcactcccactttctgactcaggtaccaggccagcccattcatctggtctcttctagcctcgtggtgactttatgttgaaggctttgaatccttgtttctggaccttgactggggctccatgggtccaccttgacagtcctctctgaatttgattttagggagttgagggagacggttttgttccctcccagcccaggacaaagtggtttgtctctttcctaatacccaactcttcctactgaggggtgaggccacttttactcagaaggcaagaggtcaaaaggtcttgccttctttgaagacagcatgagatcacccattatacacagaataactaaaggaacccactcagctgtcttttcatagaaccaaagcatgtccttgattatatggaaaactatctagcatcttcactctaaaggaaggaaaaaaaacccaagtataatttctttctttctttctctttctttctctctctctctttctttctttcctttctttcttttttctttctttctttctttctttcctccttcctttctttcttttcctttcttccttccttccttccttccttccttccttcctttctttctttctttctttccttctctctttctttctctctctttctctctttctctctttctttctctttctttctctttctttctttcctttctttctctctttctttctttctctctctctctcttctttctttctttctttcctctccctctctctctctctctttctttctttctttctttcttttctttctgacagagttttgctcttgttgcccagtctggagtgcaatggtacaatctcagctcactgcaacctctgcctcctgggttcaagcaattctcctgcctcagcctcccaagtagctgggattacaggaacctgctaccatgcctggctaatttttgtatttttagtagagatggggttgcaccatgttggccaggtggtctcgaactcttgacctcaggtgatccacccgcctggcctctcaaagtgctgggattacaggcgtgagccaccatgcctggccaactctctttcttgatagaaggaaggaaggcctgtggaggcagcatctgtctggctcactgctgtgcccctaaggtgtcacccatccctatacttggcacatagatgggctgagtgcacgttggagaggtgaaaggcgggagcagagcctgactgcgcagccgctcctcttccaggtgctgtctttctacaatgtcagccagatgggcgcactgctggctggggtcagcacccaggccttctgcagcatgaaacgcaaggacatctcgcaggtcctgagaagtgccgtctcccagtatgtatccgacttgtcacctgcccagcagcaaggtatcctcagcaaggtgagaggaagatgtctggtgctcagccacatgtcacagggggtatgtttttggggttggtgagtgggctgtgactttgggccatgaacccagggctgggattgtctcagctgttggtgtctggggtggctctgccttctcctggtggcacaccttccttcctttccagacggagcccttcagtcatgctgtcattcttcccagacccctttgttctgccagacagtctaatctggaagacttttcttaaatcaggtttcctgatcttataacacttcaggttcaagtttgttttttttttttgagacagtctttctgtgttgcccaggctggagtacagtggtatgatcatagctcaccacagtctcctgggctcaagcaatcctcctgcctcaacctcctgagtagctgggaccacaggcatacatcaccatgcctggctaatttttttaactttttgtagagacatggtcttgctatgttgcgcaggctagtctcaaactcctggcctcaagccaccatgtctggctaatttattaattttttgtagagatggagtattgctatgttgcccaggctggtctccaactcctggcctcaaataatccttctgcttcggcctcccaaagtgctgggattataggtgtgagccactgtgcctggcctaaaatttgtttttcaaatctaaaaataaacccaaagtcctagggtgcatctgaaagcccttttcatggtccacagccatgtccgtattctgtttttttgtttgtttgtttagatagggtcttgctctattaccccagccagcatgcagtggcgtgatcttggttcactgcagcctccacctctggggctcaagggatcctcccacctcagcctcccaagtagctgggactacaggcctgtgctgctcactaatttttgtttttctagagatggggtcttgccatgttgcccaggctggtctcaaactcctgggctcaagtgatctacctgccccggcctcctacagtgctgggattacaggtgtgagccaccatgcctggccccttttttacttgtcagggagtcttttgacatcttgctctatcaggtccgttctgtccaatggcaaaatctgttaagaaaccaaaacttggccaggtgaggtggctcacgcctgtaatcgcagcactttggtaggccaaggtgggcggatcatgaggttaggagattgagaccagcctggccaacatggtgaaaccccgtctctactaaaaatacgaaaaattagccgggtgtggtagtgcacttctgtagtcccagctactcgggaggctgaggcagggaaattgcttgaacccaggaggcggagactgcagcgagccaatatcatgccactgaattccagcctggcgacagagggagattcccatctcaaaaaaagaaaaaaaccctaaaacctaaggggtttggcctaaaacaccaataccttgcagatagcaagtagcccatacagttaaaataaagaaataaggagcacgggttttggaatcagacagacttgggcttgaatgtcacttactgactttcaactcatcacactttaagtctctgtttcctcacctgtgaaatggggatgatgctactctccacttcctagggttgctgagcgggtctgatggattttattgcctgtgatgtagtgcctggcccttcctcaaagctcaatgcattttttacaatgttgttttgttgcttctcgcttctggcagatggtccaagcggaagacactgccccaggcatcgtggagatacaaggggctttctttaaggaagtgtctctctttgatttaaggaggcaacctggattcaactctacagtcctgaaggataaggaacttggaaggagccaggtattaccatgaaacacagatcgatcctgtatttctgactatctgtcttgtgagaatgaatggtctgttttaaggttaatttgataaaagaaatttatttctgtgggattagtataggaggcagaatagtatagtgttaagaatttggacaggctgaggcaggaggatcgcttgacgccaggagttcgagaccagcctgggcaacatagcaagcaagatcctgtctctacaaaaagttaaaaaattagccaggcatggtgatgcatgtctgtggtcccagctactcaggaggctgagacaggaggatcacatgagcatgggagttccgcaatgcagtgagttatggtcatgctactccactccagtctgggcgacagagcgagaccctgtctcttaaaaaaaaagttagacaagacctgagcatgaattctggctcccacttatttattagctttggagaagttccttatatggcctcagttttctcatgtgcgaaatggggataattttgataataaaatgagggtcactgatacatgccacctgggctgtgtactgtaagtattcgcggctattatgtgtattattaaatgctgtgagcattgaggccgcttggggggatggtgctgttgaagtggatgctctgccttagtaccatcgttgactacctttgtattcagtcagtcttcattacatgcatccagcaaatgtttatcaagcacagcccaacagtgcgccaggcactgctcacagtgctgagtgtgcaaaagtgaatgaaacgacacaaatccctgtctgttccaggcgctcttgctcagggtctctcatgaggctggatgatgtcccgctgatctattgctgtgtcacaaaccacctctaaatttagtgacagtggcaaccgttttattttattctgttttattttttgagacagagtctctctcggtcacccaggctggggtgcagtggcacaatcttggctcactgtaacctcctcctcctgagttcaagcaatcctcatggctccacctcctgaagtagctgggattacaggcacacaccatcatgcccggctaatttttgtattttttatagagacagggtttcaccatgttggccaggctggtgtcgaactcttgacctcaagtgatctgcccgccttggcctcccaaagtcctgggattacaggcgtgaaccagggcacccagccaatagttttattttggaaaatacattctgccaccgaagacttcaagatacttttgtctcggccattgagctgatgggattgctgtttcctgagatggggaagaccatgggagggtcccagaatttgaccctgagcccaggaaaatctctggggccacaaacagtgtccagaactttcctccatcgtccattccttttgcctgggcttttgtgctgctttttggctctcagctaccatgtctaatgctagctcataatttattctgtctggggaatgatactcaaagtttcagagtctataaaatagacaaatgtagtacttgattgcgtctgcaagttagggattctgtaaaattatgttccttaaaacaaatgactcccctgtctactaggcattgttctagagtgctcattggggggtggtttgaagacagtgcatgctgctagctgcaggtactttattgctggtgctttctagcccatcctggtttattctgggatgcctggtgttcagaacctggcaggtgcacatgtgaataggagacacagggagttctcaactggtcagcagcttcctaaagcacaggaagtaaaactccagccctgccaccaatgtctttgcctctcatctgcctcatggggtgtagagaatcatctggagtgtgagagtggggctctggaattaccttgacactggttcaaatccaggcactgccacttagcaatggtctagtcctaggtaactcacatagcctgttaagcctccatttccccatctgtaaaatgggattgtggaatgccttcctgatagggcctcacagtgttgggcacacgctgagtgtgccatcagtgctaacgatcattctcttctcgcaggctctgttcctgtatgagcttctgttaaagaccaccagaaggcctgaggagcttttgaggtaggaaaatgtaactcggcctgggtgctgaacaggcctttcagagccttctgccagagcagcctacttttccaggtgggagagttaggcagtcacatctgtagcttgtatctgatcatatctgccttctctcgctctttctttcctctcctcctcacttccttcctctcccgagtgccttgttttgttttctagtgctgggcagctggtcaaaggcgtgacctgctcacacattgatgccatgagcactgacttctttctggcccatttccaggattttcagaacaacttcgccctgctttcaccctatcaggtaccgttaaagcattttccagcttctaattctctctccctaccccagtcactgggcctggattggctgtggcatctaaagatctttatgccagaatcattcagacgcaagtgatgacttagggccaaagattgagccaggttttttccagtttctttttaaacagctccaaatacccacatcactacagccaaagaatcaacagattggttattccatactcaaatttaagccttaaaatatattcataagggacagtattttgtgtgttcataattatgttcccgtgggatggaaggtactccttcagctaatattccaacactttccaggagtagctgtgaatgcaaacagtactctgagaacattttctttctcacttaaaacttcattttctaaaaggttatggaggctatttaacctttggggagactagaagcagtaactgatttcttttttttttttttttgagacacagtcttgccctgtcacccaggctggagtacagtggcataatcatggttcattgcagcctcaacctcctgggctcaagagatccttccgtctcaacttcttgagtagctggaactaaaggcacacaccaccatgcctggctaatttatttattttttgcagagatagggtcttgatatgttgcccaggctggtctcaaattcctgggctcaagtgatcctcctgcctcagcctctcaaagtgctgggatgacaggcatgagccacttcacccagccagtgactgatttttcagtgtctaagctagtaaacacaggccttacagcatttgaacttttggtgtgaaccgctggcttacagactcctgtaatggatattaaaaagcaccttctcaactctggccttgtgtttcagaccagaatgaagaatttccaaagagtaaattatctcccagaaaaccaggaagcatagagtgcttggtgtataatccttcaagatcattacaggaatatgcaaagttttaatgaagctctctcattcccttggactgttaattctgttagtgattctcaaagttgagcttgcatcagcattgtgtggaaggctgtaaaaacacaaattgggggccccactcccagagttttacatatagtaggtaaggggtgaggcctaatactttgcatttctaatcagtttgctggtacaaaccactgaactatattaaaagacctgcccaggtgggcaagccaataactgagcaaatggatggaagctagacctgctttgaggaagacctacatgttcgagcaggaagagttgccccagtgaaggtgctttcctaggcttccagctctcagagccttcaaataccagttaattagaaaatttgcctttctcgtttatatttttactaaaacacattattattattattattattattatcattattattattattgagacaggaccttgctctgttgcccaggctggaatgcagtggttcaatctcactgcaacctccgcccctgggttcaagtgattctcctgcctcagtctcctgtctaactgggattctaggtgcgcaccaccacacctggctaatttttgtatttttagtagggacggggtttcatcatgttggccaggctggtcttgaactcctgacctccagtgatccaccagcctcagcctcctaaagtgctgggattacaggcatgagccaccacgcccattctgaaaacacataattattacacacacacacacacacacacacacacacacacacacacacacacaaacaaccaatacagagaaagtaaaatttccccaaattttccccagagcagttgttctcaacagagtactgttttgccctcttaggggacttttggccatgtctgcaaacatttttggttgtcacaaccggagcagagctactggcctctagtgggtagaggccaggggtggagctcaacatcctacaatgcgtaggacagcaccactacacagaggtacctggtcgaaaatgtcaataatactgaggtgagcaactgtgtttcagaggtaactataaagaacagtttgctattacttttgagagttttcttttatatataaaatataggccggtcacaatgactcatgcctgtaattctagcactttgggaggctgaagtgggaggttcatttgaggataggactttgaaaccaacctgggaaacatacagcaagactctaactctacaaaaaaatacaaaaattagccaaatatggtggcacatgcctgtagtcctagctacttgggaaactgaggcaggaggatcacttgaacctgggagttcaaggtggcagtgagttatgatggagtcactgcatttcagcctgggtgacagagtgagactctatctctaaaccaaattttaaaaaagtatctatatgtaatataaaaaccacaagtgggccgggcacagtggctcacgccagtaatcttagcactttaggaggccgagatgggtggattacttgaggttaggagttcgaaaccagcctggccaacctaaaaaaatttttaaaaaatacaaaaaaaaaaccccaaaaaaacccactaaaaatacaaaaaaaaaaaaaaattagccgtgcatggtggggggtgcctgtaatcctagctactcgggaggctgacgcaggagaactgcttgaacctggaaggcggaggttgcagtgagctgagattacaccactgtactacagcctaggtgacagagtgagactgtctcaaaaaaaaaacaaaaaaaaaaaacacaagtgagctcatactatacatgctgttctgtttatatatatagctaagatatatatatgtataaaactatatatatagttaagctatatataactatatgtatagttaagctatatataactatatgtatagttaagctatatatatagtttaacagaattgtgtgtacaatatgagcccatttgtggtttttacattatatataatataactatatatatgcacatgcataaaatagcacagacatcatttagtgttaatatatatataaatctaccttattaaaacaaagtaggtgcactattccattgtatgtatataccataatttacttaaccaatcccctgctgaggaacattaaaattatatctccctttcttgcagatataagcaaaattgcgatgagcattctcacacttaaatgtccgtgttcatgtttgttattacctcagcgttctcatccataaactgggcacagtagtggtacttacatcatagggtgctctattgcataaatgaacacgtatgaagcacttagaatagtacctggcacatggaaagcactgtgtttgttcttcttcttactgcattaaatccccagaactgcttaatctttcaggttaattgtttggcgtggaaatactgggaagtttccagattgtctatgccacctttcctcttggctgcactcccgtaagtgaacatcagcccccaccttctggctcatcagtgagatcggtgggaatcactgaagtcaaaatgattctctccccactgggttttcttcaggaaccagaggcagagtggaggatgccttagagagttaagcccttgagatccaggatttcaattctgagtatcacacagacatttgagacagaccttcttgcttttcctgttatctaaaaaccaagccaaagcaacccaagcctgaatgagtgtcagtgaggcaggtcccatctggcctggctttgcggctgtgccaggctccaggggaatcagagttgaggggagcagtaggcgtttctcctggcatgtgtgagcttttgggcctgcagggtggccctgcttttcaaacatgatctggacattgtttctctccttctctccttctttatttccctctacctttttttgctcttattgtcttcgttcattcaaaaaaaaaaaaaagttcattgagtacttgctgtgtgctagttctcagatagctaaattttctatctgaagatttagaaattcctattaatttataagaccttataatctcatggtgggagagggaatagacaaacatgaagccaattatatcaggttgatatttggttgaaagcaacagaactgaaactgaaactggcttatgcaataaaagggaattttttgttcaggtaactggaaagttcagagagggacttcaggcatggctcgatctaggggtgcaaatgatgtcatttgtctcttgtcccagcttttctctgttggcttcactatcaggcaagttgttcctctgtgggaaccctggaagatctaaggttaaattttcccagtttcatattcagggaaaatagaaaaatgttctcttcccatcattctcaatacacatcttgggtttgactctcattgaccttaattgggcgaatttgttttccttgaaccaatcagtgaggttgggaggatgggtaactttgactgacttcaatctgtattgcacccctggagctggagagaaaccacaaggacttagagtgagggagatggttctccaagaaaaactaggtgctttccaagaaagccaggtgctgttacacacctctgttaggacagaggtggaagaacatgtttgggggaagatgttgaatctggttcttgaacagtcaagtggtgggtttgactaggccagatgggtttcatgcagcctttctcaacttttttattgccttccaaaggagaggcaaaggggagggataatgaggactggacatagaggagggaatatcacccatagactggagagacaggggagaccgaactaatgctggatagagagtttaagatggacattccaggcagtggaatggggatgtccggttcagcagtgggtaagaaaagccaatcactctgggaacacatgggggtatatctgcagagtagataggggagagaaggccagagagttaagggacatcagatcatgggggctttgtaaagtgaggtgtttcacacatattctgtgtgcagccatcagatttatatttcagaaagatcatagccactacccacatagaggatagaatgcagggaggctgaatggaaagaagggagacagctgaagattatttcagtaacccagatcttggcatggcacttctaccactcattcatgtctcagctcaaatggaactgccttagaaggggctcgtttgattatccccattgtcattctcttttacagagccattttattttcttccttacattaattaattaattaattaatttatttatttttgagacagagtctccctctgtcacccaggctggagtgcagtggtgtaatcttggctcattgcaacctccgccacctgggttcaagagattctcctacctcagcctccccagtagctgggattacaggtgtgcgccaccacgcctggctaatttttgtattttttggtagagacagggtttcaccgtgatggccaggctggtctcaaactcctgacctcagatgatctgcttgcctcggcctcccaaagtgctgggattacaggcgtgagccaccatgccagctattaatagctcaaatgtcttgttttgttcactggtttctgtgtttcttctctctgctagaattaaggaccacttgtgtcttgttcattgttatatttggtgcctagaacagtgcctggcttactgtagttgctttgtagatatttgctggatgaatgaagaaataaataagacagtggtactgggaatggagaagttagaatagatttttttgttgttgttgttttgagacggggtcccattctgtcacccaggttggagtgcagtggtgcgatctcagctcactgcaacctctgtctcccaggttcaagtgattcttccacttcagcctctagagtagttgaaaccccaggtgtgcatgccaccatgcccagctaattttttgaatttttggtagagatgggatttcaccatgtcgctcaggctggtctcaaactcctgatctcaggtgacccaccttggcctcccaaagtgctgggattatagctgtgagccaccacacctggccagaagtaagaacagattgggataatgctaaggagatagcaatgacaggcttgggataaagaaaaaaaggagtgtgggatagcatagaggcggaagaacatgtttgggggaagacgttgtatctggttttggaacagtgaagtggtggggttgagtaggccggatgggtttcatgcagactttctcaacttttgttaatgccttccaaaggagaaaattttaatttctcctgaatgaaagaaattatacactgaggaaaaatattttgagtaggaatgagcttcagtgggttacagatcgttgtcataacagtcttttttatctccatccaaaccagtttctccttcttgagggtgactttgaccctgttgagaatacattgtcaagagctgaaggatcaagagtggaaggcagagttctggactggagatgacagaatttctctttccactctttttcttatctttctttctcactttctagttattctctctcctcgttgtctcttttttcatctactttttcctttctttttcatctcccctcaaccagtccatcaatcaacatgtctatttacgagaacccattctctgatcaatgctctggggcatagaagaggagcatgatgggaagtttgttcccacccacagaagagggtcatgatgggaagtttgttcccacccatagaagagagcatgatgggaagtttgttgcccattcatggaagaggagcatgatgggaagtttgttcccacccatagaagaggagcatgatgggtgggaagcttgctacctgctgcagggagccaaagcatcactgggaagaacaaacatttaaagaatgtctttgggatgagctcttgggcaggcggaccctgattttaggggccaacaggagcagccatgtgttcctcctcttgttctccccatctctctccagggcccgctacctggcttctgtcccagcctcccagtgtgtgccctttctgatcagcctggggaagagctggttggactccttggttttagattcccacaaaaagacttcagtcctcaggaaagtgcagcagtgcctggtaagaaaactcttcctgggtgtcccctccctctgggtatctgtggccatcttggggagccctgtgagggatctggctaggatcttgagcctgctgtgatggccagaagtctgactggtgggtcttgaagcttactctaaagttgctggttggaacaatcttttccattggttctggagacttctgccccacggcccaaaggaggggaggctactctggaggaatggaaagagcacagtacccagagactgggtgccagtgattggttatgtggctttgggtgaatcacctttcctccctgagcctcagtcttctcatctgtaaggtggggggagtagcacatcccccttagagttttttttttttttttttttttgggacagagtctcactctgtcacccaggctggagtgcagtagcacgatctcagctcactgcaacctctgcctcccaggttcaactgattctcctgcctcagcctcccaagtagctgggactacaggtgtgtaccactacacccggttattttttgtatttttagtagagacagggtttcaccatgttggccaggatggtctcaaactcctgacatcaggtgatccatccacctcggcctcccaaagtgttgggattacagacatgagccaccatacctagtctcctcatagagtattgaaaacatgacatgggcaatgtattatttaatgtaaaggctcaaaggccagattgtctgggtgtgaatcctagccttgccactagctggcagtttctttttctttaaaaaatggataatagtagtacttacttcttacagttactttgaagatgactagattgagacccacagatactcaggacggtgcccgcacataggaaacacacaataaatgtgaactatttttgtcattttgtgaaagtgcaaaagagctttgaaggctttcaagtggcatacaaactttgaagtgctgttttcattgttgtggtgccaatagtataatggtggttgaagtctggaatattctcagagcaataacagtgacagcagcgctcaattactgagtgctcctggtgtgccaagccagggttttccagatttctgaggcctgcatccctggggaagatcaggtcctgttccatctctaggaatccatggcagggtaggcagttaagatcctggaatctttaagaagtttgggatcggaacttttttttttttttttttgagacagagttttcctctgtcacccaggctggagtgcaatggcatgatcatctaggctcactgcgacctctgcctcccgggttcaagcaattcttgtgcctcagcctctcgagtagctgggactacaggcatgtgccacaatgcctggctaatttttgtatttttagtatagatggggtttcaccatgttggccaggctgatttcgaactcctggcctcaaatgatctgtctgcctcggcctcccagagtgctgggattataggcataagccacagtgcccaccccacaggatgtgtttctaatggctcacgatcttatgctctgttggaactgcccattggctccactttttgggttcaggacgactccattgctgatgagtacactgtggacatcatggggaacctgctgtgtcacttgccggcagccatcatcgacagggggatctcccccagggcttgggcgactgctctacacggcctcagagactgcccagacctcaaccctgagcaaaaggctgcagtgaggctcaagctcctgggacagtatgggtgaggagcggctgggtttggcttttggtggtgtggtatgctctgtggagggacactcaaccttggctctcctgccctgcaaacagagtctctggcttaggatgagataaaattcttatgcttattttggaaatgtgacctttcttcttttggcttcagattttttttttttttcttagacggagtctcgctctgtggccaggctggagtacagtggcacgaccttggctcactgcaacttctgactccctggttcaagcgattctcctgcctcagcctcccgagtagctgggattacaggcatgtgccaccacgcccagctattttttgcatttttagtagagactgggtttcaccatgttggccaggatggtcttgatctcctgacctcgtaatccacccacctcggcctcccaaagttctgggattacaggcgtgagtcaccgcgcctggccttggcttcagatttgctgtaaagtggaatcaatagtagctgccctaaaaatctcaaagagttgtttcttacacagcttggcatatgaaggggaaatttggaaaaggtggccctttacagatgcaaggtagtggtattattattagtttaaagactattttttttttaaatggggtctcgctctgtcacccaggctggagtgctgtggcacagtaatggctcactgcagcctcaacctccctgggctcaggtgatcctcccacctgagcctcccaagtagctgggaccacaggtgcacatcactgtacccagctaatttttgtatttttttttaagggatggaatttcaccatgttgcctaggtgggtcttgaactcctgggctcaagggattcacccacctaagcctcccacagtgttgggattataggtatgggccaccatgcctgaccctagagactatttttaatactagttttaggttctcagaaaaatggagaagatagagatttcccatatctctctgaccccgtacacgcataagctccccatgatcaatatcccccaccaaagttgtacatttgttagaactgatgaacctatgttgacattatcgtcattggattctcattatcatccatagtccatattttacattaggattcactcttggtgctttacattctatgggttcagacaagtatataataacatgtattcaccattatagtatcatacggagtattttcactgccctaaaaatccttccgggctttgcctgttcattcctctctcactcctaattcctggcaaccactgatacttttgccttttctagaatatcatatatttggaatcatacagtagatagccttttcagatagacttctttcacttagtaatatgcacttaagttttctccaggtctttttttggcttgatagctcatttctttttagtgctgaatcatatttcattgtcttaatgaaccacagtttatttagccattcacctacagaaggacatttggttgcttccaagttttggcaattatggataaagctgctatcaacatccatatacaggttttcatgtagacgtaagttttcaactcctttgtgtaaataccaaagagtgtgtttgctgggttatatggcaaaaacatgtttgcttttgtaagaaaccaacaaaatgtcttccaaagtggctgtatgattttgcattcccaccagctgtcactgctaattgggcagacctcctttagagatgtcgccaaagatagtgtaatgctcttcactgtaggcatttatgatctatacaagaataacagtggattctgggtcagtgcctttattttatcctgccaagttcaagagaaaggttttttcttattctaagagaagactgttatggtaaagtaaaaggaagaaatatataattactcttctattgaggagggagaagaaggacacactgtgatgtaaatggcagaaattcaataatttaattcaaactaaagagaacgggaatgtattgaattcaggaatggaatgtaacgggaaactccactggtggtcttcaggcatggctgaatcccgtgtctcaaatgatatcttcaggaatatgttcctcccatccctcagctctgtgttccttggtgtggtctttactttttccacttggtaatatgaatgtcctccaatatcctcccctactgccagagataccagagaaaggagagcttctctgatagttccatcaaaactcccagggatgactctgattggtcagcctgcatcacatgccaattttcttggtcaaggaagtgggaccatgtgattgacatgagtataagacaatctattcctgaaagaaaagggtgctgggggaaaaggcaacagatgtccaccacagcatgttttttcactttactggttattatctctttttagactccctcagcactggacagccgagaccacgaaggacttgggaccctttctagtacttttctcaggagatgaattaagctctatagccacaaaggtaatgttgtgctccatcttaagaaggctgaaggagtttgaaggggagagaaagtgtggtcagttatacagcattgggtttactgctgtctatggttctggaagcttcctccctgcctccaagggctaagatgtttccagctccattccaggatgtgcaaggttctggaaaagggagtgagtccacagctaaatgaactcaggcccttttgtgtggccccccaggcagatgtgtgcagacagatattacttagctaccactctgctattagtgtgcatctcacacgcacgtctgttctggctctcacactggctggtgccctatgcacatgcacatgtatgtccagtgtatgcaatcacatgtgcaagcacatttaatccaataacaagtctttattgatcattacatttgggcatgacgcttttctaggagtaaggctccagaagttagacagtctagaccaaggggcatgcaaaataagcatgaattagtcatttgtgctgcataacaaagccacacaatctcaagggcatagaacaattcgcatatgttccttgctgcctgatttgtgggtcgctggggcagccctgctctagaacttgtttttcttaccatgaaggtatgaaactaccaaaaaagggaagggataagtacaattctccttaagtcctaggttggaagttggcacgctgtcacttctgccacactccaatggccaaagtaagttacatgaccaagaccaactttaatggggcaggaaggagtctccttccatggaggtggagggcaggaaaggagtgaatgtttgctgaatgacaatcagatcccccacaaagcacatccacacactctcatacctgcacttgcaggcacaaggtgcacatggtcacacatgctcagcagggcctgaacacacacaacttcacctaggatcacacgcagcacattctgaagtccagtcacagtaaaatcatattctggatgtctgaatatatagttataagcagttgatgcacacatgtttatttttattttattattttattttattttgcgatggagtctccctctgttgcccaggctggagtgtagtgatgcaatctcggctcactgcaacctctgcttcctgggttcaagtgattctcctgcctcagcctcccgagtagctgggattacaggcccctgccactatgcccagctaatttttatatttttagtagatatggggcttcaccatgttggccagcctggtcttgaactcctgacctcaagtgatctgcccgcctcggcctcccaagtgctgggattacaggcgtgagccaccatgcccggccctgatgcacaaatgttatatatccatctattttttttccttccttgtttttcttatgtttagatgtttattattatttttatttttccataaggtattggggtacaggtggtgtttggttacatgagtaagttctttagtggtgatttgtgagattttggtgcacccatcacctgaacagtatacactgcaacatatttgtagtcttttatcccttggcccctcccactcttccatccaagtccccaaagcccattgtatcattcttatgcctttgggtcctcatagtttagctcccacatatcagtgagaacatccatatatctatctaatcttaaaaaaatcaacttctgaaattgaaaaagtcttgcatcaacactgtgaaatctcaaaaacacagtgtagagttaaaaaaaaacccagattgcaaaagaatatctatagtaggatacaaagtaaataaataaatagtagctgaattaatttaaagcaaatgtaagccaagtttatatgtaagagaagtgtaaaagtgaatgccaaattcagagtgacagttacttctggggaaggaggaaggcaaagagtgaaggagggacttattatttatattgtgatgttttatttcttaagttgggttgtgaggacatgggtgttttgttgtattattctgtatactctttttttaaatactggaaatgtttaataaagcaagtaatacatgctcctggttaacaaatcccaatcgcaccaaaggtaataggatgagaagcaagtctccctcccaccccagacttctagttccctagcctccctcttcagaggcaattgctgtccccaatctcttctgcatcctttcagaaatatcctgaatatctatataacaagttttatataggtataaaaatacctatataacaagcctcgccaacatggcgaaaccctgtctctactaaaaacacaagagcatatacacactcttctttagaaaatacaaaatggaaaatgccattcactccgctatgcatattgctttctaaaagttaactgtcttagagtggttgccttcagcctcagctgcacattagaatcacctggggagattccaagagggaccaatccatggtatccagcccagcccgactgagtcagaatctttaggggctggctctgggtgtcccaggtgactcttaggtacagccagggttgaagaactgctggcttagactgtgactctaattctgaagatgagactagaaaggggagctacataggctgagaggcttgctctctgggtgagccgggacccagtgaggcatagctgtttgtagagcctgatggattatctgggcccatgggcaggccttctaataaaatcccaagtcttgacaaagtgtattcgttctagatgagaaatggcactttctccaaggcaacccaaagtcccctaagtcccctcattgctagtctccacccaggatgttgagacaacccttcttcacctccttttcatgacaaatgttgtgttaggcaattctttttttctttctcttttttgagatggagtctagctgtgttgcccaggccggaatgcagtggcacgatttcggctcactgcaacctccacctcctgggttcaagtgattctcctgcctcagcctcctgagtagcagggattataggcatacaccaccatgccgagtgaatttttgtattttttgtagaaacggggtttcaccgtgttggccaggctggtcttgaacccttgacctcaggtgatctgcctgcttgggcctcccaagtgctaggattacaggtgtgagccaccgcacctgacctgtgttaggcaattcttgcattgctataaagaaatacctgagactgggtaatttataaagaaaggaggtttacatggaatactatgtggccataaaaaagaatgagatcgtgttctttgcagggacatggatggagctggaggccatcatccttagcaaactaatgcagaaacagaaaaccaaataccgcatgttcttacttataagtgggagctaaatgatgagaacacgttgtcacatagaatggaacagcagatactggggcctattggagagtgaaaggtgggaggagggagaagatcagcaaaaataactaatgggtactaggcttaatacctgggtgattaaataatttgtacaacaaacctccatgacacaagcttacctatataacaaacctgccatgtacccctgaacttaaaataaaagttaaattaaaaaaaataaaataaaaagggccaggtgcagtggctcatgcctgcaatcccagcagtttgggaggccgaggcgggcagatcacgaggtcaggagattgagaccgtcctggctaagagggtgaaaccccgtctctactaaaaaatacaaaaaattagccgggcgtggtggtgggcacatgtagtcccagctactcgggaggctgaggtaggagaacggcgtgaacccagggggcagagcttgcagtgagccgagatcgtgccctgcactccagcctgggtgatagagcgagactccgtctaaacaaacaaacaaacaaacactgccaggcacagtggctcacatctgtaatcccagcactttgggaggccgaggtgggcgaatcacttgaggccaggagtttgagaccagccaggccaagatagtgaaaccttgtctacaataaaaataaaaaaaaattagcctggcttggtgctgcatgcatgtaatcccagctactcaggaggctcaggcacgagaattacttgagcctgggaggtggaggttgcagtgagtggagatcacaccactgtattccagcttgagcaacagaacaagactctgaaaaaaaaaaaaaaaaaaagagacaagaaaagaggattgattggctcatggctctgccgactgtacaggaagcatgatgctggcatctgcccagcttctgggaaggcctcaggaaacttacaatcatggcggaaggcgaagggggagcagacacatcttacttggccgacacaggagcaagagcgtgatgggggaggtgctacatgcatttaaacaacaagatctcgagagaacgcacgcactattgtgaggacagtaccaaggggattgtatttaaccattcatgagaaatctgcccccatgatccaatcacctctcactgggccccacctccaacactggggattacatttcaataagatttgggtggggtacacatccaaactatgtcaaatataaagtttagtaaaaacttagaaatagcaccaaaccaaaaaaggggtaggtacacatacattttttttgtttttttctgagacagggttgtactcccatcacccaggctggagtgcagtggcatgctctcgactcactacaacctcagcctcctgggctctggtgatccttctgtctcagcctcctaagtagctgggatgacaggctcatgccaccacgactgactaatttttgtatttttagtagagatggggtttcaccatgttggccaggccagtcttgagctcctgacctcaagtgatttgcctgcctcgacctcccaaaatgctgggattacaggtatgagccaccacacctcgcctaacctacattttttgtcgatattaccagattgctctgctaatagtgcacagtttgacagtcccacggaaaaatgaatgtgcccagcattaagtattagcacttcattttatttttgacaatctgatgggtgaaaagtgatttacttatgttttttagactttattggatttttattgaagttgagtatcattttataggattctttatagagaccacattagtgggactagggaatagatttatatgagaagttgctataacaaagaatgaaggcagtaagtagtgtgacagtttcaactctaatttcaatctgtatttaaggggttttaattattattcctcttctttcatcttctttcacacagtttcctgagatccttctgcaagcagcttccaagatggccaggaccctgcccactaaagaattcctctgggctgtctttcagtctgttcggaacagcagtgataagatccccagctatgaccctatgcctggtgagtgttttcagggtatctgagccattgctgacatagtaattaatgttttgggcagggtccctgacatcaagaggcctccttatgcagggaactggatgaaatgtctgcaaagcaatagaatgacaaaatctataagcaaaagaattacacttttggttcaggtgcggttgctcaagcctgtaatcctagcactttgtgaggttgaggcaggcagatcacttgaggtcaggagttcgagaccagcctggccaacatggcgaaaccctgtctctactagaaacacaaaaattagccgggtgtggtggtgcatacctgtagtctcagctactcaggaggctgagacacgaggattgcttgaacccaggaggtgaaggttgcagtgagctgagatggcaccactgcactccagcctgggtgacagcgagactctgtctcaaaaaaaaaagagttacacttttgtaaagtgacctggaatcatgtcccatactccatacccaggctagtaggtttaatgcgtgaatatgtgtaacaaacatttcagtaggattgacttagaggaccaacatggattagtggtttaacatagcagtgacagggccgggctggctacatttcactcctgagtctgccacttactggctgtgtggctttgggtaagctctttaacctctgtgtgcctcagttttcatcctttatcaaatggggataatgaaagtctctacctcactgggttattgtgagaattaatgggtttaaacccagaaacatgtttaccggaatgcctggcatgtagcagatctttaataagtattatatatttttaaaatttgattttttttattttttgagatggagtcttgctggagtgtcacccaggctggagtatagtggcatgatctcggcccactgcaacctccacctcccagattacagcaactctcctgcctcagcctcctgactagctgggattataggcatgtgccaccacgcctggctaagttttgtattattagtaaagacggggtttcacaatgttggccaggctggtcttgaacgctggcctcaggtgatccacctgccttggcctcccgaaatactgggattacaggcgtgagccactgcccccggcctaaaatttgattttatagaggcagggcctcgctctaccacccaggctggagtgcagcaatcatggttcactacagcctcgacctcctggactcaagggatcctcccacctcagcttcacaagtagttgggactacaggcatgaaccaccacatctggataattttttatttttttgtagagatagggtcttactgtgttgcccaggctgatcttgaactctgagcctcaagtgatcctcctgccttggtctcccatagtgctgggattatagatgtgagctaccatgcctgtccaagtgttagatattttattattattaccatgcacctactaagtgcagactggggccaggcatgaggagacaaagttaatcacccccagtgatagtagttgacagtcagtgcttgctttcatccacccaacaaatattcgttaagcaccaattttgtaaataaagagcttactttcaaatggagggtagcaagacaataaatttccatacataagtaaaatatatggtatattgtatgaaaagtgccaagaaggaaaataaagcaagggaatgcaccacgagtgttgagaggggactgtcatgtgaaaagagaatcatgaaggaacatcttattgagaaggtgacatttgaatgaagacccaagggagagtgggccatgtggatattttcaattagagtcttccaggcagagagtgcaacaggaccacttccatgagtgggaggtaagggccagtgtgtttggaggggagtgagagacaaggccagccatgtagtgactgttaaaggaaaccctaatgactttggcttttactctgggtggaggcatcgtgtgacatcgagcaaagaagtatcacaattggatttgtgtctaccttgggtgattatccctccatgcattatcttgttctcccgttttttttttttcttggtgaatgtggggttttattgggtaatggaggtggctctcggtgggatggatggggagctagaaaggggatggagtgggaagatgatcttcccctggagtttggctgtcctgtgaccaatctcctctccaactgtccccagccaaactcttcttggccttcagatgctcctttctctgccatgctgctcttctgctcctcttctcttctgttcatctgctcatctgcttgtatgctcatggagcctggggtttggggtttatatgggtacaggatagtgggatgtggcaggccaaaacctaacatttgggcgtgaaaacaggaatgcctattcccatttagggctgcagatttccaggcttgggtgttctcttgttttttaaatgaaggaaactggggcttaggagactaagggacttgtctaaagtcacagagttagtaaatggcagttcttggatttgtacccaaagttggtggtgaccaccactggctcccactgccctcaaggtctagcagtccatgtcatcatattgcagagctcttactgtgtgcatgtggtacacaaaataaggctttccatgctcaggggaaggaagctctggtatcagtgcatagtttgagtgttctttagttggttctgggtattaattgctgctgtgctttagtgattgatggattagcagaattaccgcttggttttatattaatttgtgtgtgtgtgttcactcactccacagatatttgctgaacacctacgatgtaccaggctctattctaagccctggacagacacagtgataagaccaagttcctgatatactagtcaaccattctgccctctctagttctgtgctatcactgatgttgttttcactagagggtgggctgggggttggcctagggagggatgggtctttagtcctctccaagtggcttatgataaagatgtttgaggaccacaactggcatctttgatctggtctacttttgcctcgtgattggaatgcagtgaatttccattgaaggtgcaatgagaagagagaggccatggggctcgggaaataccctggccttgggtggggttggtgcatctgtcagcatcagtggtggtctgcggctaagataagaaatccagggttgctcttaaggatcctagagttttctcccaggttgggcacatcagatccagcaaagacaatatctcacttgcatgttggttggtagctggtttgagtaggtaaggttcacattattcaaagaccgaaatggatgtttttcctgttgccaagagaaatgcaataggctcatttctcttttctcttgggatgggaaagccacaacccccactatgattttcatggacagcaactcatcttcctggtttttattttttattttattttgacacagggtctcaccgttacccaggctggagaataggtgtgatcacggctcactgcaatcttgacctcccaggctcaggtgatcctcccacctcagcctgctgggtagctgggactacaggcatgtgccaccatgcctagctaatattttgtagtttttttttttttagaggtgaggtcttaccatgctgcccaggctggtcttgaattcctgggctcaagtgatccttctgccttggcctcccaaagtgctgggattaaagacatgcgccaccgcacagcccatcttcccatttttataggaaggctgctgcataattttggaatctttatgctgggctgcaaactcaaaggcatagggggtaagataggcaacagaaattgtgtatcgagtgcttactgtatgcgtggcactgttctaagtgctttacatataacacatttagttttcacaaccatcctatgaggcgattttatttccattttatagacaagaaaactgaaatacagagaggttaaatagccttggatttgaatcgaaagtcaggactgttcaccaccagctcttactgccctcaaggaatttgtagtttaattgtaatgttgcaccgctcctagtttgtgcatgtggatgtgcaaaaagctggcatttccatgactttgttacccagtaattagcaagaaatggcagaagtgggattcaaactggtccctgcctcctgctctctgcttttactctgtagtcccttccatgcataaatctgactggcaaagaatgttactcatttcaatacactaacatttcctgaaattctctttcctcttctccttccctgcatctctcctttcttcaggttgccatggagtcgtggccccctcttctgatgacatcttcaagttggccgaagccaacgcctgctgggccctggaggacctgcggtgcatggaggaagacacattcatcaggaccgtggaactgctgggagctgtccagggtttcagccggcctcagctgatgaccctgaaggagaaagcaatacaggtgaagcccacctcagggaggaaacattaaacagaggaaaaaagaaaaacaccaaaaccagttcagcatttctgcacatagaaccctcctcgagcagttttcccatacatcatcttgaaattttactgcatcagctcagtgatattgtgatctccttatctgagaaaggaggaaatttccagttcctccctcttagggctgtggcagagaatgggatgagatgtgtcttggcatctagcagatgctcagtgaatcaagttctgtggatgtcccagtgcctctgaccaaggcggtttgcaggaattaggctttattccttcacctggagagccccagctgctgctcacagcaggttttctcagaatcatttgcaaatttgtctgaaaatataacagaaaggagtaaaaagaggactggaagtagctttccatctttaaaaaggtccctttgttggctgggtgcagtggcttatgcctgtaatcccaacactttgggaggccgaggcgggcggatcacgggaggtcaggagttcgagaccaggctggccaacatggtgaaaccctgtctctactcaaaatgcaaacattagccaggcgtggtgtcatgtgcctgtagttccagctactcaggaggctgaggcaggagaatggcttgaacccgggaggtggaggttgcagtaagccaagattgcgccagtgcactctagcctaggcgtcagagctgataccttgtctcaaaaataaataaaaataggctgggtgcagtggctcatgcctataatcccagcactttgggaggcggatcacgaggtcaagagatcgagaccagcctggcccacatggtgaaaccccatctctacaggtggcatgcacctgtagttccagctactcgggaggctgaggcaggagaattgcttgaacccgggaggcggaggctgccatgagccgagattgcgtcactacactccagcctggtgatagagcgagactctgtctcaaataaataaataaaaggaaaaggtccctttgtggcctgttttagcttttctttcttttttttttctttttcttttaagacagagtcttgctctgtcgtacaggctggagggcagcagcgcgatctgtggttcactgcaaactctgcctcccgggttcaagtgattcttgtgtctcagccacctgagtagctgggactacaggcacaagccaccatgcctggctaataattgtattttagtagagacggggtttgtttggccaggcttgtctcaaacccctagcctcaagagatctgctcaccttggcctcccacagtgctgggattacaggcatgagccactgcacccagccctgttttagctctttacatggttgtggaatatctagttaccctcaagggttaaacaattcaatgtcttaaaattataaatataactgtatttatgtattatatgagtacttcaagtttattgtagaaaagtcagaaaataataaagaagaaaatcagtgataatcttttactcactgttgatattttgataagcactgttcagcagataagcactgttgatattttggtatattcacttgaagcttaccagactccaaaactatgtatataaaaaatattattttatatatttcatacatatatctcatgttttacaaaaatgatattatacttacctactattcaataacttgctttctacacccaacagtacagactgcatattttttcatatccaaaatgtacatctatgtcagtattttatttatttatttattttttgagatggagttttgttcttgttgcccaggctggagtacaatagtgtggtcttggcttactgcaacttctgcctcccaggttcaagcaattctcctgcctcatcctcccaagtagctgagattacaggcatccgccaccatgcccggctaatttttgtatttttagtagagatggggtttcacaatgttggccaggctggtctcgaactcctgacctcaagtgatctgtctgcctggcctcccaaagtgttgggattacaggcgtaagccacagcatctagcctatatcagtattttaaatagctttgtaatacaattagccttccatatcagtgggttccacatctgcagattcaaccaacctcaggtagaatgtatttagaaaaaatgatccaaataacaatataacaataaaaaacaatacacataaaaatacagtagcatttttgacataacattttgtacatatttacatagcacttatattgcatcaggtattataactaatctagagatgatttaaagtatacatgaggatgtgcatagattatatgcaaatactacactattttatataagggacttgaatatccatggattttggtatctttaagaagtcctggaaccaatccttggtggaggtatccacaggggcaacttcattttatttatggttagttcttatttatttagctaattgttagactttcaggttgcattaaaaaaatgcctcaatgtatgcctttatacatatactgttgggtacttgtctcatttactcaggctaaattcccagaggtggaatttctgggtcaaagaatataaatactttaaaagcttttgatacagatagccaaattgccctctcaagagtatgtaccaacttatattctcaactacaacaaatgagggtatcccttaccttgtatctttccagtatcgtaaatggtgataagtctttatacttcttgacatgtgatgaatcaacatggtctgattgtttttaatgtatatttctttaattatgactgagaataaagttttccccatacatttaatttttcttttgtgaattccttgttgatgtcttttgtctatcttttttttaaaacaaatatagtcatgtttttattattgatttaaaagagagctttatattaagatttaccctatgtctttttaatttttatttattttttattaagggatagttgacaaatacaaattatatatatttatggtgtatacatatatacaatatgatgttttgatgtatgtatacattggggaatggttaaagcaagctaacatgtcaatcacctttcatacttgtccgttgtcagtttttgttgtgagaatatttaacatctactctcttcacaattttcaaccattcaacacattattatcaactgtggtcaccatgctgcacaataggtttccctatgtctgttttatttttatttctttgagacagggtctcgctctgtcacccaggctggagtacagtggcaccatcttggctaactgcaacttctgcaagtgagtcttgtgcctcagccacccaagtggctgggattacagatgtgcgccaccatgcacagctaattttttttttttgtatttttagtagaggcagggtttcgttatgttggccaggctggtcttgaactcctggcctcatgtgatctgcatgccttggcctccaaaaatgctgagattccaagtgtgagccaccgcacctagcctccttatgtctattttagatactgcctttgtccattcaggctgctataacaaaatatcatagactggtaacttataaacagaaatttatttctcacagttctggggggtgagaaatcaaaaattgaagcactggcagatccagtatctggtaaggacttgtttttcatagatggtgctttctcactgtgtcctcacatggtggaaagggactagcttgtagctagctctctggggtctcttttacaagggcactaatcccactcatgagggctccacccttatgacctaatcatctcccaaggcccaaccttccaatactatcacattggagattaggttttaacatatgcattttagaggggcacaaacattcaaatcattgtaaataccatcacagtgttcagtctaatctattttctttttttgcctaaaggtttgggacatgccatcttactggagagaacaccatatcgtctccctggggcgcattgctctggctcttaatgagagtgagctggagcagctggacctcagctccatagacactgtggcttccctaagctggcaaacagaatggaccccgggacaggtgggtggatgtttctgggtcttttaactattccatatttataagagctgccttcatatccttactgttaatttcctcatgatggtcatttttgagtctgtttctgttgactgatttttctcttagttatgagtcatattttctttttttgtttgcaagcctagcaattttgattgggtgatgagcattgtggattttacattgttgagtatttgatttagttgtatttctttgaagagtattgggctttgttctgtcatacacttaagttactttcaaatcagcttgatccttttgatgcttccttttgagttttgttagggtaaaaccagagtgacctttattctgttgttaatttatcatcattactgtgacatgattcctttgaggatgttacctaatgctccatgtatttcaagatctctctactttggctggtgagaatgtgaactatttccagctccatatgagctctggaagttgctcagcctaatcctttctgattactgatgactcttttcctgcctatgtggagtttcactctttgcatgtgcaaaatagcagtcagtactagacatctctgcagctttctggaaccctctgcagtttcctcctctccaatactttgcccaagtgataagtgccgtggcctctctgaacttggatatctgtatcctcaactcagctgggccactgggcttgttttggttcctcttcctgatccatgtcttggaaactgctttttggcagtaagtgagggtaattttaaggctcatcttgtttgtttttcttcttctgggattatgattctgttgttccatatccggatgcagttgtctgatgtattttgttaaattttctagttgtttatggtgggtggccaattcctatgttaattaatccttcatgggctaaagaagaagttcttcccagaattttaattgttttgattgggagaggagtttagggtgtctaatccactgtactgctggaaagggaagtgttagcccttccatgttatcttcgttcttaggcagctctctcagtggtcattttcagcactaggcttatatacaacctaattaacaagcccataaaaatgtgcctcttctttattagtttttggaaaagcctcagcattgactccactcatgtagttgcccgcccctgagcaaccactctggtcaggggttgaatatgttggttggcgaggcctgcatcagggagcggagtccatcttatcagcatctcatgaccacatgagccgagtggggaaggatatgtggtgggctgattaaggtccccgaaagatgtccatgtctgaacccctggaagctgtgactatgttaacttatggagcaaaagggactttgaagatgcgattaaggatcttgagatgaggaggttatcttggattatttgggtgggcccaatgtaatcacaagggtccttttaagaaggagcaaggagggtcatagatagagaaggtgacatgataatggaagcagagggacctagaaagagatctgaaggtgctctgctgctgattttggagatggaggatggggctatgagccaaggaaatgcaggtggcctcttgaagctagaaaaagcaagaaaatgaattcttcttagaactcccagaaggaacccatccttctagtccattttaggacatacagtctccagaactataagagaataaacgtgtagttttaaagccactatgtttggggtaatttggtagagtagcaataggaagctaatggagggtaattttccaaagaaaaagtgtggacgctgagcagccaaaaccaatgaatgtccccctactcttttgagctttttgtaatcacggtggccatgtttcataactctgagtggcaccattcaaacagaatacactgtgaatggtgcacccctggagctgggcaacatgcagatcctggccatgaagattacatgagttaatacttgaaaacattttgaacaatgtctggtacatagtagtcaataaaaattagctgtttttatgttgatattgacatcattgcattgtcatcatcaacattatcatcattacagcccctttctctgggttagtctcctcctttgcaagatgagagggttagccccaacaatctgaggttccttccagtctgatattctataatcccatggttctttgactctaaaactggttttgactagtttgagaagtgccacatcacactgtgctattaaaatcattctatttgcaggctcggagaaacagaaaaatacatgcagaaactagggtatctccttcccttcgcaccgattttaattctcatggatggcagtgagatttatcaatatgtttgaagaggatatgaaaacctaacatttgcatgtatcatttgtagtcagttcttcaactttagctcccaatcaaccttaaatgcaggtttctagattaatagtcagacctgacggaactacattaacagatagttcagctcaaaaaccaatataagggaaaaaactattatagaagccagagggatgaacagagagattgaaatcttaaagctattcatttttcaacagttaatattgcctaaaagtgttggtattaattgtcttggaatcattacatatacactggtctcgtcactcaaggaaatttattttaacttatcaccttgcaggctgagcttgcattttccgggtttcagtggcaaggacaatttaataccatatcttcaaagtaattttatttaaattgtatttttgcactttcattttaaagtgagcgtgcctgatagttgaggagcccaaattgctctgagtcaactagtgaaacctgattatgaagacttaataagaaaaatttgaaaactaacttgaatctccatcttttctccatagccaaacaccttcactggctaagagtatgggccctggaatcagactgcctgggttttgatcctagaaccatcattttcttttctctttcttcttcttcttttttttttttagaatgagttttgctcttgttgcccaggctggagtgtaatctccactcactgcaacctctgcctcccgggttcaagcaattctcctgcctcagcctcctgagtaactgggattacaggcatgcatcatcacaccctgcttattttgtatttttagtagagacggggtttctccatgttggtcaggctggtctccaactcccgacctcaggtgatctgcccgcctttgtctcccaaagtgctgggattacgggcaggagctacggcgcctggccagaacgatcattttctagctgtgtgatcttggcctagttacttaacctctccttgcctcagtttgctcatctgcaaactagggatactattaatacttacctcatagtgttatttaggaggattagatgagatagtatgtgtaaagtggtcaaagtggtgccagcacacagtatgcactcaagaaatgttagctacaataaatgttagctattaccactttggatatacagtcccattaagtcaaagacatataagtctaagcatggtgttactgcatcccccgcccccatagtagctgtgagctttgtaatcatggaggacaacttgatgaggacactgaccagtccgattttcagaaacatgagaaatcttcctgaagccagtctattacatgaaggcagcaaaatgaagcatgtcaaataatatatattgcccacgacttttgtaagtcactcactcagatgttgtttcattcattcattcattcactcattcatttacttactcaagaagtacttattgaactcctactctgtggcaggcattatgctaggtgctggggactcattggtaaactacctggatatggtccttttcttttgggagcctacttggtgatacagacaaaaaagtgagtaatcaaagtgaaaaatttgaaaaatcacgataagtgatgcggaaaatggacaaggtgctcatgggaatagtgggaagaagggctgtttgagatgaaagagtccagagggcagttttctctgagtaggtagcatttaaacacacctgaggggtgggaagcaccagcccatgaagacggaatttcattgcaacatttcacaatcttcctcaacactttctctcaacaccttaatgatctatattgtgtgatggggatgactaacattaaacggagatgggggtcgggcatggtggctcatgcctgtgatcccagcactttgggaggctgaggtgggtagatcacttgaggccaggagtttgagaccagcctggccaaaatggtgaaaccctgtctctactaaaaacacaaaaaattagttgggtgtggtggcgggcgcctgtaatcccagctacttgggagtcagaggcataagaattacttgaaccctgggggatggaggttgcagtaagccaagatcatgtcactgcactccagcctgggtgacacagtgagacgctgtctcaaaaaaaaaaaacaaaaaaaagcaaagagagttgggaagattgactatagcctgtgattttcgcttccacttaggggtctctccttggatgtctcctcatctttgccttgtgaggtcttataatctcttttacttgctcccatgagcactgaaggaaccagactttattttgtgagacagagtctccctctgtcacccaggctggagtgcagtggcacaatcttggatcactgcaacttccacctcccaggctcaagcaatcctcccacctcagcctcccaagtagctgggaccacaggcacgtgccaccatgcctggctaatttttgtattttttggtagagacaagctttcaccatgtcagccaggctggtctcaaactcctgactttaagtgatcctcctgcttcggcctcccaaagtgctgggattacaggtgtgagccaccgtgcccagcccagactttattttgtagctgatcttcataggattggcttggatgcctcctcaggtcctacataggtagataaaatgaatcagcacatgtttagttacaagtggcagaaaacccaacacaaactggcttgaacaaataaaggggctgggtgcactgtgcagtggctcatacctgtagtcctagaactttgggaggctgaaacgggcagatcacttgaggtcaggagtttgagaccagcctggccaacagtgaaactacttctctactaaaaatacaaaaatcagccaggcatgttcatgcctgcctgtaatcccagctactggggaggctgaggcatgagaatcgcttgaacctgggagagggaggttgtagtgagcagagatcatgccgctgcactccaggctgggtgacagagtgagaccttgtctcaaaaaaaaaaaaaaaaaaaggaatttattgactcccattactggaaagttcaggggtagtgttcagatacagctggatccaggatcttcaacactctgggtgggaatctgtctcttatcatgtttttgaactttgcttttctttgtgttggcttcattgagagacaggctctatgcctgcatgtggtaggttccagcagatccttgtgtatatccttctaagttcaagtccagagtaaagaaagctcttcccctaatgctccactcaaagttctggttgactctggttaaatcacatgtccaatccagaaccagtgactgcagctaggctaaggtatgaattgaaattcatcactcctggaacttggtgcagttagctttgactgaaccacatgaagcaggaatacaagagaggtggttctccagaggaagttatgaatgatgaatagccactgtgctagaattatggagacttatgtgtcagccgccttaaatcaaggcttagtttaaaatagtttaacaccaaagcattttgtgtgctactcttggaattgaagagtaaacattggaattgaaggggtgaacatatttctgtaggaccacagaggaagaaaaaatcattaaggggtaaacatatttctgtaggaccatagaggaagaaaaaatcattctggctgaaacctcatgaagaaggtgacatttgagttgaaccaaagaaaaaaaaaaaagaatgtctgcacttggaagtgcagaagggcatttcagatgaaaggactggtttgaacaaaggcaaagagacaggaaattataaggttttgttggaggttgtggaaaggctgggtgcggtggctcatgcctataatcccagcactttgggaggccgaggtgggtggatcacttgaggtcaggagtttgataccagcctgggcaacatggtgaaaccccgtctctacaaaaaatacaaaaagccagatgtggtgatgtgcacctgtaattctagctacttgggtggctaaagcacgagaattgcttgaacctggggaggtggaggttgcagcgagctgtgccactgcactccagcctgggtgacagagcaagactccgtctccaaaaaacgaaaaaaaaaaaaaaaagggagaagaaacgttgtggaaaaagatgctggaaaagtttggatcctgatgcagaagaagttgtatgtccaaactgtctgagggtcataagagtgactgaaggaaataagcagcagacacacaggacacaagtgcctttaatattggtgaaggatgtaagagattcattgcctgaagacactttcatagattaggggacatactcagttgaagtagtatcttaaggacatgaacttggatgcagaggccaggatggtttggagtggggattccagaggagtaggatgggagatcagtcaggagactacagcaacagcttatttatcccctcaggcctggggaccttgatcattcctggatggtttatcttttattcttactattttttaggctgaatccattttgcaagggtacctggatgattcaggatacagtatccaggacctgaagagctttcatttggtaggacttggtgcaaccctgtgtgctataaacatcactgaaatcccacttataaagatctcagaattcaggtaactaaaatatgaatgtgcaaaatggcaaatgggttaattcatccatccatccatccatccatccatccatccatccatccatccatccagatattccacctcctgacacttggcacctttctgggctaaaatcccactgggctaatgggataagctggatctgctgtccctgctgagcctactgtgcagtgtgtgtgtgtatgtgtgtgtgtgtgtgtgtgtgtttgtttgtttttggctgaagagtccaagctcatattatatccctccctctttaaccactaccagggtggtagtggccagaattgggaccctgctctgcagcacacatgtcttagccgagtttaagaggaaggctgaagttgtgtttggggatcccactgagtggaccagttctgtcttgcaggagcttgggaccattgcaggtaagactcaccctgagcatacctttctctctctttccaaacttaaatgtggggacacaaaataaaacattatccttggccatgtgtagcaaacatcagtggcgttacagtagaacctacatttcatgatttgaagttgcagagggtgggtctgcaaatctgcttttaaaacaagctcttttggagattcttgtgtacactaaagtttggaaaaccgctagtttagaatgtgatttaattggcccctaagtaggtttatacaaaatttgaaagtgtgtaaattgaagttccttctgggcatgcgtttcactgtaggaggccaatcagggctaatgtgacccacattttttttttctgagttgatgaaggaacttgattccccagtgtgatttccagggccttttgtaaggaatgatgcctgcctagaacactcagatctgaacattatgcagcaccattaataaaacaagcggagttctgatggcttgaactaaacccccgtgattcctttttctccccagctggattaactaaggcagagctccggatgcttgacaaggatttgatgccatatttccagccatcagcaataaaatgccttcctgatgagatattcaaagtaggtgctcagttcttcaaggagaaatgggagcttgaccccatttcaaatcacacagggaaacaggtgatgggccttggaatttagaggcttgtgaccaggctctgctgatggggtcagaggagatctgtgtgagtttaggtgtttttaaaaaacatttttcttaaaattacaatatgtagtttaattatatttatttttacggtcatcttctcttcttctagcaggtggtactgattttctacttatggtggtatgacaggttcataaacccttacgaaaacccctggggacagatatagttcagaattcagaatttctcagattttgaaaagatcaccctgtacatttactgtatgtaacttcatacccccagcagtgtctggggaagcaccttgtaagcaaacacattaatatttctgtgaagaaatctgtgacaagccacactaattggaataaatagagactataaataaatagcctcacattacttcaggtcaagttttgctgataaataagtttgacttaaactttgggggaaaacttgcagttttcagattatttttggactttggaattgcagatgagggattgtggacctctgtaacatttccttttaagatataattaaataaaaatattttagttgatttaggtcaggcatggtggctcacacctgtaatcccaacattttgggaggctgagacaggccaatcacctgaggtcaggagtctgagaccagcctggccaatgtggtgaaaccccatctctatgaaaaatacaaaattagctgggcgtggtggtggatgcctgtaatcccagttacttgggaggctgaggcaggagaatcacttgaacccgggagacagaggttgcaatgagccaagaccacaccattgcactccagcctgggcaacaagagcgaaaccatctctctctctctatatatatatatttttttctatatatatatatttttagttgatttaaagaaaagtattaggaaaatcacaagaggacaggtgaaaaactgctatgaaaaaattgagagggtgaaattggatcatttgaaggaagggaagcagggtatctaatgacaggtcctttttttctgtctgtatacaagattaggggagtgtttggtgggaatagtctgctctgatgaggaggcagtcattctggtgttcctgtttgctgcgtaatgtgggaacacattttgtccagcacttctggataaaacacacaaaccaggctcgacaaactcccccagtgccacatcacttgttcatttcaagaaagatagctgaggccgggtgcagtggctcacacctgtaatcccagcactttgggaggccgaggagggtggatcaccaggtcaggagattgagaccatcgtggctaacatggtaaaaccctgtctctactaaaaatacaaaaaaattagctggggtggtcacatgtgcctgtagtcccagctactcagaaggctgaggcaggagaatggtgtgaacccggggggcggagcttgcagtgagccaagatcgctccactacactctagcctgggcgacagagcgagactctgtctcaaaaaaaaaaaaagaaagccaaccttcaatcacttcagcatcctggacagttccgagcacattgcaggcataatagctgtttgagggcaataaatagcagtcctcaaagccattgagcaaatacctgcttcccctctggggcactctgcatgggacaagcagcttggtcttggatgctggcattttgctaagcactttctcttggtcttgtttggagtgctgttgtgctgcttccttgtacaggtatttatctattccagaaatccctactgatcacctacattgtggcaggctccagggtaggtgcacctaaggatgcacaggtgaaggggttatcacatagtgccttcaggggcctaaaaggtaacataaggtgcagtaggctgggtagagaccgaagtgaactggagagccttgtctaaatgtggaggctgcttctcattcctagcacattcatgcagtgtggccatgtgggcccaagattgctgaattttccttttcacttttttcgagaagaagtcagaaatcttcattttcatatggaattgcttgataattaaatgttggcagccaatctgaatttatttttgaaaacacagtgccgtaggcctagagattcaatctggcctgtgggtcgcaagtcagcaacattgataaaagagataatttttagaatacagactctgtgttaatggtatatggaagccaaaaaagtacctctctgaccaccccaccgtgtgtgtgtgtgtgtgtgtgtgtgtgtgtgtgtgtgtgtgtgtagtgagaggagaggaggtgatgctgaattttaatttttttgagacaaagtctcactctgttgcccaagggagtgcagtggcacaatgatggctcactgcacccttgatcccctgggctcaagcaatcctctcacgtcagcctaagtaactaggactacacacttggctaattaaaaaaactttttgtagagaaggggggtctcactgtgttgcccaggctggtctcgaactcctgagctccgttaatcattctgcctcagcctcctaaagtgctgggattgtaggcatgagccatggcgcttgaccgaccagatgctgaatcttggagaacagctggcgatgaagaagaaacagtgttccaggcagaaagaggtgcacaggaagatgctgcctctagggaactgtaaatattggcacccactctcctggagtgaagaatgccatgtgtgaggctggagaggtgggcagagttttttccaggagcctgaactgtgttctggagtggggttcctggaagggctttacacagagggatatgattccagggaagtatctacctggacaaaagaggaggagagggtgactgacaggagaggaagggatgagggagcataagcatctttcccagattcttcagggcctttagaaaataaacatgatgatatagagtccccttcgtattccagtcccattggaacgagtcaccaagtcctttgatctggaagtgacttcagaagacaccttgttcacagtccttgaagacatagtctggctggcagaatttccaactcatgttgtccatagcagatatcaccaatagatgactgcattttccctccatggagccctcacagagctcatcacatggtgctcaggcagtcaaaccaaaggatcagaatcagtcagcagaggagatgagttctctatgccgtctcacatttatccccaaagcccacggaggctgtgtaatttgttcaaggtgacacagcaagtatgtggcagagcaggggctcgaattcaggcctctgatctttaaggcctgtgtttccccctccacatcagtgtttcaggaggtggaagacttgaagcactgggaagctgtcctgcattgcattaaacaacattgccacatagggaggaaatcatgcttcccttttcaactctccattagtacttctaaatacctcaagaaggaagtgtcaatttaaccctgtatagtacattttatattctctctctctctcttttttttccaagaggccaggggttcagatattgttggcggacaaatctagctaggattcaacaatattgttttatttttattttgcggctcctatttaatgcttgcttatggcaagtctgccggctttccatttttggaaacttccattttaaattttctatttttaaatgcatttactttggtagtgcaagagtgatctaattttaaggaaatatcttaaagaggaccacacatgatacacacaaggggatggcaaagttgtgtgcatcctgcgcggacgcccgagatgtgggaaatccggggaggggccccgtgtgagggtgctgcccctttgcctcctgcaggagctgtccgcggagcagatcgcctccctgggtccggagaacgccgcggcggtgacccacgcccagcgccggcggctcagtccactgcagctgcagagcctccagcaggcgctagatggcgccaagactcactcctggcaggacgcgcccgctagcgccggtcccactagaacctcatcctcgcgttctcccgcaggtgagcagagccgccctctgccccgcgtcccagccccactctccttccttgtcctccctgtcaggcctggggtggggaggttcttaagattcagagcgaggtctctgacagtcactggggattctgccctcagtgaaaaacccaaagtccctatcaagcttccctaccaagcttcagaattagtgattctcaactatggctgcccttgggtggggggcattaaacatcttccagttctcccgcccctacccagaacgcataacatcagaaactcaggactaatttcattttagccgctcctttgcaaactccctcctcactatccaataataatgaactattattattattattattttgactcagagtctcgccctgtcgcccaggctggagtgcagtgccgcgatctcggctcactgcaacctccacctcccaggctcaagcgatcctcccacctcagcctcccagtagctaggatcacaggtgtgtgccaccacacctggttaatttttgtatttttagtagagatggggcttcaccatgttggccaagctggtcttgaactcctgacctcaggtcatctgcccacctcagcctcccaaagtgttgggattacaggcgcgagccaccaagcctggcctgtccaatattaattaattcaacccatgtttactgggcacctactatgttccaagtccgcagtaggggctgggaatacagaggtgaccaagatagataaggccctcttgtaaatgaagaagatatttcaaatctgacaagaccagggagggtgatagtgactgagggctgagctaagatagagaagcctccccagggagtggcattggatcctgggaacatggccttctttcctttttctcccccatgcctttcttacagctctccccatttccccttcactttctcacttctttgtgataacttctgttcttaacaccacatttggaccatgctctggggagatagcttctaacaagatggggaacagagatgttccctgccctcattgagctctcagtgcagcctggcggggagggaagacatgtaccctggtgaacatgaggcaggtgctgggtgctgagatggggaacacacatgggtcaggaaacctcctaaagtcagtgatgtctcaggtgagacacaaggtgagaagaagatgggcttagcgaggtagacagtgtctcaggagtaggtaccggcatgggcaagtgcccagagaagtcagaggacttggtgcttgactaaaacctccactccaccttttcctgacttgaatgtctccctgtcctgccttcacatagggatggtgaattggagtattccccatttctacagccacaagtggccagaggtggcacttgaaaacataaatcatgccttttgatgtattatattattactttaaaacacttttcattgaggctgggcacattggctcatgcctgtaatcctagcactttgggaggccgaggtgggcggatcacctgaggtcaggagttttgagaccagcctggccaacatggcaaaaccccgtctctactaaaaatacaaaaattagccgggtgtggtggggggcacctgtaatcccagctattcgggaggctaaggcaggagagttgcttgaacactgggggcagaggttgcagtgagctgagatcatgccagttcactccagcctgggcaaaagagcaaaactccatcacaaacaaacaaacagcaacaaaaaaaactttccattgaaatatgatatgcatatatttgaaagttatttgtaaatgttatagcgttttgcatgaatagataatatgtgcaatagataatgcacagggttccgaatatataaagtctgcaaggcatgtggtgaaatcttttcctccagcccctgtcccccagccaccctgttccctccccagaggcaaccaatgttagcagcttcttgtgtatttgtccagagatattctatgcatacacagcaaatcaaatatagatgatctctgcacttttcacaaaagcttattatacaccttattctgcaccttgtatttttcacctaacaatatactttggagggagttctgtatctgtgcacaggagctgtgccattgttggttttatggctatgccgtaactgtattcaaccagaggtctgtagatggaccttgcagttgtttctattttttttttttttttgctgttatgaacaatgctgcagctcctgacctgatataatttgcatctgtgcaagtatgtctgtaggataaactcttcaaagtgagattgctagatcacagggtctgcatttataattttgatggatgttggtcggatgtggcagcttatgcctgtaatcccagcactttgggaggctgaggcaggtggatcacttggggttagaaatttgagatgagcctggccaatatggtgaaaccccgtctctactaaaaatgcaaaaattagccaggtgtggtggcacatgccttagtcccagttactagggaagctgaggcagaggaatcgcttgaacctgggagacagaggctacagtgagccgagatggcgccattgcactccatcctgggtgacagggcgagactctgtcttaaatttttttttttaatggatgttgtcaaatcccctgcagaaaggtgtgaccagttttcccttgaaacagcagtgtcagaaagtgatgagggccccttaaaaagatgtttcctgcatgtccctggctgggcaagatcctggatgcccctccttcattcaccccaagggcctaagtgagggctgccattggatgaacccttcctatggaccagagccctaatcttttctttcctaaagttgcttaattatcagaatcacctgggagagatgcttaaaatacaaattcctgggtctcctggcagacttgctaaatcagaatctccaggggatcctggaattggtgtttctaacaagctccctagtacatgctgactgacacaatctcatttaattctcactcccccacccctcctcctctttggggatcattgttcccatttaagagacgaacaaatcaaggctctgcatcaagtggccccagagagagactcggggagttggacatcatgtgtctaccttctgcttgctgccagaacttcatgtgtactcttattttgtatttgcttttaggagctctccagtcgtggggtctttggcttggttgtcccctgctggttctaatggccaagctcctgtggtgagtggcctgagcgcatcgtcctgtgttgccccaagcagctggccaacatgtgtagagacaggatgctccagatggtgggacacccttccctggatccagaccctcatctagggcagggaaaccctggggccttgatggtgaaaatgcaccccaaatgaaaaataattattaaaaatgatcttgcaaattatttttaatttttttaaattttaattttcattagtacatagtaggtatatatatttatggggtacatgagatgttttgatacaggcatgcgatgtgtaataatcacatcatgtaaaatggggtatccattacctcaaacctttatcctttgtgttacaaacaatccaattgtactcttttagttattttaaaatgtgcgattaaattattattgactatagggtcgggtgcagtggctcatgcctgtaatcccagcactgtgggaggccgaagcaggtggatcacctgaggtcaggagttcaagaccagcctggccaacatggtgaaaccccatctctataaaaatacaaaaattagctggacatggtggtgtgcgcctgtaattccagctactcgggaggctgaggcaggagaatcgcttgaactgaggagccagaagttgcagtgggcagagaccatgccactgctctctagcctgggtgacagagtgacgttatctcaaaaaaaaaaaaaattactgttgactatagtcatcctgttgtgctatggaaaagtaggtcttactcatctttctgttttttttgtacccgttaaccatctgcctcctccccaccaactctcccattacccttcccagcctctgttcactctccttctactctatctccatgggtttaattgttttgatttttgatcttgcaaattcttaagcccactcatctcctcagcaggaagcccttctctgtcccattgcagcctcttttgttttccagcttggagacagagaacctgtggggaaggaagggtgttttctgttaacagcacgagacccttacaatcaagttgctgccctcactttagagagataccagagagaggcagtgcaagaaaaggcaccattttagccagggcctcatctagtttctacttgggcttaatttcactttcttgaagctacaggctacattggatttctcctctacgatatttagcagagctgaaataaatgaatccctgagcagaagccaatattcttgcctgattgctgggactaattgatgttttggtgggcattgcattggttggaagttaaaacatttaacatggctcaacgttaaatcaatttaaaaatacatttttcaggtgtcttccatttccttgggactcagctgaatggatggctgtgaagttatcattaaactctcaaaatattccctgtttttggtggagatggtggtggctcttctggttttaagttgctctgggctttggggaattggttgaaataaaaaataaaagtacattgggtaagtcagtcactgatgtgatcctggcgggctgagaaaactccacccactggctcgatcctgctagaatgaagttacttccgggaattgccaggatgcttttagccttaggtttaggaagtcagggctcagggaaggggggcagcagtggtgtttgcaaacaccttctcgaagacagcatcacagctgcttgtcagggcgtttccctggtggcatcctaggtgcttctgttctgccatcagcacaccttgggttctcctcctagtcacctatccacagtagacatctcatctggaggtaagaaaactgcatgtttccgaaaatcttggtgtccctaaaaggcggtggattttacaaagcgtcatgagtaggtgttgcagaggctggagtgtattttcagaggtcacgtggttttatagaaaactaagactgcagtgtgaaaggtgtgatcctgtgatcctgcacgtgttatttaatgtctgacttggttttccttcatcctggcagggaagtagcagcaaatgggtgctcctcaggtacagaacattaattttttttgtttttgtttttgagatggagcctcactctgtcacccaggctggagtgcagtggcatgatcttggttcgctgcaacatccacctcccgggttcaagtgattctcctgcctcagcctcctgagtagctgggattacaggcatgcgccaccatgcccagctaagttttgcatttttggtggagacgggatttcaccacgttggccaggctggtcttgaactcctggcctcaagtgatccgcctgccttggcctcctaaagtgctgagattacaggcatgagccaccgtgcttggcccagagcattaattttcttacaaacagcagcccccagtttagctgggctggaccagctgcttggagaggggttcttgatgaaaacgtgtctgcacagactcccatgaggatgtccttggatctcaatcggtattctcactttctgccagtcttggattatcctggacaagaaaaagcaaacagtaacaaaatccactctcctgcgagtcaggcttcacactgccgacttcatgtagcttttgtatttcatctctctttctggtcatttgtttctgatctaattcctgtttctttcctcccatcttgaataatgactcccattacagagggctgactctgggtcaggctgtctaagggctttcactgtgtcattagctcatttcattgtggccatgctcctgccaggtaggcactgttaggattcccattttccagatgaggggactgagtgtgagagaggttaaggagctcttgtctaagcttcccagataggacaaatttgaatcctgacttctttatctctgcactgtgctgcctcctggacaggtgtcctttaacttctctaataagtcagatcagagagagattctgtaaatcccttcacctcctcctctggtgggaggacagtttgcctcacagcacatataattggtgatcgccccaggcaggaagacaaatctagctgatgccctgcaggaaccccagggtctcaggttgaaatgcacagtcctttgcatgcaggaaagcagcaggtcacgctggcaggtgctgctcccattcacctttcaatgtcagctctcctgatggatttctagcctccatccttcacagccctcctcagctggaggcagggatcactggcacttgtatgcagatcacagcatgttggctctggttcttatcagtcaggacctgtgccattctggcttctaaattttttgaatatcaccccagttagatccttttgcagaatctctaccttcaggcccgctccagacaccaagcctggcttgatgggggctgcaacttcagcctaacatccagtggaacttacaatgaagttatcctctctagtcctggtacccaggggttcagccacagctgcttgtgatgggctgtactaccaaacagaggttactgtgtcttggggcatgtgtgtgcttactctgctttactgaagtcatggaagagagttacaacacagtaaacaacttaatattcaatactaggcattttttgtccttaaaagtcctttgcccacttttgcctcttgaggggcctttagaaatattgggccaggcgtggtggctcatacctataatcttagcactttgggaggctgaggcaggaggatcacttgaggccaggagttcatgtccagcatgggcaacatagggaaatcctgtccctaccaaaaaaaaaaaaaaaaaaaaaaaaaaaaaaaaaggctgggggcagtgggtgggtcactcctgtaatcccagtattttaggaggctgaggcgggcaggtatctgagctcaggagttcaagaccagcctgggcaacatggtgaaacctcgtctctagtaaaatacaaaaaattagctgggagtggttgcacgtgcctgtagtcccagctacttgggaggctaagcaggagaactgcttgaacctgggaggtggaggttgcagtgagctgagattgcaccactacatctgagtctgggcaacagagtgagactctgtctccaaaaaaagaaaaattagcccccgcctggtggcacacacctgtagtcccagccactcaggaggctgaagtgggaggatcggttgagcccagaattttgaggctgcaatgaactatgattgtgccactgcactccagcctgggtgatggaatgatctatatctatctgtgtatgagatatatatctcatatacagaaaagcgtaatacaaactacctatggtattggaagaatcccaggaatcgttggaggtcttgaatgaatttgaagagggtactcgttcaagactagtttaagacacacattttgtagatgtcccaactagacactgtgtggcctgggaatatagatgtagatagatatctatatctatctatatatgagatatatagctctcatatcttatatatatgagatatatttcatatatataagaaaataatatatatgagatacgtataactcatgtatatgataatatatcatatgtataagataatatatgagatatatatcaaagattatatttagatatataatatatctagattatatatagatatataagctatatataatcttatatatgatatatatttcttataaatatattataacataatataattgaaaaaaagtaaacattgcagaattcccaggccacacagtatctagttgggacatctacaaagtgtgtgtcttaaagtagtcttgaactgagtaccctcttcaaattcattcaagacctccaacgattcctgggattcttccaataccataggtagtttgtattacgcttttctgtggtcgcttccccgattactgattgtttcagaaagagacatgggcttggctgatccatggagatatctgcagcttgccagcagctgaagtctttatttgcctttatctccgttgtggcctctgatgagccagactacagagatgctgatgaaatctgggaggcaatggtggaggctgtagtttcccaggagaactctggccctggggaattccttccagtctctgagtccctgtggcacatctccatgtgtggcggactaggtgattgctcctagtgattctgcttagttcctttattagaattataagctttttgccatgtgactttgtagtacatctcaataggtagagtctaattccttgcccttctaactttgggctttggtcattggaatgtgagcagacacattttcccccagcagaagttttaaatgtgctgcatgatttgacttgacctcttggcaattgcttctcatgtgaagggacatgtggagcagacctgaactcaacccaaaccttggagccaagctgagctcagcagaacctagctgagctcagccaagccaaacccagtgtaatcacagccaatctgaagactcagaagcaagaaacaaatatttgttatagggatctattgggatttgagagctatttctctttttttaagttattgttattttttgagatggagtctcactttgtcacccaggctggagtgcagtggagtgatctcggctcactgcaacctctgcctcctgggttcaagcaccactagtgcctcagcctcccgagtatctgggattacaggcagtgccaccttgcttggctaatttttgtattttttggtagagacagggtttcgccatgatggccaggctggtctcaaactcctgacctcaggtaatccacccgccttagcctcccaaagtgctggggttataggcatgagccaccgtgccaggcctagggagttccttgttattgtagcaaaagctgtcttatatatcatgtcattaacatgcccaccttacacagtgctggtcccattctgatgacaggaagatgatacattttatcctttacccttaccatcatttactatgtacactatgcccatttgtcaagctcttctgcctccaaaaagtgctatggtacttgatacccgataatagtctttaacttctgtcatgcacccatttatttcccatcttcaagaccaagggtcgtagaaatcacaggaaagctggggtcagaacttatactcataacatggttgttccacctactttgccatggcagactttgtatctcatggctcacttaactacttcccttgagcactcactgttctaacactcatttcccccaaatctacaacttagcttctctccctggtgcagtcaaggcccttttacctggagtctcccagaaggattttcaggtcatgtgctatattagctcatccttagggaagaacgttccaattgaagaagccatctgactctcccccaggtgtgtggtcatcttctctgctcatgctggaagatggaagaccctttgaagtaacttagttcaacaaatctgcccttaagttgtcttccccctggggatctgccccatcttcgtcttctccctgccacaccaggttcattgagagctcactctcccccacggtcctctctcatgctccctggcatcttgcaacagggaacttgagatgctgatgggcagttgggtggattctcaatggtggccagtccagctccaggacctgccatactggcaagggttttgggttggaggaatcggcatgacaactcaccagcctgtattccacccgaatgtaagcttctgtgggcaggaggctcatctgtcttgttcgctgccatgttgctactgccaagcagtccccagtaggctggtcatggctggtgtccattacatatttgtgcagcatatgggtgaacatacacacgtcctttctgaaacaaaattgaactcagtaggacactcactcaggcaaagattgggaagctttagatccattctggaggagggggagatagaatcagaatatattcatttaacaaacatttatggggaacctacttttttggcagacctcatgctacagaaacaacagtacacaaagccctgctttcatgaagcttacagtctaccggggactgggagaggcggaccataaacacacacatgcacacatatacatgttcacatccacacacccctgtatcagatagtgataaatattatggagcaaagaaatctggaggaaaggatcgagagctccagatggtgatggtagggataggggtggtgcagaacaagctttaataaaacattaggtggtcagtaaaggctctgccctcaagagggatacaatcgcttcttaaaggtcccacctctcaatgctcccacttttgggattcagtttcaacatgagttttggggggtcatttgaatcaaagcacatggtgtccaccatcagctctaagtttacagcctaacacttccgcaataacaagaaagagagagagagagagagagagagagagagagagagagatctttcctagttacttcagcaaaagtccccaggttaggtctgattgggcttgcttgaggcaggtgcccatttctgatctgaccactgtggcccagacaatggttacaccaattggccaaggctaggtctgattaccctaaatcctaccacaaataacattgactgagcaggaaaggactgattccagaagagatcaattactaacatgtggtaggcagaattctgagatggcccccaagatccctgctccctggtgtgcacaatctgtgcaatctcctcctctccagtgctgcacaattagaggatgtgatggaatagccctgccctgactgggctactagttagttgattttgagttaatcaaaagggagagcatctgggtgggcctgacctaatcaggtgcacctttaaaagggactaggcccttcctgaagtcagagatgctcaaagtgtgagaaagcctatggagaggccacagggcaaggacctaggtttgtctttaggaggtgagagaggtctctggtcgatagccagcaagaaaaaagacctcagtcatattgatgcagggtagatgaactccaaactggggcttagcctgtgagggttcttggccttgcccaggaaagaattcaagggcaagctggaggtagaagaaaacagctttactgaagcggtggtgttacagctcctgcagtgttacagctccatgacggctcctgcagagcagggctaccctgtaaccagagagtggcatctctgggcagttttgcagtcatatttatacctgcttttaattatatgcagattcaagggtggtttctgcagaactttctagagaaggggtagtaactttaggtcatcaggtcattgccatggaaaggggtggtaactcccaggtattgccgtgtcaatggtaaactgacctggcacactggtgggtgtgtcttagggaaagctgcttccctcccagctctgttttagttagtcctgaacttggtccggtgtccaagccccacctccagagtcaagtcctgcctcctatctcaagataatcagaaggagcggaagtctgaaaacaaccaatcatcctggaagaagaccctgagctttagataagactacagctccagctgacaccttgatttcagccccatgagaccctgagcagagaatccggttgagccgtgcttggattttgacctatagagctgtgagataatacatttgtgttgctttagttgatgcacttctgtcaatttgttacacagcaatgagaactgaataagggagaaacaaatgctgggtagacagaagcgacggatgtgcatgaggagctgagacagacagctgcctggaattgagccttacttaacctggaaggtatgactatgtctgtgaatcctcattggaagaagttttattggtcagacatcctgttccatgtcagcctctccctctaggatcttttgcttcctgcaaggagtggggcctggtatgtttatcttttgcatttgtcattcatagtgactcagcatcaattcatcctttcccacagtattgtgaatttcctttggggaagcacacttttggtactctccagtggattaggtggcattagccccaccttcactccagtgctgggccctgattcccttaagtcaattagcatactccattccccaggccataatgactgattcagggatggaccaaagagagccaggctttggattttttattcaactgtcagagtaaagagaaagaacttctctttcctctgcacatgaattgggcagccatcttgaaatagtaagaagagaagctttataaaggaatgaaattaagaaatggagtgagaagaatggagttaagaaatggtgtgaggtcaggcatggtggctgacacctgtaatcccagaactttgggaggcttaggtgggtgggaggattacatgagcccaggagttcgagaccagccctggcaacatagtgagactccctgtttctataaataatgaaaagaattagctgggcattgtggtgcatgcctgtggtcctagccactcaggaggctgaggtgggaggattgcttgagcctgggaggttgaggctatagtgagctgagattgcaccattgcactccagcttgggtgacagagtgagatcctgttaaaaaaaaaaaagagaaagaaggaaagacaaaaagaaaaagaaagaaagaaggaaagaaaaaaagaaaaaagaaagggtgtgagaaacactgggtcctggcaaaagatgttggcacctgcatcaaaccatacctgcaggtttgcccctggacctttcagttatatgaacaaatatgggttggatttccttatacttacaagtagttgggttgctttcttttttcctgtttatttttcttgctcatgagatgcacacaaattgttttttattatgggtataagtgatcacaaagtgcccattttctctataacctgaacagagagagtatgggcatctcagcttcactgggccacagcatcaatctttaccctgaattcagctttgatgcacctgagtgcctgatgagctacagggatcctgtttctgaaaactttacgtgggtgacaaaatagcaaaatagtgtgtgaggcctttgccttgagacctgggtttgttccggagacaactctaatggaggagagagatttgctcctcccactctcctcgctgacatttggcctcaggggactgagtcatacccgactgactccatgtatataagtgtgaatggcagtctggtagtccaaccaggtgatgcttcctgtccccggagggtagccaatatcatctcctgcttttcttccttctgatttagcatcactcagggcaggaattctgggctggaggagaggggcctatagttctcttgtatggtctgagtttgctcacacagcaacctgctcttatctagtctgatttttttcaacagcatcctgttgtaccttgtcatctggctctgtggacaggcctttctggtcttcacactgatgcaggtttgttagtttttttcctccttgttaatgtatagtcaggaatttaacatccttgactgtcctcatcatcggacaccctcactagtcttgtcaagtcttagctatacaaatgaaagcatggaagcttggaggtgatatgtcatgatgctgaatcctaggactgagccccgtgaatatgctgttaaggttcttcaatccccacttgccttctgggcctgccgctcttgcaacatccttgtgtcatgctcaaagacctttgcagtgcccagttctgtgtttcctaacagcgtctttgttttgggtgcattctttgatattggatgcttgaaatggactaatcaggtcctggcaggcaatggatgcacattaaaatcaattacttgaggagagtttagcaaagagagtatttacagaagcatggactgggttaaatgaaacaaaggatgtgaggaactctggaactgtcaacagcacagagcccttaccaaccaggtctaaaagggaaggggagagagactcctggaatccagaaagaactgtagtgtgattactcaaccttcctacccactgcatagacaaaaccagtttgctgagactgtggtattgcagtgaagaaagagtttaattaacttgaggctggccatgtggaagaactggagttatcactcaaatcagtctccccaaaaacttggaggttgtggtttttcttttcttttctttttgaggtggagttttgctcttgttgcctgggctggtgtgcaatggtgtgctcttggctcaccacaacctccgccccccgggttcaagtgattctcctgcttcagcctcccaagtagctgggattacaggcatgtgccaccatgcccggctaattttgtattttcggtagagacaggttttctccatgttggtcaggctggtctcgaactcctgacctcaggtgatcccctcaccttggcctcccaaagtgctgagattacaggtatgagccaccgcacccagcctgtggtttttcaaaaatagtttggtgggcagaggactaggcaatggatgctgctgattagttggggatgcaatagaggtgtgggaaatggtcctggtgctctgagtccacctctgggtaggggccacaggaccagttgagtcatgagttacaagtccaggtggggtcagttatttgccagaatgcaaagtctgaaaaacatctcaaaagaccaatcctaggttctataatagtgatgttatctataggagcaattggggaagtcacaaatcttgtgacttatagaacaatggctggttctaaaactatgcctaagactatgcctccattttagcagaattcaggcccctccctaatcttgtggcctttccttagttttacaaaggtggtttcagccctgaaacaatgagggaatcagttttagtggaacactattatcatccttgctttcaaattaaactataaactaaatacctatccaggtgcagtagctcacacctgcaatctcagcactttgggatgccaaggcaggcagatcgcttgagcccaggagttcaagaccagactgggcaacatggcgaagccccatctccacaaaaaatacaaaaaaattaacatgcgcctgcagtcctagctactctggaggctgaggtgggaggaccaccctgagaccagggagttcgaggctgtggtgagccgtgatcatgccactgcactccatcctgggcgacagagtgaggccttgtctcaaaaagcaaataaataaaataaaaaaattcatctcatgattaacttggcctatgcccaggaatgagtgaggacagttagcctgtgaggctagaaacaagatggagtcagcaacaccagattctctcactgtcataatctttgcaaaggcagcttcagtagctgtgagaaagagccgcccaacaagggctgtagcagcttttcccagtggcgccaatgcttccctagtccaggctctggggaattctctcttggaagacgcagcaggctggagttgagggtggggactttaatcctcctctgcacattgccaggaaccaccttttcccttccagagcagactttcattttaaaagctattttgtgttcatcttctgaaagcccatgtgtttgctcatttccaggagaatttttatgacttctacacttttaaaaagctcatgtgaagctgcctggctttctgtctaggttttggatactttcttcttgcgcctccaaatccgctgtccgttcttctcaactctggtgtgcccagggagccagactggccagtggggacccagtaggagattggagggtggaaggggaggtcagggtatttattcctttggcttctttccttccgggctgagagtttgcagtagctcagtttctccctaaaggccacagttcctgttgggcagttctgtcttacagcgacagctctctctgggttccaggattctctctctctctctccttcccttttagaccccactgttgataataccagcgtgctccacatccttgttttctcttaatcctgtccacacttctgtaaataatctctttcctaaactgtcctcaattaccccattggagtgtgcatctgttttttgctggggccttgattgctccatttcaaacacccagtgtcaaagaattcacccctgaaggctgcaaggggaacctcagggaagcttctgcaatgtctctctgtttccaggtggtagtccacctccggcgtagcctgaaccaggtcaattaatgctgcctattttatatgatcaagtttgtcattgaggtcgtgaagatgcatacctcttacttctggcttggggacagttgggcactgccccgtagttaatgactgtggatacagttctcaaattaatctgggtgtcagctgagtccatcagccagtgagtagcccctgattgcatggccaaggaaaaccaaaacttcaccagggtttctgcaaatgactgtctcaggactccttctggttgcatgctatcgatgtacctccttgccccaggtgtgaatcctctgaaataattcatagtggaacattgtggtagacagcttctaagatgaccccaaatgatccctgccacctcatattcacgtccttttgtgaccccttgccctgactgtgggctggacctagtgactagcttttatttttttattttcacttaaaaaataatttctcggccaggtacggtggctcacgcctgtaatcctagcactatgggaggctgaggcgggcggatcacgaggtcaggagttcaagaccagcctggccaacatagtgaaaccttgtctctactaaaaaaaaaaaatgcaaaaattagctgggtatggtggtgcgctcttgtagtcccagctacttgggaggctgaggcaggagaatcgcttgaatccaggaggtgggggttgcagtgagctgacagtgagctgtctctttttttgagacagggtcttgctctgtggcccaggatgagtacagtgacacaatcacggctcactgcagccttgaactcctgggctcaagcaatcctcccacctcagccttccaagtagttgggaccacaggtgcacatcacaatgcctggctaatttttaattttattgtagagaggaagtctccctatgttgcccaggctggtcttgatttcctaggctcaagtgatccttctgccccagcctcccaaagtgctggggttactggcatgagccactgcgaacagcctataatttcaacttttattttagatgtaggggatacatgtgcaggtttgttacatgggtatgttgtctgttgctgatgtttggggtatgactggttctgtcatccaaatagtgagcatagtttgtcagcccttttgtctctccctttctctctcatctagcagtccccgtttttttttttttttttttttttttttttttttttgagacagagtcttgctctgttgcccaggctggagtgcagtggcatgatcttggctcactgcaacctccaccttccaaattcaagtgatcctcatgcctcagcctcctgagtagctgggattacaggtgcttgccaccacgccctgctaatttttgtatttttagtagagacagggttttgccatgttggccaggctggtcttgaactcctgacctcaagtgatccgcccagcttggcctcccaaagtgctgggattataggtgtgagccaccatgcccagctgtagtccccagtttttattgttcatatgtttatatccatgtgtacccaacgtttagctcttgcttataaatgagaacatgcagtatttggttttccattcctacgttaattcacctaggaaaatggctgccagctgcatctatgtagctgcaaagggtatgattttgttcctttttatggatgtgtagtattccatggtatatatgtaccacattttctttttccaattctccattgatgggcacctaggttgattcaatgtctttgcttttgtgaatagtgctgcaatgaacatatgggtgactagcttttaatcagtagaacacagcaaaggtgatggcatttcagtttgagattaggttaccaaacacacggacttctgtcttgctagcacacactctgtcttgccttcttgctgatactgaacctaacttgggtccccctgcccagcacagcaaaaccaaacattgatattgggattgtagcaagaggaagtagggtatttattggaggggcaccaagcaaagataattagttaatgcttaagtcccaagctcccggatggcttataggtaaggatttgtaattgcaggaaggcagaggttacatgcaaagttataaatcaatatatgggaggctctacattggtttgacctaaaaaggcaggacgtctcaaagtgggaacccatgggtcaaaggtagatttaaagatgttttgatttgtaattggcttaggaggagaagccttgtctaaaaatttgagatcagtggaatgttagttctggcctggggtgtgacttcctctactccccttaggaagaaatttagaactgagaaaagtgttaagagtttagccttcaggtcccccttatctgagttgtgttgctggaccttgtgtgttgctggacccatttagtggggagtcctcatttttgaaaaacaatctatgaacattagtttttatagggaagccaaacatcccatgattttaacttttttgcccattattctaagctactattatcttcttgcttattaagttgtttattgatgtatttatttatttctgagacagagtctttctccattgcccaggctggagtgcaatggcatgatctcggctcactgcaacctccacctcctgggttcaagtaattctcctgcttcagcctcctgagtagctgggactacaggcatgcgccaccactcctggctaattttgtattttcagtagagatggggttttgtcatgttggccaagctgttcttgaactcctgacttcaagtgatccaactgcctcggcttcccaaagtgctaggattacaggcatgagcccccgtgcccggccttatttattttttaagggctagctaagtgcctggaatttttcttaaaggaacttaagatttttctttatttctatgtttgagggtgggagtgctgcatgtccctaagagaggtccctgttctgcctcattgcctgcttgctctgataaatcaagctgttgtgttgtgagctgcccttcggagaggcccacgtggcaaggatctgaaagcggcttctgacaacagttcatgggaaacgaatcctgccaataatcatgtgggtgcacttggaagtggatcctgccccagttgagtcttgagatgagacctagcttacacctagatagcaacccatgggagaccctgaagcagggggcccatcttcgaattcctaacccacagaaactgtgagataataaatgtgttgttttaagccactgagttttggaataatttgttacacagcaatagatagccgatatagcagtgtagactttagttgatgattccggtggggagaccaaagtgaaatttacattgcacacttcacaaaaagtaactaactaaccaacccatcagtcatttctgtgcttcctcagccctctcaatgctgagggctcctctttcttgctcttgttctctctcaatatcattttctaatttggccatgtctagcttcattgcatattatctttctctggattgtcagttttttctgtgtccattttggcagagaattttagttttttatgattttttttctttagagatggagtctcactctgttgcccaggctggcctcaaagtcctgggcttaagcaatcctccccacttggcctcccagagtgctgggattacaggcatgagccatcacacctggccctttctacttctactcccaaacgtgttggccaactcctcaaggtattcagcaggaaaaaatcctctctattaatgcagcgcacatttcctgggcagcagtgtgggttatagatacatgaaatatctattacataagtctctcagcttcttcctgcatatattgctattcaactgcttaaagctattgaaaaattcatgcaaacaaaattttaatctaacagagaaaatatctttgtgacattgttcaaatcaagttatatcatgtatgaaggagaagcacattccaccgagaaaagctttttaaaccctctgctttttgacattttaaccagtatgttagataagaaggctggtatggaaatatagttagcaacattgttggaaaatataggctagaaaagagttcaagaatatgtatccattgaacttgatgaaataattttagaagctgaggctgtgaaatcttgacagcaaaactgaagagacactgtagagttcccattttgcagatttatatttggttggttcatgcaggcagactccaggagaactaagactttgttaagtacctaacacatacccagtaagaaggataaatgtaggtgttcacatcagggttttaaacacgtgatccaataaatcagcaaaaaggcagcaaagcaattgtagtaatggttaaaaaaaaaaaaaaaggagtggggaagacttcaggagcaggaattgtataaaaatacatccaaatgtggctatttctgactacttcatttaaatgtgagcctctatccgttctcacctggattccagcaagaacttcctagcagttttctctgtttgagatttgctttcttggggtctattttcaacaaggcaactggaataatacttaaaaaaaaaagtatcaggctgggcacgggggctcatgcctgtaatcttggtactttgggaggctgaggtaggaaggatcacttgaggtcaggagtttgagaccagcctgggcaacatagctagactctgtctttacaatacataaataaataagtaaatacatacattagtcaggtgtggtggcacatgcgtgtagtcccagctgcttgggaggctgaggtgggaggatcacttgagcctgggaggttgaggctgcagggagatgtgtccctgccactgcattccagcctgagtgacagagtgagaccctgtctccaatctctctctctctcttctatcttctatttaatttatctatctatctatacacacacacgaagtatcagaacattattcatgatagccaaaaggttaaaaaaaccccaaatgtccattagctgaatggatagttaaattgttgtacagtatatccatacaatgaaacattacttggcaatttaaaaaatgaagtatgagtagtcatatttatagagacagaaagtacaatggtggttgccataccagggactggggtggggtggggaatgggaattgttgtttaatgggtacagagtttcagtttggagaggtgacaagagttctggagatggatggtgggtatggttacacaacagtgtgaatatacttactgccatgaaacgatacacttgaaaatggtaaagattgttaaaaaaaaactcaaaaggactgaagtgctgatatatgctacaacatagacgaaccttgaaaatcttattctaagaagccagatgcaaaatgtcacatgtagtatgattccattgatatgaaatgttcagaataggcaaatgtatagaaagtagattagtggttgcccaaggctgggtaggggttttgcgggaagggttgagaaaatggggagtgatggctaatgggtaaagacttaaatgggtgatgggatgataaaaagttctaacgtagattacgggcaggtgctgtggctcatgcctgtaatcccagcactttggacccgaggcaggtggatcacttgaagccaggagtttgagacaagcgtggccaacgtggtgaaaccccatctctactaaaaatacaaaacttagccaggcgtgatggcacatgcctgtaatcctagttacttgggaggccaaagtgggaggatcgcttgaactcaggagatggaggttgcagtgagctgagatcacgccactgcactccagctctggacaatagagctagactctgtctaaaaaaaaaaaaaaaattataatgatggttgtactacattgtgaatatataaaaatccattgaattgtaaactttaaatgggtgaattttatgtcaattaaagctattttttaaaaaagacctatatgaaaaacttgaattttggggagttagttgtattaaccaggccctatccagtctttttttcaaaattagagatgggggtctcactctgtcacccaggctggggtgcagtggcgtgatcatagctcacttcagcttcccaaagagctgggattacaggcggatgccacaatgtctggctaactaaaaaaaaatttttaagagatgaggggtctcactatgttgcccaggctggtcttcaactcctggcctcaagtgatcctctcgcctcagctcacaggcgtgagccaccatacctggcttatctaagaaagccaccatacctggcttatctttctctcatcttgagaaagaatgaattcagtttggttactgcacattgaagagtaagctatcctcaacatccagtaacacaccatagcctttccaaaggtagaaatggtgatagggtcaaataagtatttgtttcacagcatttgaagaaaaaaaggcagattatgttattcctttgctcaaaaccttccagtggttttccatgttaatgagtggaaactaaagttcttaaaattgcctacaaggtccaatacactcagtttcccacctgcgacttgtttgagcttaccccctacttccttcagccatgctgaccttctccccatccgtcccatgccctggacccactcctgccccaggcctttgcacctgctggctgtgacctccgcctccgaaattgttttgccaaattccctcatagcttgctcacttataccttctttagttcaaatgtcacttcttggccacctgtctggccacccgccacggaagtgcattcctgacattttctgcttttccgcttttcttccctccttcatttttttcccatgacacacctgcacaatacacagtttgttcattctttggttcattgtctcctcacacccactcaagaatgtagtacaaaggcagggatttttgtccatcttgttcaccgctgtatcctcagtacctttataatggtgtttggcacatagtagtaactcaataagtatttgttaaatgaacaaatgaaaagctgccatgtgttcaagaagtcattgtgtgttgcataggaaaacagtagctgttaaggagataccagcatcctacaaatagtggaggaaaatgccatgcaagttgccaaattgattaaagtgtgccttttaacttgtagactccggagggtagcttacacaaatatgaacaattgttcccttatatgtacaatttgcccctgatttttcattccagctgtcacacaattgcctggaggatattttttttttttttttgagacggccgtcacccaggctggagtgcagtggcatgatctcggctcactgcaaactccacctcccaggttcacaccattctcctgcctcagcctcctgggtagctgggactacaggtgcccgacaccacgcccggctaatttttttgtatttttagtagagagagggtttcaccttgttagccaggatggtctcgatctcctgacctcatgatccgcccacctcggcctcccaaagtgctgggattataggcgtgagccaccgcgcccggccgaggattgttaaacatcatttaataagtgggtctttgctgcccttctcccaggaatagagtgtatagagttgcccatgtgagaagcagccaaagcccaggtcagcacctgcaatgaggagtggctgcctggttgaatggagcggggcttctgtttgaaacctcactggttttctctgttgacagcatcttgatatatatggcatgtgtctcctgaccttagtggcctctcacaaaactctggagcataacagtgcatctctttgagattctcttagcagcatagtccataggtgaattctctatggactatgtgtcttatattttaaaccaatttaaaccaaacccatcacaaaagtaccctccaactttggtgaaaacctgtccagccattttcttatgatattgtaagacagaaacttaattttttttttggagacagtcttgccttgttgcccaggctggagtgcagtggtgagatttcagctcactgcaacctctgcctcctggtttcaagcgattcttatgcctcagctacctgagtagctgggactgtcggcacacaccaccacacccggatgatttttgtatttttagtagagacaggggtttcaccatgttgcccaggctggtcttaaactcctggcctcaagcaatccacccaccttggcctcccaaagtgctaggattacaggcatgagccaccacgcccagcctgtattttaatctccaggtaaaataagaaccagaaagactgggtcttgtgtttgcagtatgtggaactgcaaattaagactttcaaataaggttgaagcccgagagacaatggtaggtaagggatgggtctgtggagggctctggacaaaaacctatgtctacccacaattggtatgcagattatcttgagtagttgggattacaggtgcctgtcaccatgcctggctaagttttgtatttttagtagagatagggtttcaccatgtggccaagctgttctcaaactcctgacctcaagtgatccacctgccttagcctcccaaagtgctgggattacaggcatgagccaccacatcaggcctagaaatggtatttaaggtttacttatctgataacctgatttcctccctagagaaagaattaaattgtttttagctgattgaatgggggcttgggtgacatttcaggagagttagaaagtgtacgtgtatatttaaagactgatttgtaagttgacacttgaatatatgtaagagtagtcaacttggtttgaaacagtcttttttattctttttggtttattggtaactgtgagttgatttatccctaaaatagttcaaagccttttctgttttagctctgggaataatgtttttcttcttttcaaagatgtaatatttctgttaacactatagaaagataagaaagataagaaccttcagggctctttgaagacaaaattgtattctgaattgggcattcattagactgagcggataaatctctaaatctgggttttatgattttaggtttgtttgtttaatggatttctttgcttaaacttcaggtgcatgcatgataattttgaagagcagagagatggacaaatgtgatttgatttataagtcttttcaaaggcatttgaaaatgtatttcaggtttagttaagcttatttttcacactcttagttgaaggcaggagtgattgttttcctccctccacacctcgaaagatggaatggtttttcacttataaatttttccatctcagaaaaggaggagcagaggttttctagaagggttaagaataaaggtggggaaggcaagcccttgttaccataagagcaggaatccatacggaagagtggctggtttagatttgctggcttgagagtggattattttatccaactcttgatcagtgttgtgagaattaagtaagataatggatttaaggggcttagaagtgtccaatcaatgttagctactgttgttattctcagtactacctgtaggcttgatggatatatttggagacatttgtaccaagggttatggggcaataagtgcgtggttcaccatttggcccagtgaacttttcaggacttaggatgaggaaggcgggaaaagccctggggctggcaggtttagagggagactcttgcattatggtcctgagagccccaggataggagatgacctttatcacaagatctgagaactgctgctatctcgggcttctgggataatgagctggaagctcacactctgacaatggagggatttttttttttttttgatggagtcttgctctgtcacccaggctggagtgcagtggcgtgatctcggctcactgcaagctccgcctcccgggttcttgccattctcctgcctcagcttcccgagtagctgggactgcaggtgcccgccaccatgcctggctaattttttgtatttttagtagagacggggtttcactgtgttagtcaggatggtctcaatctcctgacctcgtgatccaccctccccggcctcccaaagtgctgggattacaggcatgagccaccgtgcccggcccaatggagggattttttatagcattatgtctacctggcttttcatatgacttgtgtcctgctcatgcagctttgatgacttctgaagtacagatgttccttgacttacaatgaggttgcatctcaataaacccactgtaacttgaaaatatcttaagtaaaacttgctttaatacacctaacctactgaacatcatagcttagcctagcctaccttaaacatgcttagaacacttacattagcctaaggttgggcaaaatcatctaaaataaagcctgttttataataaagtgttgaatatctcacataattcattgaacattgtactgaaggggcaaaccagaatggttgtatgggtacttgaagtacagtttctactgaatgcacattgtttttgcaccattgtaaagctgaaaaattgtagatttaaccaatgtaagttggagaccatctgtgttttgttcctccttaaagcatacaaaagtgtagccaaagagtgtttcaaagctggattacataatgaattattattatttttttttgagatgaagtctcgctttgttgcccaggctggaatacagtggcgtgagctcgcctgactgcaacctccgtctcctgggttcaagcgattctcctgcctcagcctcccgagtagctgggattacaggcatgcctggaattacaggcacacgtcaccacacccagctaatttttgtatttctagtagagacagggtttcgtcatgttggtcaggctggtctcaaactcctgacctcaaatgatctacccgccttggcctcccaaagtgctgggtttacaggtgtgagccactgcacctggctgaaaatccagatttttgtccaagattgcagaataaattgcctgggacaagtcaatgagtgaggagagataagtcaatggactgagaaggggtaaactcagtcttgcataaacagaatacagaggggatttgggtggatggggagcagtgagtgaatgggcaaagataggacaaaaccaagcccacttaaagaacaataatattacaaaggacaaagttgagaataagaggcaaagggaggaaatttaaaaagcacatttttgagcactgactagtgatgctttccctgcataatctcatttaaccagtttaacaaccttaaaaaggaagtagtagtgttcttatttcatagatgaggaaactgaggcttggagacaggagaaatgttcagagaagactgtttctaaaagggtatgtggttagctatattctaaacattcttgatacctcccccaacccccctgcccttgaatagtcactgtcttcccagccatcatctattctaccttcaaaacatatccccagttcatccactgcttcccatttcctgcattgtcaccctagactaccactgcgtctcaacatatacagcctctcgattctcctatttcctaatctgccttctgcttaaattgttctttcaacaaaatccagagaaaccccaaacaagtgcacatctgataaagatactgccctcattaaaaccctcaaaggctcccttgcaattactttaagaatctcaagtgctcatgctggcctgcaagacccagcatgaccttgtccctgccagcctttctggttacatcttcttcatcatctccttcatcccggtgccccaccaatgcagtcctttcatgtctctaactgcatcctcgctttccttctccgtggtctttactcatgctctccttgctacttaaaatactttctttccactttgcactgacaaagtgacttgtcttacagttctcactttaaacatcacttttctaactttccaaattaagcctcctgtacttattaagagtggcatatttttctttgggacacttcacaatatagaattatgtacttgtttgtgtgataatttttttttttttttgagttggagtttcgctcttgttgcccaggctggagtgcaatggtgcgatctcagctcattgcaacctctgcctccccggttcaagcaattctcctgcctcagcctcccaagtagcttggatcacaggcatgcaccaccatgcctagctaattttgtatttttagtaaagatggggtttcaccatgttagtcagcctggtcttgaactcctactcctgacctcaggtgatccacctgcctcggcctcccaaagtgctgggattacaggtgtgagccaccatgcccggcctgtgtgataatttgtttaacatctatatctccctagtagactatagctccacctggtgaaggagtgtgtttttattgctcactattgtatttccagggcctcatgaagtgctgccaggtaaataggccctccataaatatttattgaatgaatacgtgaatgaatgaatgaatgaactgcacctaggattgctgacaattctggcttttgggactttagtgtcatttttcatttactttcttaaagagcagtaagtttaaacttatactttcacctagaagacagaagagtttttgaagcaaaaccttgaagctcgtgacgtgtgccacgtaatgaatggatgtccacccaattcaaagtccctgtgttgtgatctgacatgacctctgagcttgccacaatgaacttgaccacaaagacactgcgtgcactgccaaccacaactagcaattgagtagcaagcagtggtgtcaatcttaaaagcctaagatattcttagatgcttatttttataatcagttttattatagagttgctaaaatgggcccaaaccatatgtctctccatcgagaaaagtcagcactgactgcatgaaacaaaacacttgcagagacattgaaaagccacttgtttgactttggaaatagagcgctagtattttttgcaactcaaaagacaagccttgtcttggagcagtacaaggagaagtgcaatcaaaccaatagataaaaaatcatttgtctcttcattcgaggtcggtttagaatcactatgaaaggtatatgcaataatagaaagcctggtgaagcccggagctgcagaaaagggttgaaattattttgggtcaaaaagaggcagccaagttgaaaaaggtgcccttattgagtgacaccatcaaatgggttcaaaagacgtgcttgaaaattggtggagagtcccagaggcagctagttctttacattttgatgaaagggggagacatccatgacttggctattttgccatctttaaaataatgaagtctaagaaggtatgctgattttcccaatgctgaatggtatagcagctggtgaattttcaataagatacacttttctcctgttctagcaagttttgatatttgccatttggttccagaaacttattgtgtctatgttcctaaagcactttgactctgagagagaggacaaactgaacctgatatatgatgtttgtgccccttgacggaggctgaattttctgaacttgaatgatcaatacaacagtgtcttgctaaaaattgtctcgcagaaaatttttcattcatttttcttgatggcaagtaatgtattccttcatcagaacaattaaacatctttaatgatttttaaagacagggtgtaattacatgcacatgataaaaatttaagcagcaccaagggcgtacagtgaaaattaagtctctttcctgactggagatcatagtatgagtgtttcatggctcctttcagagagattccatgtctagcatttatacatgcacataaattcatttcctttttaaaattaacacaaatgacagcatgctgtattctctctcttttaaaacattgagatggggtcaggcgcggtggctcacgcctgtaatcccacactttgggaggccgaggcaggcagatctcctgagatcgggagttcaagaccagcctgactaacatggagaaaccccgtctctactaaaaatacaaaattagccgggcgtggtggcacgcacctgtaatcccagctactcaagaggctgaggcaggagaattgcttgaacccaggaggcggaggttgtggtgagccgagactttgccattgcactccagcttggacaacaagagtgaaacaccatctcaaaaaaaaaaaaaaaaattgaggtgaaattcacatagcaaaattagccactttaaagtgtacaattcggtgacattttactccattcacactgttgttcggttatcacttctgcctagtcccaaaacgttatgttctcttttgcaatttactattgctctttcacttaaaaatctatcatggagattgttccatactaatacatatagattcatgtcttccatcttcatcctatgggtaacccttgtgccagacctggagatgagctgctcagatcctccttaaacaaaggctctctgtccagctgtggggagtgaggagctgatagccttaacctggcagctctttcagggtccccttagctgttaagtcatggtcatgctcttcttggagtggctcccatccagtgactgagggtacaagggcctgaccatttctctaacaggcaatctttgctgccttctgaaatggtggtagctctaaattgtgctctaatggcccctcctgcccaatcctatctcttctgcttttctggcagaggtgttactccctaatgaatcttttgcattctatccgggcatgcgcttctcggagaacccaaccaacatgtacagtatctcatgtacacagtcttctaaggattgacactgaggttgcttctggatttttgcaattacagatagtgctggatacaaatctttgcaaatataccttgcacgcatgcatgagaatatctggagaataaattcctagggtctaattgtgggtctatttaaattttgcataaaaatttgatacatgttttctaaccacctgctcctcccaagaggttgcaccagcttacagtcccaccaatcagggaagagggatttttttttttttttttttttttttgggacagggtccggtcctgccacccaggctagaatacagtggcgtgatcatggctcatggcaacctggtcttccccagttcaagcaatcctcccgcctcagcctccccagtagctgggatgatagccgcatgccaccacacccagctaatttatattttactttttgtagagacagagtctcactatgttgcctaggtggatcttgaattcctgagctcaagcgatcctcccactttagcctcccaaagctctgggatgacaggtgtgagccaccatgccctgcctgagaattgtcttctcacacccttgttaatagaactattatcacattttaaaatgttctcaattttgtaggtgaaaatatgtcatagtagttttaatttgcttttattttatgatgagtgaggttgattgtattttcaactccttaaaaatgatgacaagcaaatgaaaactatttcatactaaaacaagcagagaagataaacatttgccatggaatcttgagataaaacacaatgctttaaagaaatcctccgcttgtagagggctactttgtgctaaatttccatacatcttttggcacaaattctccttcctattaagaaaactgtgatagaaaaatttgagaagtcccgcatattgatgtaagattttcttaaagtacaggaggaaaggtgtctacctgtataagggatttcctgagtactgaatctattaggtttggacattaagcatgtcataatttaatatgtataatgagttaaaatgatttttttcgggagttgttgtgagttggcaattagaatgttttaattcctaccattggttacactctgtcaggctccatgagataaaggtaatggcagaaataattacgtttcctgttttcccaaatgagtctaaggaggaaccagggcagggaaggctaagctcccatttcaaatgtaacagctgtgagtgcaaaggaccagtggggaatttgtcctgtctgatgacaggggcaagttgaggtgacataggaaaggaatatcataacattctgagctttggtcacagaccaaggctatatctattaattaatggtctatttatttttatttttatttatttttttgagacagagtctcactctgttacccaggctggagtgcagtggcatgatctcggctcactgcaacctccccctcctgggttcaagcaattctcccggcttagcctcgtgggtaggtgggattacaggtgcacaacaccacgtccggctaatttttgtatttttagtggagacagggttttgccatgttggccaggttggtctcaaactcctgacctcaagtgatccacccgccttgggcacccacagtgttgggattacaggtctgtatctattccatttggatgatgttttgagactcattttgcttctttgtctcccttaggagcaggagacttggtgaggtatattgattagactagagggtaggctgctgtcacaaagaagccctaaaatgcagtgcttcaaaaatatgattaggacttatgtttttctcatgttataatccaggtgggcccagggttggataggtagcttggttctgtgaactcgtctagggacttgggttccttctgtcttattgcttagtcatctcctggagtttgtttttattcatgtgactgaagctgactcaccagcatcacatgcatgttctggctcattggaagggtgaaagagaggaagtggaggaccagcagttccctttttaggaaagtgatgaagatactgacacatcacttgcactcacattctgttcatgagaatttagtcacaaggccacatccagttgcaagggaagctgagaagtgagatcccagtagggtgaccacatgccctgttaaaactccatgggagggtataaatggaagaagagaggataaattttggaggacaattagccatcgatgccacatggactcagagcctggcagaattatgatccaagaaaggcaataggtctacgtctatcattagccacatccattccaaacctcctgaactggcaccacaagtgggcaagatagtggcaggggagaaggtagcaccactttcttctttgatccttcaaataggccagaatctgttatcaagggtgcccagttaactaacttggaagccattcagtcattcgacagataattaatggagcatctgctatgtgtctggcattgcctaggcactgggtgcagggatgtccttgtggagtttctaggagagtggaggaggtagatgtttaacaacaaagaactttgctagatatataattacaaattatgacaaatgccatgaaggaaagagtagaggattctgtgaagaacttgagatatggatttcattcatattagagatagagggaggtcttggagggagtatttaagctgagatctaaaagatgtgctggaattggctggtggatgatgaaagggaaataatggtctaggtagactgtcttagtccattcaggctgccgtaacaaaatgccataggctgggtagcttataaacaatagaaacttactgctcacagttctggaggctgggaattccaagatcaaggcattggcaaactcgtatctggcaagggcctgcttcttttttcactgtatcttcacatggcagaagcagcaaatgagctctctgggttctcttttataaggttactaatcccattcatgagggctccaccctcatgacctgatcacctaccaaagatttaccttctaataccattaccttggagattaggattttgacatgaattttgggacacagactataacacagaggaattagaatagtaaatgagaagagaaagaaattgtgtggctggagagagaggcagcatagtttttctatagacttgtaggcctatatgtatcagagagctattgttgcatatcaaattcccccaaaaggtagtgacttaaaacaatagtcccttattacttcatgatttggcaggctggcagtctaggctagactcagctgggaggcgttctggatctaggctgagctcccttatgcatctggagtcagctgtgggtcagcagatgcctctgcttctggggtaggctggttgttggctggggcacctcagctctcttccacatggtctctcatcctccattaggctagcccaggcaggattgttcacatggtggcagggttctaagagaaagttgctgcatgcaaagcctcttgagactcatgcttagaactgtcacgccataatttctgccacatctattggccaaagcaagtcccatggccagcctagattcaaggggtgaggaaatagattttaactcttgatgggaggagctgccaagccacattgtaaagggggcaagatagagggaggggtgaattatcaagggcatttttgcaaccaggtaggaaatttgtgtggttggaagtcacaggagatttttaagcagggaccagcaataacagggcacatagccaaggtcatttgtgctgcactgtgatggaaactttcaagagcttgtgtcttaccttgccgttgtggttatgagttcttaggatgcaaagtctgcgatgtcctttcccaaggctggacacagtgcccatctgccaactcaactcccttggttgcaaacaagaattgaaagctctgttttcagcacctccaggtttgccagtgaggtgttgttgaggagatttcacacagacagcttaacttgtttggagttgtgaagctaataccatcaccacaagctgagctgtgaagaatcccagacttgtctaaattataatttgtttgttgggccttaagggggtctgaaaagcctgttccaaattctttctctccaacacaaaagcatatttacccaaactggcatttccccttttgagcatgtttttttttcaatgatagtgttttgccaactatggtgtgctggttgttaagctattgtctctcgatgaacccatgaacccatccttctagacttttctctgcagtagcctctctgctttctctctctctctctctctttctttctttttcttttttttgacagagtttcgctctttttgcccaggctggagtgcaatggtgcgatcttggctcactgaaacctctgcctcccaggttcaagtgattctcctgcctcagcctcccaagtagctgggattacaggcatgcaccaccatgcctggctaattttgtgtttttagtagggacgaggtttctccatgttggtcaggctggtctcgaactcctgacctcagttgatccacccgccctggcctcccaaagtgctgggattacatgtgatagtttttctatagccttgtaggcctatatggatcagatagctattgctgcatactgaattcccttaaaggtagtggcttaaaacaatagtcacttattagttcatgatttggcaggttggcaatttaggctagactcagctgggaggcgtttgtgtgacctaggctgagcttcctcatctgcagtcagctgtgggtcagcagatgcccgtgtgatgttggggtggtgctctgtggagcaccttttcccgtcaccagccagatgctctgtcatgagggagactggaaggaaggaagaaggggaagggacaccctcctttttgtttgcttgcttttccagtagcatctcttcagcagtgattctttaccctggcaagggtcattgattacagaggaaattgttccagtttccagtttctttccctacactgctagaatcagcctcaggagctcccttagagacaccagcattgtcaggggccaaccctctcctcatagggtcccagctcctggtggttccaaacttctaggttctaataaccccatgctcttccctttattccttcaggacagtaactgctttacgtagttcttatctccttgttaactcaagggttcccttttttacttttttagttctcccataccgtttaaaaaattctgataaaataaactcatgcagtttctgttgtgttgcccaaaccttggctgttatatatagtatataagattattttaaatgatacccacttgagcactcaaacaaaaatttgaatgggcatttattagtataatatatattatggaaaaatataatgaatacacaaaactcattagttcttgaatattattgcttaagattaaaacaataaattaagaatgggttaacttaaagaacaatattatgcaaataggacgagtggaacacaagcaaaatagctgtgggtgtaggctagctgctggctggggcacttcagctctcctccacgtggtctctcatcctccattaggctagctttcgtaggcttgttcacattgtagtagaaagcatatgcatgccggagaaagcatatgcatgcaagaaattttgagagtacgctagtgaggtatgtctaccctgcccattactgtaataaaatgaccttttagaaggaaaatcatcttgattccaaaaaaggatcccgatagagagattagaaaagtcataaattcagatttcctacgtttctttacattcccaggtccatatatgatgtcaccagggttcccaacgtagcagccaaccgtggtcattccccagcacctgaactctatcctatagctgactgtttgctgggtttgaaggctgaactttacatattcagatcaaccaacagttgagagggttggctgccattttgaaagtcatatatagaaagagctgcacaaaagcaaccagtggagtctccaaagttgggggcccacatatttgtgtttcatcatcatggtgttgctgagctctgagttgctttctgggcggcagtctggaggtcaaataccagacctgggaagactgtgtagcgaggttggagagggagttggggaggcttgaggagccactcaaatatcttacctgtagctgacaaggcacaacccgtaatgacatcctgttctcagaactctaatgctattttttttttgctttcatgacaaggagttgaggtagttatctttgttccaagcaactccagatgggtgaaagtcaacccacacagtctggaaaggatactaatccttcaaatcagagacttcacaagaagcacagaggtggccaggcctaatgaggttaccccagtggaaactgtgaacccaaaatgtgacttctggattatgtgcaaatgagtagaaaagtgcagcccactaagtggggacctggcattagacagttgtctctggaaacacttcagcaaaggctaagtggggaacgtgtccctccatgactgacactcagtgtcatagctttaattttatttcacttctgagaggaaagttgacataggtgagctacagatggaaaggaaggggatatgaagaacgatttctcttttacctaaatgtgacagcaaaaatttttcaatttatacattcagtccttcacagagacttcttaatcttcagagagattgtgatgtgctgaaattttctggttgaatgttttcctttaggaatggtggttcagagatagaggcaaaaccaattgagaaccacaatttttctaagatagctaacagttccacttgaaatgatcaatatgatatagaaaaaaatggttctttggtttctgcactgattttaatctttttggaatttttttatacacagtgtcttaaaaaggaccaggtttgctatttattgatagatcttcctgaatgtctcatcaccaaaactttttttaaaacattgtttccttaatcactaaagtttgccaagtgtaggaatgaagtatatcaaggcaacttgcttgttcttgatttctgaattatttttgacttgttccttttctctgcctatatccaatcacttcccaagccccacacactggggccattcactcattcattcattcgacaaatatttattgagcacccgatatgtgcaaccttcttcctcaacctggagatatttatcctcaaaattttcattcaacgctttttattgtggacccttagcatctggtgacatgaggtatctgccattggcccagaaagtgttctgacatctttggcatcacaagcatcacttagattagtttattgcctctcttgtgtcaaggcataagtatgataatgatcaggtttgcatatatccatcaatttaaatagagaaataaatataacagagacaaggcgcggtggctcacgcctgtaagtgaggtcaaggtgggtggatcatctgaggtcaggagttcgagaccagtctggctaacgtggtgaaaccccatccctactaaaaatacaaaattagccaggtgtggtggcgcatgcctgtaatctcagctccttgggaggctgaggcaggagaatcacttgaacccgggaggtggaggttgcagtgagccaagatcgcaccactacaccccagcctaggaaaaaagagtgaaatttcatctcaaaaaataaaataaaataaatatgacagtaatctctgtttattaaacacataatgtgccaggtactattgtggtcaccctgcaaagacatggaccccaccacccaaaatttgttttagatgtcaagactgatgatacaccacatgcaccaagagggtaggaaaaggtttattgctcatataatgaagctttctgagagagcagggcagattcccaagcaggtccaaaaatggtttcagaaaaccaggcaaggaaactcccttagcatttatggtggttagggatggggatggggatggggatgcgatggggatggggatgaaatgtgggtctggtgggagggctagggcttgttgggtatgaatttccagctggtgccagaggagagagcagcaggctttcttagcttgcccagatgtggggcagagggggagagggagggtggaagatgttagcagtcccatatcaaaagtggaggcagactgtttttccctctacaattttttttattatggtaaaatacacaacataaaacttaccatcttaaccattttgaagtgcacggttcagtggtataaaataaattgatattgttgtgcaaccatcaccaccatccatatccacaagtcttcatcctgtaaaatgaaaactctgtacccattaaacaataatttccccactctgtctttctgcagccgctggggaccaccattctactttctgtctctctaattttgacaactctatgggcttcctttaagtagaaccatacagtatttgtttttctgtgactggcttattttacttagcgtaatgtcctacaaaatcattcatgttgtagcgtattgcagaaattccttttttttttttttttttttgatggagtcttgcccttgtcacccaggctggagtgcaatggcacgatctcagctcactgcaacctctgcctcctgggttcaagtgattctcctacctcagcctcctgagtagttgggactacaggcacaggcaaccacacccagctaatttttaaaatttttttatagagatagggtctcactatgttgctcaagctggtcttttaactcctggcctcaagcaatcctcccacctcagcctcccaaaatgttgagattacaggcgtcagccaccacgcctggccttttataatgttactaatttcatagaaatttaacagactcttacaatactagagaaacataaataaaaatattttaaataactcccatcaagaaagcataaataacttactttgtgattgcagcaaaaaagttaaccactgagggcaggcaaatcttcaggggatttagctggctcatcactatccgctcaaaattcagactctgaggatactgcaaacctttggtttaaaaaaaaaaaagatttttaaaggtacaaataagtgaaaagtgtaagatatctttaaaagcacaaattatcacacatttaaaaaaaacttaaaaaaattatttgcagaaatgctttcaataaaggtccatgcagatagtcacacagtatatggcccagaagagtatcactaggctaaccacattcattggtcaccaaggcagcttctctaaaggaaacttaggaagtagcaggctgtaagattccacgacaacgtgaagttcatacgtttgtaagctcagtgtatgctgagctaatacagagggagaaaaagaccttgtgatttggtttcagctaacaatcacgacaggcaacaaaacaaaacagcaatttgattctagcttgcatgtctcgttagtgaagctgagtgctgttttcaggtgcacagtagtcatctgtagttttttttctaaacaagaaaactccaaatttgccttctacctcaacggacggcaaatttagacagaagccactttcttagacttagtgaatacaattctttcctacatgagtaaaataaagacatcacatttattttaagaggcaagctgaccaacttgtacttaagtatattttcttaggagtttctttgatgcatatttcaataaaaattacctaaatgggatgtcactgcttacaaaaacaagatatttaattcagattcctggcattaatttatacaaagaaaagcagagcttgtatttacttaccttgtgataaaacctcatcctactagttcatacaacatcttttagaagcatgtaggatgtaggtaaacatatataatgcaacacgtacaactgtcagtttagagctgtggctgttaacctaaggagactgcaacccccacagaggacacctggcagtgtctggagacacttttagttgtcacagctgggggtggtcagggactgctgttggcagctagtaggtggaggctgttaaacatcctacagtgcagaggacagcccccgacgatgaaggatgatgcagcccaaatggcaatcatgcagggttgacagaccctggtttagaggaagtgacccacaaaaccatatgaattattcataaacataaacagaacaatttacaatgacttataaacactgttcttggagactctcttcaactaaaatacgctaatctagtaagtttcaactgatagatttgaattataagtaactcttagaaattagcaaaacaatactggtcaattaagtctcaaggcttcaggcagagtgtaatctatataaactcaaactttagggtcagctgaacctggcttcagttttctaatcctgccagtaaccatgtgatcttgggaaaatgacttccccgtgctttggtgctgtctgtaaagggagaatacctgccatttactgggctgttacaaggacaacaaagagaaggtgcatccaactgaagctttgtacagggcgctggcacagcccagggctcagcctcacctctggagacatcttcacatttcaaaccttcaaaggcagaaacctctttcttaacctcaaatccatcttaaggggtttgtagggttctcaagctcaaatctatcttaaggggtttgtaggggcctatgagctgcttgaaattattattagaagtttgagtgtacatgcagttttctgaatccagtttttataaaaatctcaaaaaagtaatgaatcaccattctgaagggtgacaagaacacaaggaaaatccagtccagcactcccacaacactgaccttctttcaggtttccgctcaaaagctgcttgtgtctaaaaacaaaggtgtagaacacagcttggcaggctgagtaaaatggtccatggagagcaacatcgcagaatgcctttgttcccgaatcctggttattaaggtatatgtgcagccagttaaccaaaagatctaggcatggttttacagtactagagaaaagaaaaattcaagtcaactttacacttcataaaaaaaccagaataacataaaaacacacaactgcctttcattacaaaccatgctaagtaagttcataggtttctttaaataatacccatgggtacagaggaaaagcaaagaaaggaaggataaggatgggtgcgtaggaagacaaccttccaattacaaggcagagtagctctgaccttctaggaacaggtgagcccctaagaacgtcccaagggatggaaagcaggttctcctaaccatctcaaaggcacccctcttagggtgattggccaaataggacatgttcaccaacacgtctcaagagaaagacagtctggtggacttcagtattccctgatgcatccagtcaagtcctatgggtgaataattttgttcttggggaagggtttcaacagcatccttgtccaaagatatcttcatgggccactgaaagaaactggcctcctagataggtctattacctttaaaagggtttttcttcagctttaacagatacaatagatttggaatgcaaatgaaaaaaatgacaaacctacaaaaagaatcaaaacagtatacaacactgtcctctatccacaaaacaaatggatctttaagtgcaaccacacaaaagagatgacaaaagccttacatacagggttttatatataaaaaaggagacactttattctaaaatcaccacttagaaatataaacatcttgcacagagtaggaattttattcactttaaaaacatgccaaaaacatatgggagatatttctgacttgagacaatgctatactctttttaaagcatgatattaaaaagtactcggcaaattaggctacttacataagagaaataaatttagctcttgccaaaaagcttccaatataatttccagcagcctgcctgatgatggcaggattacttggatcctgcaagtttttccaaagatgttccaaaaatgcctctgcgaatccctataaaaagagagggcatcggtgtgatattttttaatgcctaagataatctgactatcaaaatcccaagatttttacttcaccaatgtagggaaaagttctactatctcataactatctcatgggcttcatttttaaaacacgttgagagaatatcattagaaacaaaaggcacctcgggtgttaaataatccaatggatcccaaacctagctaagcatcaaaatcaacccagggccaggcacagtggctcacgcctgtaaatgtaatcccagcactttgggaggccgaggcgggtggatcacccaaggtcaggagctcgagaccagactggccaacatggagaaaccctctctctactaaaaatacaaaaattagccaggcgtggtggcaggtgcctgtaatcccagctacttgggaggttgaggcaggagaatcacttgaacccaggaggcagaggttgcagtgagctgagatcatgccactacactccagcctgggtgacagagtgagactccatctcaaaaaacaaacaaacaaaaaacaacaaaaaattcaacctgggaggtacaaattcaataggtttgtgacagggctttggaatccacatattataaaaactcttcaagtgattccaatgtcagccagaactagtgaccaacaataattcacatcccatggagctccacatgggcactcctgtgagtgcaaagcaccttccggtctctggacacactgaactcaaccatgaacagaaatacggactaatgtacagctggtatttgagttaattatgccaatcatggaaaaaaacagacacagcttctcaccaaagggtgtaacttccaacttctcctaaatagcgctgttctaaagctaggcacgcccatgtgggcagactgaattcaaccttctttcccatgaccaacactctcctgacctctaggaagccacaaaatcgttgcagagaaggaaaagccttctatattctttcccccaccaaaaaaaaaaagaagaagaagaagaaaagtcaaagcctaaagtttttaaaattctagattaataagttggtttgggctagttacaactcaacccttggaaagaataaaggaaatactgttaattaccccatatgagattttaatagagaaaggcttaagggaagaccaccacctagtgaccaaaggcaggatgacattttcagagcacctagctgggctggcaggcagcaatctgttttctctccaagtgtactgagaagggaacgtgggccaggcacagttgttcacacctgtaatcccaacgctttgcggggcaggaggcgggcagatcacttgcggtcaggagttcacaaccagtctggccaacatggtgaaaccccgcctcttctaaaaacacaaaaattagccaggcatggtaatctgtggtcccagctactcgtaagaagtaatgctataaagtgtacaagtggtaaaatgcagaaattaaacagttatgcttttccattagccacgccctcacagacagcatctggcttacaaaaacaaacactgaaagttacaacaacaaaagtgaaacatacttcaccaaacccaaattcaaagccttggaaatagaccaattatgctaagtgctaaatgacatggcagcaaattactcatataaggaatcgttttcaagtttgctaaactattttaattctttcaatctaaagccttaacaaagatgagcagcactagctgtttccaccctttgattatgataaacttcatctccactttcattaataaactgctaaccatattaaacaatccttccgtggaatctgtcccaccacaagtttgatttgctgtttcttcagcatcttcaataccctgccgggatgcattcacctataacaaaggggggggaaaaaagaataaaaggatttaaaaaatacaactatgttattttgggatggaaattcatctgatatacacacgttcaaggtgtccagattagtgccttatatcacaccccaacacaatacacaattatggtgcaagcctgtaaactgacctaggtcatgaaggaatttaaatataataaaccaagccccttttactacatacttatataaaatcgacaactatcacatgatgctctatgtcaggtagcctcaacaaattcaacatttattctagctctgatatggtctggctctgtgtccccacccaaatctcacttttttttttttttttttttgaggcagagttttgctcttgttgcccaggctggaatacaatggcaagatcttggctcaccgcaaactccgccccccaggttcaagagattctcctgcctcagcctcctgagtagctgggattacaggcatgtgccactgtgcccagctaattttgtatttttagtagagatggggttactccatgttagtcaggctggtctcgaactcctgacctcaggtgatccaccggcctcagcttcccaaagtgctggaattacaggcatgagccaccacgcctggccccaaatctcatcttgaattgtactcctgtaagtcccacatgttgttgggggggggactggtgggagataatttgaatcatagggtaggtttcccccatactgttctcatgatagtgaataagtctcacgagatctgatggttttatcaggggtttccacttttacatcttcctcattttctcttgccgccaccatgtaagaagtgcctttcacctcccgccatgattctgagggctccccagccatgtggaactgtaagtccaattaaacctcttttttggccaggtgcagtggctcacgcctgtaatcccagcactttgggaggccgaggtggatggatcatgaggtcaggagattgagaccatcctggctaacacagtgaaaccccatctctactaaaaatacaaaaaattagccgggcatggtggcacgtgcctgtaatcccagctaatcaggaggctgaggcaggagaactgcttgaacccgggaggtggaggttgcagtgagccgagatcgcaccactgcactccagcctgggcaacagagcgagacaccatctcaaacaaacaaacaaaaacatctctttttcttcccaggctcagctatgtctttatcagcagtgtgaaaatggactaatacaatctctatgcacaagacactcacagacacattgtgtaataaacatatcgtcaatcaattgagcagaaaaatgatgaactgcaagccaaatgtgcatgatgcaatatttattttggtatatcaccattcaaatatcttaacataccactcaaaccatgccattttttattaactatgcctgaccttctttgtaaacattctaaaatgttccttaagtatataccagagaaagactataaagagtacatatacagttggccagagaggtgcaactccaagggagcactgcaccagtgagcccaagctccagctcttctaagaccttgttccatcttcctgctttcctatagcatcaatgttttcctccaccaaagctcctctcccctcagtccacaaacctgctcacatctccccactcctaaaccacgcctcttagccctgctccatcccctccttccaccacaaccctgcaccaaggtctctaacagccccaattctgcttccccaccatccacatcctctcccgaaatgcagtttctgcgtcttcactgacatggtcctccagaaagcaacaaagactaccttctaaccactaaatccaaggactgttgctcttttcatctttctaaaaaatgacagcagtatctgatgctgctgaccaaactcctccttccagcggattcttcctgagcatccagactcttggttttccccatacttctgatcacccttctcctcccctgtcctaaactgcatctttccaaaggtttatgctcaggtccccatctgcagccacgactgcctgtgagtattctctggtaggctgcccaccagcaactgaacctggccaagatggaactactcttccaactgcctcctcttcatattttttttttctttttttttgagacagagtcttgctctgtcacccaggctggagcagagtggcacaatctgggctcactgcaagctccacctcccaggttcacaccattctcctgcctcagcctcccgagtagctgggactataggtgcccaccaccatacccggccaattttttatatttttagtgagacagagtttcaccatgttagccaggatggtctcgatctcctgacctcgtgatccgcccgcctcggcctcccaaagtgctgggattacatgcgtgagccaccacacccagcctcctcttcatatttctaactaccattaatggcaacaccaagattcgattccacagggagcaactattgaaggattcctttcccttactgtctgcctcccctcctccaaaccagtctcaaggaccagttcacctttcctcacaatgtcactagaatctaccacttcctttcattcccactgcaccttagtgcgggcctccttaaacaaagttttaactgtttataattataatctgcccttaagaaaggccaaacaggaaaaatcacttccgtaggaatcccttcctgaccccactgtgattctatcaggttctctaactcataatgtatgtttcattcatggcattttccacaaccatacttttacatttggataactatgtatttaacgccttgttctccaatcatgagaaggaactgtctacaactcccagcacatgcacagatggagttcaagacacattcaaagaaaggaagcaaagaatggtgctagtggtttcttttcttttcttttctttttttttttttgagatggagtctcgctctgtcgcccaggctggagtgcagtggcacgatctcagctcactgcaagatctgcctcccggattcaagcaattctcccacctcagcctcctgagtagctgggattacaggcacccaccatcatgcctggctaattttttttttttttttttatagagacggggtttcgccatgttggccaggctggtcttgaactcctgacctcaggtgatctgcctgcctcggcctcccaaagtgctgggaataaaggcatgagccaccatgcctggccaagtggattcttttctatcactgactattgtttccacatactgtgattataacaaattcaagtcagtaaatgaaaataaaaaaataaaaaataaaaaaaagaaaataaaaatagattactcaatacttacatccagcttgagtagtttttcaataataagctccagaatttcatgcctcaaggttggaaaatatacactaatccttagtaagttatgaacgtaacattcctaaaggagaaaacgtaagataaaacatttcaacagagaataaatatttcacagttatgtaagaaaaacatcaattacatgacctttagtttcaaatattgaaaaagaaaaaaacagactatccagcaatacaaaaactatactgtttctacatgtattatgttcggtataatcatttcaattatccccagtaaatgaaatttttaatttgcataactataggtttttaagtagctgtattgataaaactcatatatcatacaatcaccaacttaaagtatacaatttaagtttttaatatattcagttatgtgaccgtcaacataatcaatttcagaacatttatttttcttttagagacagggtcttgctctctctctcaggatgaggtacagtgggtgcaatcatagctcactgcaaccttgaattcccgggataagcaatccttcctcctcagcctccctagtagctagaactacaggtgcacaccaccacatgaggttaattcttccttttagggagacattttctcactatgttgcccaggctggtcttcaactcctggatcttcccacttcagcctcccgaagtgctgtgattatgggcataagccactgcacccagccagcaattttgtaacattttaatcactctaaaaagaaatcctacatccattagtgcacccctaaaaaatgaagaccttggcaaccactagtctttctatgaatctgcctctttgagacatttcatataaatggagtcatataatacatgtttttagggttcaatcatgttgtaacatgtaaaccattcctctcatatcaatggagtcatacacagtttgtggcatgtttttaaggttcaatcatgttgtaacatgtaaaccattcctttcctatcaatggagtcatataatacacagccttttggcatgtttttagggtccaatcatgttgtaacatataaagcattccttttcattgctgagtaatattccattgtaccatgttttgtcatctgttcatcagttgacagacatttgagttgcttctacttgaggctattatggatgctgctgctatgaacatccatgtacaagtttttctgtggacatatattttcatttctcttgggtataaacccagaaatggaactgctgagtcacgtgttaattctacatttaaccttgaagaaatgccaggctattttccaaaacggctgcaccattttacattctcacagcaacatatgacagttccaacgttcccatttctccatatccttgtgaacacttgttactgtcttctcgttctgattatagccatccttgtgggcattaagtgaaatcatttccctgatggctaatgatgttgagcttcttttcatgtgttttgcagaaatgcctattcagatcctttgccctcttcagttgggctatttgcccttttattattcaattataagagttctttacatatacaagtccattaccagacataaaatttagaaatatttcctcccattatttggggattcttttcatcttcttgaagatgtcctatgaagcataacaacgtttaattttgaagtacaattgatgcattttttctttggttgcttgtgcttaggcatcaaatctggaaattactgcctaatccaacattatgaaaatgtactcgttttcttctcagagttttacagtttttacacttcatgtagggcttttattgagttcatttttgtatatggatatccatatgcttcactcttttgcatgttcatatccacttctgccagcagcatttgttgaaatgactattctcccctattcaattgtcttgaacaactggttagtgtatgttagtcttctgtcccgtaaccatgctgaactcatttattatctctaaaatttcttgtgtgtgtgtaaacttcttagaatgacatataaaatcaccatgcaaaagagagtttacgccttcctttccatctggatgcttttaattctttttcttgcctaactgccttggctagacaagcagcaagagcggaaatccttgttttgttctttgtcttaggaaaaaacttttggtctttcaccactgaatatgatgttagctgtgggtttttcagatgccctttatcaggttgagaaaatttccttctgtttttctcataaagggatattggtgtttgtcacacacttctgcatctactgagatgattatgtggtttttgtcctttgttctattgctacaaaatattttattaattcattttcaggtactaactcaatctcagccggtcacggtggttcacgcctctaatcccaacactttgcgaggtggagacgggtagatcgcttgaggtcaggagttcaagaccagtctggccaacatggcaaaaccccatctctaccaaaaacacaaaaattagtggggtgtggtgccccatgtctatagtcccacctacttgggaagctgaggtgggagagtcacttgaaccctggaggcagaggctgcagtgagctgagatggtgccactgcactccagcctgggtgacagacagagactgtccccccacccccgaaaaaaaaaatcaatcttgcattcctaacatcagtcgcacttggtcatggtacgtaattctttttgtatgctactagattcggttttctactaaggcaaccactattaattattaaaaactgcacagatgatctgaacattgtacaaaaacttaagcagaattcttctatggaaggctttgttttcaggttaaaataaggcatgttcacaattagtaatacatgaactattatcttctagtaattcttgcccgtatgagcataaagccactacagatattccggaaatgaactcagaccttgacttgcacatagtaataacagaaaaaggcactgcgaatccccaatagccgctttataagaaaggaatctgagtcaaattcttagacatcagtttaaagtctagaagacaaagtaacctttaagaaaaagacctaacatcagccgggcacggtggttcaccaatcccagcactttgggaggccgaggcaggcagatcacaaggtcaggcgttcgataacagtgtggccaatatggtgaaaccttgtctctactaaaaatacaaaaattagctgggcatggtggtaggtgcctgcagtcccagctaatggggaggctgaggcaggagaattgcttgaacccgagaggcagaggttgcagtgagccaagatgacgccattgcactccagcttgggcgatagagtgagactcggtctcaaaaaagaaaaataaaaataaagacagaaaaagaaagaaaaagacctaatatcatctaaaatgaaatcatacaaacaacttttccatgatgttctcaatgaaaagatttcttaccagtgttctctctgattttcgaacaaatggaaatttttccaccagtattggcatgagaaaccacggtgccctatttttaaaaaattaaatcaatccatgttgactttactttctagaaaaggaataaaaaggaaaactaccattctaaaagcaaatatcgatagacataggaggcaaacaggaacccttacctcaaagaactggaactttttttgttttttgagacggagtttcgctcttgttgcccaggctggagtgcagtggcacaatctcggctcactgtaacctctgcctcccgggttcaagcgattctcctgcctcagccccccaaacagctgggattacaggcatgcgccaccacgcccacctaattttgtatttttagtagagacggggtttctccatgttggtcaggctagtctcgaactcccgacctcaggtgatccgcccgcctcagcctcccaaagtgctgggattacaggtgtgagccaccgcgcccggccagaactggaacttacaatgtatagcttctgagaaagtctataacaacttagagaaaataagcttctgttaactctgatatcaacagcaaatcaaagagggagcttctctcccacagaaacataacagcacttttgctgacatttcccactacacatgtatattatttttaaaagaagaaaaaataatcaagttggatttttttaagttaacaaataatcaacagacagagggaactagaaatccacccctccaaaagaaacccacaaacctgaaaagcttttcttagaagtgcaatttttattcatatggcatgacacaaacacacccaggggtttctcactgaaaaattttggatagcatatctgttgaagataaaaacaaaattccaaccaccatacaaaattgggggagaatctgcatacgaactttgaaaaacaattaaagagaataaatagaaaatggaaatgccactttttgtagaatgtaatgtttcctcaagtggatacaaaaaaaaaaatgcaatgtaagactcaagctttaatactattaacattttataatttttactaattgattacaattttcttgagaattaaacattcaaaataaggaaaagtatactcatgatggtacatatcttgctattatttgcaaggctctgtgatatgtgtcaaaatttgcaggaagatctgaaagaagaaaagttcagagtatgagcatcaaaacaaaactgaagggcgacatgcttgaaactaaaaataaatgctggccgggcacagtggctcacgcctgtaatcccagcactctgggaggccgaggtgggtggatcacctgaggtcaggagttcgagaccagcctgaccaatatggtgaaaccccatctctactaaaaatacaaaaattagccgggcatggtggcaaacgcctgtagtcccatctactcaggaggctgaagcaggagaatcacttgaacctaggaggtgaaggctgcagcgaaccaagatcacaccactgtactccagcctgggcaacagagcgagactctgtctcaaaaaacaaacaaacaaacaaaaagtgacatacttgaagctaaaaacacatgctaaccaaaacggaataatttatcagagaaataataatttcaagacttttctccaccagcatcaatgaaaattaaatggactaattatataaataatgcattcaggacaactgactgcatatcaatggtaaatataacaaaaagattacatcaaaagttgtcatttgttgcagtctacttattagaatagatgccaggtattctgtgctttacttttttttttttaaagaagacagagtcttgccaccaggcagagcttgaactcctgggctcaagcaatccacccacttaagcctcccaggtagctgtgactaaagacacacactaccctgcctagttctactttaagccttttttaagaaaatatttgaaaaaaaatgtttttttgcagagacaaggtctcactatgttgcccaggctggtctcaaactcttggcctcaagtgatcctcccatcttggcctcccaaaatgctgggattatgggtgtaagctactgtgcccaggctttaaacctttttatacttactatcatcttcatcatcagaatctgaaacatctacatcgccttccttaatgatcactcaggcttttgagggaaaaagaaaatatgttgttctgtcattgatctagacaatgaatggctatacaaaaaaagttattgacctagacaatgaacagctataaaaaaagttatttttccataatccaaagttagcccaatgattaattaaatgcacaatctgaaaaaaagtaatgcaactttatagtttttaaatggctaaaaattcctagatttcaccaggagttcaataaagcaagttataattcatcaaactcacagcaacaaatgaatctagacacctccataggggtcattacggggaatatatgtctaccagacctggtgccaatatgcatctggaatcttccatggtagcagtctctcatatataaggggaaggtggtattttaacaaagaagtattaaaaagaaaagaaaagaaaattccaagcaagcaaagagtaatgacttacgaggcacaaaatgggaagcaatcatgctgagacacggtctgaggaaaacagtctatgctgatacaagattaccaagaaaagccaaatactcttccactactgtttgacttctattcaaccaaggcaatctctagagtgggggaagaaagataaaagcagcatgttattaatataacatatactattaccaaagttctgaattacatacttgacagtaaaataaatggtgaacttaccaatataatactgataagttgctcaaagtcttttgtcaagtacatgacagaagaacggaattctagcagccagttgatgatctggtcatccttaagttaaacaaagagtactttcaaaatcacaaatcctctaagataacagaaatttacagctatcttatatcaatcatttatcaagaataggttggggggaaaaggtcacaaacttggaaggaaatcaaaactgggtattaaaacagaaaaagatgtcacaataaacttaatcgttttaagaaagtaatctagtaactctaatacacaggagaaagacttaaatgcaatacttcagcctgatcacttttgtttgccctgaaaaagtgaaatcacctcaaatgttgacacctgggacttttaaaaactgcagaattctagcagattgaaatattagaagatcacaaaggaacaatagctacctctatttcctctatattcaagctgaccaggaagcatgctgataaaattcagtctaggctgatcaattggggtcatgaataaacataacttttctaaaccaaatctgtggctgagtttaaatatattatgatgtgtttgttctgtataaatgatagccccattcctccatgaaatatttttcaggcaatcaaattactgttcatagtaattgttagtgacatgagaagaactgctaaatttgaaacgcaaggtataaaatacagtgtcaattatgtaaaatattactatattaattatattcatgcatatatactgcacaggacaaaaaccattaagaaaaagcccctaatttgtggaaggcttagacatataaataaaagcaacacaaggtcatcatacctacagggatattcatatggagttatcatttagtgagaatacaccatatgccaggcatggtgcctgacactccgcatatatatcttcttctaatcctaagaactctgcaagatgtttagttattcccattttgctgttcaggaagctgaggctaagaacgattaataagcaatctgcccaaccaagaggccagtaaagaagcaggtccaaacccatctgtctcggtcaaggctatcctctgtccaccatcccacatgcctccctatatgcggagaagaagctgtccccttttccccaccttaattcagctactgagtgcttactatgccatatccatgtgtcaaactcccacagatcaaccattttctgatgaaatcccaagtagcctggcagtaaaataaagtaaaaccacaactcatttgtactatggtaatttcatatgtccaaaactgttaaggataacattaacggtagctcactaaggccaaaggcatgtagaaaacaagctaagttagtgtgtaaataaaataatctatcctatctcttttccactaaaaagactgcaacaaaactataaggataacatttaaactgtaccatttttaaaagtaaatcaggctgggggtggtggctcacacctgtaatcccaacactttgggaggccgaggtgggtggatcacctgaggttgggagttcgagacgagcctaaccaacatggagaaaccccgtctctactaaaaatacaaaattagctgggcgtggtggtgcatgcccataatcccagctactcgggaggctgaggcaggagaattacttaaaaaactcggaggcagaggttgcagtgagccaagatcatgccactgcactccagcctgggcaacaagagcaaaactatgtctcaaaaagaaaaaaaaaaaagtaaatcagttgcagactttgatgctttagtactgaactattattatttctactagcaggcaggaacagtggctcatgcctgtaatcccagcacttttcggaggccaaggcaggaggaaactgcttgagcccaggaatttgagaccagcctgggcaacatagggagacctcgtctctagaaaaattagccaggcatggtagcacatgcttgtggtcccaggtgctcgggagcctgaggtgggaagattgcttgagcctgggaggttgaggctgcagtgagccatgatcgggcccattacactccagcctgggtgacacagcgagaccctgtctcaagacgaaaaaagttctacttgcaacactccacacaactagtgcaattcttggtatgtcaaaataccaagaatgagaactgctgatacaaaatacagtggaacacaaagaaaatgtccctttgtatctgggaaaggaggcaggggtcaggaaaagctttaaagagaaagtgatgcttcagctgtctttaaacagtaacacagttgagtcttttctggaagttctgcttcttacagaaggaaaagtatgttttcagaaaactgaaaaatgttcagtatggctggcatgtatagtgaccaagccaacagataataaatctggggaacaaagaagcaccaaatagaccatggagggccttgtaaaccagatctgtaactagagagatctggaagtgtgggaaatagactcaatgaaggaacaaccatgtgcttagagagaaccagggaaagctccatgaaagatggagcccagccaagagtggacatgataagtttggagcatctatgatgattctgggtaaatgcatctaacagacagttaagaaacaagtctaggccgggtgcagtggctcacgtctataatcccagcactttgggaggctgaggcgggtggatcacttgaggtcaggagttcgagaccagcctggccagcatggtgaaaccccaaatctactgaaaatacaaaaaaattagctgggcgtggtggcacagctactcaggaggctgaggtgggaggatggcttgaacccaggaggcagaggttgcagtgagccaagatcatcccactacactacagcctaggtgacagagcaagactctgttctgcccatccccaaaaatgaaaatgaaataagtctggagcccacaagagcaatcttggctacagacacaaatatattaggacacaggtagatttcaaagccatgaagggagatgaggagatcacacagaagaatcaacagagtgagaaaagagtcaagttttgaagcccaatcaacaccaaatttaagatcaagaacctatcgagagatactagagcttaaaggatcactggccgggtgtggtggctcacacctctaatcctagcactttgggagtccaaggcgggtggatcacgaggtcagaagatcgataccatcctggctaacatggtgaaaccccatctctactaaaaatacaaaaaattagctgggggtggtggcgggcgcgtgtagtcccagctactcgggaggctgaggtaggagaatcacttgaactcgggaggtggagcttgcagtgagccaagattgcgtcattgcactccagcctgggcgacagagcaaaaaaaaaaaaaaaaaaaaaaagagagagattaaaggatcagaagacaggaggatcagaaacactgaagttttaagaagtgggtggccaacagtgtcggctgatacaaggaatacaaggcttaaaaaagtaagtccactgaggctgggctcagtggctcacacttgtaatcccagcactttgggaggccgaggcaggcaggtcacctgaggtcaggagttcaagaccagcctggccaacatggtgaaaccccgtttctactaaaaataaaaaaattaaccaggcatggtggcgggtgcctgtaatctcagctatttgggaggctgaggcaggagaattgcttgaacccaggaggcaaaggttgcagggagcccatatcacaccactgcactccagcctgggtgacaagaaggagactttgtctcaaaaaaagtccactgaaatcagcatgtaaaaaaaaaacatgggtaatctgtcagggtaattactacagtgataagaacagtggacttaaatgtgagtgagaaatgatacagcacagtcagctggaacaaaaacaacagatgacaattactgcccttactttgagtcagagactgttctaagtgcttcttgcatattagctcattgaatccttgttaagtatttccatgtttaaagccaggcacagtggcatgcacctatagtcccagctttttagaaggctgaagagaaaggatcatttgaggccaggagttcaaggctgtagtgcactatgatcacacctgtgaatagctagagcaacacagcaagaccacatctcttaaaaaacaaaacactccatattttttaaatctctattgttttcttggtttcacacagtggaaaatagaggcagagaggttaaaacaatttgctcaagatcacacactggataataaaattggaatttcattccaggcaatctaactaccactgccatggtaataaaccattctcttcaaaactgggcagtaaaggaagaatggtgaaacaaaatgtattaaggttttactacatgataggtgtatctcgaacctggaaatgctgaaacagtggtttgttttttttttttggtttgttttagctttaaagagacaaaagagttgcatgcagcatggaggaaagaggtagtaatctaatagaaaggaagcattagagcagggtttcccagcctcaacactgttgtcatttggggctggatcactcttggttatgggaggctgccctgtgcactgtgagatgtttagcagcatctctgtcattcacccactagatgccagtagcaccctttcctcccagttgtgacaaaaatatctgcagccatcaccaaatgtcttctagggggtaaaactgtccctggttgagaaccaccagattaaagtaagggaggaccatggagagagcaagttctgcagaacagaatgggacccaaagagcaaactatgtctgtataaagtggcaataattttgctaatgatcaaacacaaaattaattacctttatgtctggatctaacagctggttcttcaacaactcaaagtcatttgtttcacccttaacaagaaggggaaagaattaagttatgcttttgtttcctgtttagtatcaacagcaagacttttaaccgtactttaacatcagatgaaattataaaaggaacactaactttcacatgtcaattgcggattataaaatcatgactacaaaaatttaaacactcatgttagtgcagccagagggcttggaaaaaggaaaatgataaactacatttagctatacttctgtattgacatttgaatataatagttgatactcctgcgaattctcaaaaagcatgaggggaaaaaacagccagctctaatgatctaattcaggaggatctaaaaaagtattcactcaaatatggatacaaatggatatttcatataaacatacggttacttaacattttccctctactgctgagatatagtagaaatgcttctaaactaccacaaaaacaaaaatccctattcagagaaccggtttactgtcccaaagtaatgcttaggtaagttcctcaaaaaataaaatgctgtaggccaggcatggtggctcacatctgtaatcccagcactttgggaggccaaggcgggtggatcacaagctcaggagtttgagaccagccaggccaacatggtgaaaccccgtctctattaaaaaaattaaaaaattagccaggtgtggtggtgcgtgcctgtaaccccagctattcagaagactgaggcaggagaattgcttgaacctgggaggtggaggatgcagtgagctgaggtcacgccactgcactccagcctgggtgacagaggaagactccagcacaaataaataaataaataaaatgctgtaattgtttttaattctagcacttgctaaagttaaaagatgctttgtaaataaagcatttgaagaggtgaaacctcagtaaagacattattactctctcattattacctgtgaaatgggccaaggtgggggaaaaaaaggacactattactctaattttgcactgacggcatcatgctattattaaatatttgatttcaactggtatcttaattaatcttgctatttctattggtctttagtataacagcaatagttgtattctgacctgaccaaaagcaaacctcacacattatctcctcttacctttttgtacttcagcaagacttctgtcacagttccaccaaaccgaacagtttttcttgggggagaattgaaaaaatcattctctaatgcacgcatatttgaaatcctgtggaaccaagattaacaagctattaagttcatgaaaataataaaaattataatagccaacctttattgaaccaacataattcagtgggactattgttaaggcctctttactggtctccctgcttccactcttaaccaacaatccctcctttgctcagcaaccaataactgtcttcccactgcacttacagtaacaatccaaatctctcagtgtggtctttaaaatcctacattaatctggcccccgcctacctctctcacctcatctccaacaacttgttttactacagccatcatgtcttttctgctcttcaaacaagccaagctgtttctcatttcacttactgttcactctattggaaatactcttttcccaaatctctacgtggctggatttttttttttttttgagatggagtcttgctctgctgcccaggctggagtgcagtggtgtgatctcagcttaactgcaacctccatctccgggttcaagcaattctcctgcctcagcctcctgagtagctgggattacaggcacctgccaccacgcctggctaatttttatattttcagtagagacgaggtttcgcatgttggccaggctggtctcgaactcctgacttcaggtgatccgcccacctcggcctcccaaagtgctgggattacaggcgtgagcaaccgcgcccggcctagatttttgtcttcattcaagtagaagctgaaatgacagatgtcttcccaatgagaaatctcgaacactccttctctcccttctccctcccccattaccttgttgtataactgaaatcatcgtgttcgtttatttattggcctgtgtactgccttcccaccctatgctgtaagctctgtagaaagcagggacattagtgtctttggataaaccactgtccccagtgtttaacacagtaagcaggagctcgataaatattaggaatcatattacgctaattgttttacaaggtttgcttcacttacacgtagtaaattaatgaaaaaacatagcatcctaatgactctgaaagttaaacgccaagagtgctatgggggttagggattttaaaagtggagcaaaataaagactgcgaaacaaatacgtgtgtcgaaacaaatttcaaacaaaaaagatgtaatattcaatttgccatgagtgacaacgttcggctgataacccacatagcccagggaaatcccttccaaatttggacgaagaagagggaaggaagaggggtcaaggcgcagaaggcagtacccaggcctgggaaatcacgaagagacacagtcgggaaagtgggcctccagaacagagaacatactcacttttccaggccccacccatgtctattacccagttaggaggaatgagctcatttctgtgaacgtgagatgaccctcgaccccgtgctcctatcacacgccattagctttgtcccacatcctttcaatccgctcctctaagcgcggtcctgagctttggtcccagacgcgcagaaggaagcggcctgaatcttacccagtcctcgacgcgcccagcgtcttgactgcagaggacgaagcggccgcatctcccgacaaacaacgtgtgaagcagcggtgccgccattgggccgaactaacgcgaccgctgcgcctcaggccggatgcccagctccttccagccacagcctctgtcccggaagttgcgcgtgccagcgcaaccttcagacaatcaggggccccgtgtggggagggcgtatgctctcggcgggctagagcgccgctaaaacgcgctcttcgttctacttggaggacttgttccagccagcgtgagtgcgcgagtgtaaggagagacgggaaggatcggctccatccagccctgaggatcccaaagaaagggtggaaacaccctggatgtgctaagctgtggccaggtacactcaagtgttaattttttggagtcaaagcctccctcagtcagatcgaagaaactgaagcacttgtgactgacccagatcttcacggaggaaaggggattcgaacccggctgacccaggagcctgggctctatactcagtgcagcattctcacagacacccaagataacgttatcctcatggaaacgagctcgacgaagtgacctaccccagagcctcaaggctgtgatgatgctggcatgagaaacaacaggagagttaccaagaggtgttacccccttgactttatttatttatttatttatttatttatttatttatttattttcttttgagaccgagtcttgccctgttgcccaggtggagtgcagtggcgtgatctcagctcactgcaacctccgcctccccagttcaagcaattctcttgcctcagcctcccaagtagctgggattacaggcgcatgccaccacacccggctaattttcgtatttttagtggagacggggttgcactgtgttggccaggctggtcttgaactcatgacctcaggtcatccacccgcctcggactcccaaagtgctgggattacaagcgtgagccaccgcacccggccaaacttaaatttttaaaagaggaacagaagtcagccagaccaacaaaagagcgactggtgttccaagcataggaaacagaggaaacagaggccaaaacctcgggactgtggaggatgtagagggagagccggggctgcccctactctcagggagggggaaaggttgcaactttggaaactgtacaggcctatcaaaaatacaaaaatatccagcctgggtgacacggtgaaactccatctctacaaaaaatttaaaaaataaaaataataaaaattatctgggtgtgatggcacacacctgtagtcccagctactcgggaggctgaggattgcttgagcctgggagatagcaccactgcactcctgcttgggcaacagagtgagaccctgtctcgaaataaataaataaattttttaaaatgcatatgtatgggcccggcgcagtggctcatgcctgttatcccaacactttgggaggccgaggcaagtggatcacctgaggccagaagtttgagaccagcctggccaacatgacaaaaccctgtctctactaaaaatacaaaattagccaggcatggtggcagtgccttactaatcccagctacttgggaggccgaggcaggataatagcttgaacccaggaggcagaggttgcaatgagccaagattgtgccattgcactccagcctgggtgacgagcgaaactgtgtctcaaaaaaaaaaaaaaagtgtgtgtgtgtgtgtgtgtgtgtgtgtgtgtgtgtgtgtgtatgtatctctctccaggagttcaagaccagcctgggcagcatatggtggtgcatacctgtagtctcagctacttgaaaactgaggagggaggatcgattgagccctggaggtcaaggctgcagtgagctgtgattgcacccctgcactccagcctggacaacagagctagaccctatttcacaaaataaaatacagcaatttggtttttttgttttttgtgttttttttgagacagtctcgctccgtcacccaggatggagtacagtgtcgtgatctcggctcactgcatcctccgattcccaggttcaagcgattcttgtgcctcaccctccccagtagctaggattacaggcatgcaccaccatgccctgctaatttttgtatttttagtagagacagggtttcaccatgttggccaggctggtctcgaactcttgacctcaagtgatccacccaccttggcatcccaaagtgctgggattacagacatgagccaccacgccccaccagcagtttgttaaacataaaccatagctctgttttgcaacagtgtaaaatcagtaactgtctttcctgagtctctatttggtccttactgagttccttgggaatgttggacaggaatcatctgtgtctcaaggacagaggaaataattgcaccctagttcacaaagatacttcaagataactgtttaaatgagaatctcttcttcacttccaaggcaaagcgaagcaaaaacaaaaagcaacaatagcaaaacagcaatttgacaattatctgttttgttttgttttggtttgagacaggatctcattgtctagcccaagttagagcgcaatggcgcgatcacagctcgttgcagcctcgggctcctacagcttatgcaatcctctcacctcagcctcccaaacccacaccaccaagcccagctaattttttgtatttttggtaaatacgaggtctcactttgttgcccagactggtcttgaacccccggcccaagtgatcctcccaccttggcctcccaaagtgtgtctccccacctacactcccattctttcccttaaaaaaagtctgagtctgggtgcagtggctcacacctgtaatgccagagctttgggaggctgaggcaggaggataccttgaagccaggagtttgagaccagcccaggcaacacagccagactccgtctctacaaataacacttttaaaaaacttacccaggatacccaaaggactataaatcatgctgttttaaagacacatgcacacatatgtttattgcggcattattcacaatagcaaagacttggaaccaacccaaatgtccaacaatgatagactggattaagaaaatgtggcacatatatgccatggaatactatgcagccataaaaaatgatgagttcacatcctttgtagggacatggatgaaattggaaatcatcattctcagtaaactatcgcaagaacaaaaaaccaaacactgcatattctcactcataggtgggaattgaacaatgagaacacatggacacaggaaggggaacatcacactctggggactgttgtggggtggggggaggggggagggatagcattcggagatatacctaatgctagatgacgagttagtgggtgcagcgcaccagcatggcacatgtatacatatgtaactaacctgcacattgtgcacatgtaccctaaatcttaaagtataataataaataaaaaattaaaaaaaaaaacttacccaggcatggtggcacatgcctgtagttccaattatttggcagacagaggtgggagaatcacttgaacccaggagttggaggctgctgtgagctatgactgcaccacgacactctctggcctgggtgacaaagcaaaatctcatctcttaaaaaaaaaaaagggaaaaaaagcttgacatatataaaataatatgttaatgtaagttataagaacataatgggctgggcgcagcggctcccgcctgtaatcccagcactttgggaggccgaggcaggtggatcacgaggtcaggagatcgagaccatcctggctaacacggtgaaaccccgtctctactaaaaatacaaaaaaaaaaaaaattagccgggtgtggtggcgggcacctgtagtcccagctacttgggaagctgaggcaggagaatggcatgaacccaagaggtggagcttgcagtgagccgagatcgcaccactgcaccccagcctgggcaacagagtcagactccgtctcaaaaaaaaaaaaaaaaaaaagaacataatgaacacctgtgaacatatcacccaatttaagaagccgaacattaactaggacaattgacacttactgtgtgctgctctcagatcccaccttctacctgctttcctcccaaaaatagtcaccatcatgatttttaaaagtcattttagttttctttgcataattaccatatttatactcctaaacaatgcactatatttacttttatttgtctttgcattttataaagttatctccatgctgtattatactgctgtttgttttcaacattatgcttttttttttttttttttttgagacggagtctccctctgttgcccaggctggagcgcagtggcatgatctctcgccgtcctcccacctcggcctcccaaaatgctgagattataggcaagccaccgcgaccagcctgaatattcttgtatcgtttcctgatgtatgtgtacaagtgtttttctagggtggaactgttgggttggagggggcacaaaaagcttttaggaaaggagaaaggaacaaattggatatctacgattttttttttttttttttgagacagagtctctctctgttgcccaggctggagtacagtggcacaagctcagctcactgcaacctctgcctcccgggtttaagtgattctcctgcctcagcctcctgagtagctgggactacacatgcccgccaccacacctggctaatttttgtatttttagtagacatggggtttctccgtgttgcccaggctggtctcaaatgcctgacatcaggtgatctgcctgcctcgacctcctaaaatgctgggattacaggtgtgagccatcgtgtctggctattagttttcctatttagaaattgttcatctggatcctccctacctttcagccatttgcaatacatttgttgagcataaagagtgaccttcttggctgggcgtggtggctcacgcctgtaatcccagcacttttggaggccaacatgggtggatcacctgaggtcgggagttcgagaccagcctgaccaacatggaaaaaccctgtctctactaaaaatacaaaattagcctggcatggtggcacattcctgtaatcccagctactcgggaggctgaggcaggagaatcacttgaacctgggaggcagaggttgcagtgagccgacatcactgccattgcactccagcctaggcatcaaaactccctctcaaagaaaaagagcaactttctcaaagaaaaagagcaactttcttgtccacagcaaagaatcactggaagccatttgatgcaatatgacctcatctctctagccagtgtcgattgggttacaggagggcaccaagaagcttcgaaggctgtgccaatgtacacttccagcaatatcttcttaagcttgagtgcagctccttattttcccaaagcacagctaagactaaggctgccaagtttttaaaaagatttaaaggaaactctgagcattatacaagaaaaatactggccaggccctgtggctcatgcctgtaatccctgtactttgggaggctgaggcgggtggatcacttgagaccaggagttcaagaccagccgggccaacatggtgaaaccccatctctaccaaaaatacgaattagccaggtgtggtggcaggtacctgtaatcccagctactcgggaggctgaggctggagaatcgcttggacccgggaggcagaggttgcagtgagctgagatcgcaacactgcactccagcctgggcaacagagcaagactcggtctcaaaaaaaaaaaaaaaaaaaggagaaaaaggaagccttaaaactaaatgcataatttcctgttgtaattctttggccatgtccgttctttgtggagcctctattcagtcaaattgtcctgtgggccaactcatcttggcaggataaaagcctccttatccagtcttgccttccccagagaaaataaagggggtgggggagggccaaagaaaattaagaccctccccctccaaaaagagaaacaacaaaaagcatgcaaggattaacatgctatctgcaaagtcaccaccctgcccacagtgtggcctttcacttcactgagtaatatattgtttgtaatacaacaatgtaatcagcttcttcattccagaacaaaattttgctttactatcgtcatatacccagaagacccattaaactgtgttttcaaaagagcagcctttccttagagataaattttacagctacccctagagtagttctgttggccaaagcctcttagcttgctagtgaaagaaatgaagtcaagccagcttaagcagaaaggagaatttgttctgaggatacaaatatatagtaaggtaccaaaaaagaatttatcattggccaatttggataaggtgccctcctgtaaccctcctgtaatctaatcaacactggtagagagatgaggtgacagtataccaaatggcttttgatgaatctttgctgtgaactagaagggattaagttatgctcaactaatggtttgcaaatggctgaatggtagggaggatccacacgaacaatttctaaataacaaaaccaatagcatgtatctcatttgtcctttttcctttccaaagagtcaacaattaatgtatgagtcaattatctttataaaaactacattcattaacacaaatgcaagatctcaactatatatctttagttatatacatgtatacacatatatgtgtatgtatgcatacattatcctcaaagacaactaatttagagcgttcctcatcccagtatctcagagaaatacaaagcagtttcttagacttggcatcattgagattttgggccaaccagatacttctctgttgggtggggaggaggctgttctgtgcattgtgggatgttcagcagcatcccttgcctctacgcagtaggtgacagtagcattcccctcctccccactgtaacattcaaaaacatctccagatgttgccaaatgtccccggggtacaaaactcttccaattaagaaccactggtataaacaagtcagctgggagtggtggcacacacctgcggtcccagctatatgggagggtgaggcaggagaattgcttgagcccaggagtttgagaccagcctagccagaatctctgcctagcctaggcagacctctacagaaaaatacaagaattagccatagtgttggtgtgcacctgtagtcccggctactcaggaggctgagacgtgaggatcagttgagcccaggaggtcgagactgcagtgagctatgatctccccactgcatcccacaacagggaccctatctcaaataattaattaattaatggaagaaagaaagaaatcctagctttgtcatttactctattactttgggcaattgccttatgtttccagaacttcaattttcttatgtacaaaatgggaataactttttgagctattttagagctatcgtaaggatcagagcacataatcacaaaccacaaaatatgtcacagtgtacaggacagggcaggttctctgtaaatgacagtatttgcccatttatttttctgtaaatatgaaatatactaggatacttgatgtggttacaatcaggtggaaactgacctatgagggagacagacagaaaagcacggtcttttttgtttgtttgtttgtttgtttgttttttgagacggagtctcgctctttcgcccaggacggactgcagtggcatgatctcggctcactgcaagctccgcctcccgggttcatgccattctcgtgcctcagcctcctgagtagctgggactacaggcgcccgccaccgagcccagctaaattttttgtatttttagtagagacggggtttcaccatattagccaggatggtctcgatctcctcacctcgtgatccacctgtctaagcctcccgaagtgctgggattacagacgtgagccactgcgcccagtcaacagataggtacagtctttatctgttcgtgcggctataagaaagtaccagagactgggttatttataaaaaacggaaattttggccaggcacagtggctcacgcctttaatcccagcatgctgggaggccagggcaggtggatcgtgtgaccttaggagttcgagatcagcctgggcaacatgacgaaaccctatctgtacaacgctatgaaaaaaaaaaaaagctgggtgtggtggtgcatacctgtaatcccagctactcgggaggctgaggtgggagaatcacttgaacccaggaggcagaggttgcagtgagccgagatcgtgccactgcactccagcctaggtgacagagaccctgtctcatacaaacaaacaaaacccagaaatttctttctcacagttctggaggctaggaaggccaagattaagttaccagcaggttggtatctggtgagggcatggtggccatttccaatacggcaccttgctgctatgtcctcccggggggaccagtgctgtgtcttcaagtgacagagggatgtaagggcaatgaaagggcctagctcgttcccgccaacctttttatgaggttactaatcccatgccctcatgacttaatgatgccccacctcttaatactaccagactggtggttaagttttaacatatgaatcttggggaacacattcagaccacagcagatatattgtagaaaagaatagtccgtaaattccccagcagtaacacttcacatattttgcctcttattacttggagtatactgtgtttcatatggctttttaaactttgtaaaaactgcagcaagtgcctgattacttagggcttctttatctagtgacagactatttagtccattaattttgtgctgtacaacaggaaagagaaagaaaatgacttctgcagagactgaatcatctttatgtcctctatggtagttggcacttagtagatattaaataaaaaacaggctgggcaagatggctcatgcctgtaatcccagtaatttgggaggctgaagcaggtggatcacttgagctcaggagttcaagaccagcctgggcaacatggtaaaatcctatctctacaaaaactataaaaagtagcgggatgtggtggcatgtgcccatagacccagctacttggaaggctgaagtgggaggattgcttgagcccggggggtggaagttggactgagccaaggtccagctccagcctgggccacagagggagaccctgtctcaaaacaaacaaacaaacaaatctctttaactcccaaaatggaaagttctccaagatatatgttaagtgattaaaaaaaaaaaaaaaagggccagcctggcatgctggctcatgcctgtaatcccagcactttgggaggccaaggaaggcagatcacctgacatcaggagttcgagactagcctgaccaacatggggaaaccccgtctctactaaaaatacaaaattagccaggtgcggtggcacatgcctgtaatcccagctactcgggaggctgaggaggagaatcgcttgaacccaggaggcggaggctgtggtgaaccgagatagcaccactgcactccagcctaggcaacaagagcgaaactccatctcaaaaaaaaaaaaaaaaaaggaaaccgcatctctactaacaatacaaaaattagctgggcaaggagctaagtgattatagtaccagctactcaagaggctgatgcaggagaatcactaaaccgcatctctactaaaaatacaaaacttagccaggcaaggagcccggtgactatagtaccagctactcaagaggctgatgcaggagaaacacttgaacccgggaggcggagtttgcagtgagttgagattgcaccactgcattccaacctcggcaacagtgcgagaccctgtctcaaaagaaaaaaataatataaagtgaccaggtgtggtgactcacacctgttatcccaccactttgggtggaagcaggaggatcactggagcccaggagtttgaaaccagcctaggcaacatagtgagaccctgtctctatattaaacacacacacacatgcacacacacacacacacacacaaaggcagccagactatgcactaggaactgccctgggaatccctttgcattctcacaacaatcccatttcacagatgaagaaaccaaggcacagaaatattaagtaatgtgtccaggtgcggtggctcacgcctataatcccagtactttgggaggctgaggcaggcagatcacgaggtcaggagttcgagaccatcctggccaatatggtgaaaccctgtctctactaaaaatacaaaaattagctggatgtggtggcaggtgcctgtaattccagctactcaggaagctgaggcaggagaattgcttgaacccgggaggcggaggttgcagtgagccgagatcacaccactgcactccagcctgggtgacagagcaaaactccgtctgaaaaaaaaaaaaaaagaagaagaagaaatactaagtaacttgtctgaggccacttagttaccaagacgtgggagctgggacttgaacccaggcagtctgcagtctgactggattcatgcctgcagcctctgcactcctgctacttactgtgtgagaagcgcctgttctgtggaaggttgtgggctgagatctttccattagttccactcatttacccccaaggctgttcttaaagacaggcatgacagttatgcccattttacagatgcggccctgaggctcacaagggcacgccactcgcccatttccacaaagctatagctcgttagcggagggcagaattcggccgcctctcccctagctcgaaggctgtgattgacacagaggtttttttgttgttgttgctgttgtttgttcttttttctttttttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccctttttttttttttgagacagggtcttgctctgtcatcccggctggagtgcagtggtgcgatctcagctcactgcaaactctgcctccaagatgcaaatgattctcgtgcctcagcctcccaagtagctggaattacaggtgtgcactaccacgcccagctgttttttgtagagatggggttagtagagatttgtttaatagagatggggtttcaccatggtctctactaaaccctgtctctactaaaaatacaaaaattacccagacgtggtggcacatgcctgtagtcccagctactcaagaggctgaggcaggagaatcacttgaacctgggaggtggaggttgcagtgacccaaaatcatgcactctagcctggggtctcgcttttgcccaggttagagtgcagtggcacaatcacagtggctcactgcagcctcaaactcctgggctgaagggaatcctcccacctcagcctcccaagtagttaggactataggcatgtgccatcctggcgagttaattttttgtgtgtttttattctctcgagacagagtcttgctctgttgctcaggctggactgcaatggcgtgatcttggctcaccgcaacctccacctccggggttcaagcaattctcctacctcagcctcccgagtagctgggattacaggtgcgtgccaccatgcctggctaattttgtatgtttagtagagacagggtttcgccgtgttggtcaggctgctctcgaactcctgacctcgtgatccacctgcctcggcctctcaaagtgttgggattacaggcatgagccactgagcctggcctggtgagctaatttttaaatttgttatagagacaagagagacaagagtctctcttatgttgcccaggctggtctcgaccccctggcctcaagtgatcctcccacctcagcctcccaaagtgctgggattacagatgggtgtcaccgcacctggcctctgaggaggatttcattataaacctgccctgaagggagggaatccaattttacgagagggtgtagcctggtgaggcctggatgacctccggaggcaggggcttgtgcctgggctgaggcctaagggacaatgggcagacatgaagttgccccaggcagagggtacagtgtgggcaaagtcaggaagtggcagggcttggatcactccaggaagagagaggagtcatgtgtcacaggagctcgagacccagagagtgaggcaggcaggcagggaccaagcttgggcacagccaggaaggcaggacagggcatggtggggccaatggaatcattacccaagacgggcattttcagggaaacagcttagataaggccaggcgtacagtagctcccacctgtaatcccagcatttggggaggctgaggtaggactgcttgagcctgggagttcaagaccagcctaggcaacatagtgagaccccatatccacaaaaaatttaaaaaaggagtttgtgttcctgtagtagcatacttgggaagttgaggtggcagtatcacttgagcccgggagttcaaggctaaagtgagctgattgagccattgcaccccagcctgagcgacagagagatatgctgtctcaaaggaaatacaaactaaaaaaccagccggacatgctggcgtgtgcctgtagtctcagctacttgggacactgaagtgggaggatcgcttgagcccaggagttcaaggctgccgtgagctatgattgtgcctctgcagtccagcctgggcgactgcagactgcaggacttttttaaagaccctgtctcttaaaaaaaaaaaaatcttagataagaggatgctgtgcctccctgggggtcttcagtcacccatggtcctggcaagagaggagggccaggagagagcttcacccacctgctgtcctgcccatgtgacatccgcaggtgctgccatggccacgactgatgttacactcgagctgaggaggccggctgcagccccaagacagagcgctactcctggcagtgcgtcaatcagagcgtcctgtgcgatgagtccccagcagcaccatgccacccaccccgagtatcccctgggcaccctggcatagccagatgacttccgtgcccctgttgcaataaccactgcttccaagtctctgtagaccaccccttgggtatatctcatgtaagtgatatttattttatttattttttgagtcagagtctcactctgtcacccaggctagagtgtgctgacgtgatcttggctcactacaacctctgcctcctgggttcaagcgattctcatgcctcagcctcccaagtggctaggactacagacatgcaccatcacgcccagctaatttttgtatttttttcagtagaggtggggtttccccaagttggccgggctggtctcaaactccccacctcaagtgctctgcccgcctcggcctcccaaagtgctgggattacaggcatgagccatggtgtctggccctaatgtgagtgatctttaacactgagcacttgaaaaagaaaaccctgaagaaacctaattattcgatgtctggacgacaaggaagaagatagaaatggcatcagataataaacagtgtaaatgtttgtttatcagaaaggggctggtggtcgggacaagtaggaggatcgcttgagtccaggagtgcatctctacaaaaaagttaaaggattttttaacattggccaggcgtggtggcacatatctgtgatcccagctacttgggaggctgaggcaggaggattgcttgaagcccaggaggttgaggctgcagtgagctgtgatcgagccactgcactccagcctgggtgacacagcaaaatccagtctcaaaaaaaaaaataataatattttacataaccaaccacttctaaagattaaaaaaaaacccctatgattaaaaacctcaggtccctcaggcaatcataccagatatcgaaacaaagcaataacataaggactgcagtatttattttatttttatattatttatttattctttgttagtttttggagtgtgggttttgttttgttttttgaattttttattttgttctactcggttttattcttattgctcaggcttgagtgcactggcctcttctcagctcaacctccgcctcttgggttcgggtaatgatggttccacgtcagcggccctccgcctcttgggtttgcgtgacggttccacgtcaccgaccctccgcctcttgggttcgggtgatgatggttccacgtcagcggccctccgcctcttgggtttgcgtgacggttccacatcaccgaccctccgcctcttgggttcgggtgatgatggttccacgtcagcggccctccgcctcttgggtttgcgtgacggttccacgtcaccgaccctccgcctcttgggttcgggaggtggttccatctcagccgccctctgcctcttgggtttgcgtggtttttctgcctcagcctcctgagtagctaagggaggtgtcttgagattatcatcggctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctccccgcagacgctcggcaggtgtcttgatattatcatctgctgagggtggagctgagtgtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatcggctgatggtggaagcggaatccgcagacgctcagcaggtatcttgatattatcatctgctgagggtggagctgagggtggaaggggagtgagctgacgctcggaaggtgtcttgagattatcatccgctgagggtggaaggcaggtgtcttgatgttatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctcagcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaaggggatggagcagacactcggcacgtgtcttgagattatcatccgctgagggtggagctgagggtagagctgagggtggaaggggagtgagcagacactcgggaggtgtcttgagtttatcatccgctgagggtggaaggggagtgaggagacactcaggaggtgtcttgagattatcatccgctgagggtggaaggggagtgagcacacactcgggaggtgtcttgagattatcatccgctgagggtggaaggggagtgagcacacactcgggaggtgtcttgagattatcatccgctgagggtggaaggggagtgagcagacactcgggaggtgtcttgaggctcagggagttatcagttatagaatgttgttgagttggaggaggtggctggtggcccatcctgttttttaaagtttcagctgtgaggtagggccagtagggcaatcctgaagaatgacgatgctccgctgccgccattctgacctgtagggccaaaggagggaatgttttcacacatattcatttgatggacaaaattaccgccaccaacacagtctgcaccttctgttgctggtgatagatttttgcacctttccatcctccaggtttcaaaatagaagtatcagtgtcataatatcacccttccactgagtactgccaacagctggagggtaaaggaaagtcattgggacacactgttgtctccacatgccactgtgtctgtctgcaaatgtaggcaggctggggtcctgccccagggaagacagagtcataacagagtaataaagaagcatgtttgagacacaggagtgtctatgtctatcctcattcctccctcacagccatcaccagagcatgtttcttgcaccaggtcaacagacagtaagagacagtaagagaggcatgaaaagcccactgtccacacatgttgcagcttctttttggagaatgttttccaggccttttatgttctgtctctgattctcagaactctgcaaggtcagtgtgaccaccctgctccaaatctaagaaaacagaggtttccagaggaaggagaaattgtgcccagggtcacacagcttgcaagaggcagagtggaagttgattccagctctgcctgcaggaccctctcatttcccctctgtttcccttcttgacaaaggatcttcttcactctggaggtgccacccatgagaacaaagagctctggagagatgtggattcctgaagagctgcaggggaactgggagagggttttctgacagaacaatctcacctcaagaagtcacttaggcatggctgtaatatttcttttcactcccaggtaataccaaattgtaagtgcactaggacataaagaatacttttgtccatggaaaaatgaggtgggaattctaaacaaagcaagttttaaaactgtgtttcacttcaagtgtacaagtcccatcacgtgtaatcataggactcggcagcttttgaaggtacagaggccacacaagaaccagcttagctgagcatcatttaaggccttcatttggaattgtccctgtgggtaataagttacattcactcttcactagtttacagtcagggcccatctgctattacaaatacggaacctctgacacttagaatattagatcaggggccccactgggtggggatgaaggtgtttttgcgcaacacggttaccaacagggatgggactgtgatgcttgtaggcagcctttctctctgccatctccctctgcagggcttgagcacagagctgtagggagaaaaatgtatccatgtcctgacctggcagactatgtccaaaagcaaggaaaacaagcaaacttacccagttgcaaagagcctttcttgcagaaggggggatctgaaaaagccaacacatgagaaattgaatgttgagagagtctaagggccgtggcatcatctgcatcagcactgaactatcctgcaactgcagggaggaagctccttactttgcatttgtggtagtcctctgctcgccgccgcaactcttgcgcacgttgaaacattttcctatggattacaatcactttcatcagataaagcaccactttcaggatgattttaaataatctgccatgtttctgttatcctcacaactgtacccttacacaatctatctctacctagaaaacgtatttcagatggctagaagagtacagtctgagccggtcacggtggctgacgcctgtaatcccagcactctgggagggcggggcggatggatcacgaggtcaggagattgagaccattgtggctaatatggtgaaaccccttctctactaaaaatacaaaaaattagccaggcgtggtggcaggcacctgtaatcccagctactcgggaggctgaggcaggggaatcacttgaacctgggaggcggaggttgcagtgagccaagatcacgtcattgcactccagcctgggtgacacagcgagactccatctcagaaaaacaaaaacaaaaacaaaaaaactgtacagtctgatccaaactgttgctgtattgattcctcctcttgcttactgcctgctgacttctgagatgatagtttccttccccattctcagtacatccctaattcatccttcattgagcatcttttatcataaagctgtattctctttgtattaatatccttaccgtgtttcacagggcagaaacagctgggcttataaacaggcatagtccttttgaaggatgtggttgatcctacaacaacacactttcctaaggatgacaacaactcaccccacccctagaatggctggtatgaaccgagtttccacacagtctagctggcaatggggtcaggagacgttttgctacttcacatcttttggtcactggtaaatattaaggtactttgttttctgttttgtgaactctctctcgctctctctcacgatatgtcttctgaccgtttgtttctatttctgcatttactgggtctaaatactgtacaaaggttaaaaacaacactccaatgggcgtttcccaagagggtggggtacagtttctgaactcacttgtaggtgtgtatttctttcatatccaatttcccattttcctctgcctctgatacctgcctctccttttctgcatgctcacattctttcacgcttagtttcctcagattagaagggagagaaatgcacacacatgatccaccagcccgtgtgggattccctctgcccttctggcatctgaaggctgtgattcaaagattcccccctgcaaccttcccacaaatgaaccaactgattctcacaaccgaagggagaattgacacctcccattgagggacaaaaaaaagtcacactctggcctgctggcaagtcacctgtcatttccagctcatcttcatagttccatagttagtcctattctttagtaaatataaagactattaaaagcttctatgaggtgcactatgtgtgtctctggggtcagtcttgtgcttgacacagcgaaagctcattttagttcagtgtgaaaaaccagacctcaccaattcatcacaactaactccatcggaagcagaggattgctcctcatctgactcctcctgtgtgagacctgattctcagtcagaggctgatgccggaactgagaccatcagccatagagagatccttccagaataaccccgcagttcactactgcactttgccatgattcaggactggaactcttgtcatcaactttaaagatcctggttgagagaaaaggcaatctgaatgctgggcgcatctattgaattagaaatgatcggaatggctcctaagtcagggtgttatgtcctgaaaataggtgacaacggcaaaccatccaccctggtgttgactgactttaacaaggttcagttcacagagattgagggcagaaaaaggaaacggcctaaaaagggtaagtttgctgtgttgccctcacaccacttgattcatggtcctgatcctaaggatctcacctgatacttggctttataggaaggatgtgtaaaattcccagaacgctaggaaacaggggcgaaaacacttcaaagagaaagttaatgaacttgtttctgaccacaaggcatccttcagcacatgctgtctggagtggcctcaaacaaggagtgtgtggtgtggtgctgagaatgcaatgggagcagggtcctgtccccacgctaaagaagctcacagcttaatgcaaatgagaagccagtgaggacatcactactcctgctgtgcacttgggaactagaaacacaaaacctgactctggagggaagctaaggaagcattctactcttgagttgacataagtgcatctgaagcttctgatctccaatgagaacaatgggggacaccaaacagaatataaaacccatgattgaatacatcaaattgctaacatggcagtaaacagacatgaggtgaagatggagaagaaggaaacccaggacgaaagtcagcctcgcatttggaacccatttccctgagtttcattgctgaattccagaaggaactactgagatgcaaagaagcacagcagcttttgcacacatgcgtgggattagatggaaaacaagtggattgagggtctgccaatgaaagcgacccatactgaagtccgctggctctggttgagacccagaagagtcatgcatcagaataaaggtggacaggaaataccctggcctttgtagggactgagcctgcaccgacgacttcaattgcagcttgtatggaggacccctgaccatcccccagaagtagactcccatctcttctgcagcaagataacatgctactaggcctcaattcattgctaaacattttttaacaagtatctcacatttaacaaaaaaagatcagtcatatggcagcaaaatacaatgtcatatgaccaaaacatgaaagactgtgaaaatgaatctggaggtgacccaagcattgaattcaacaatccaggctgggtgcggtggctcacactgggaggctgaggtaggcagatcacctgaggtcaggagttcaagactagcctggccaacatggtgaacccctgtctctactaaaaatacaaaaattgggccgggcacggtggctcacgcctgtaatcccagcacattgggaggccgaggtgtgcggatcatgtcaggagttctagaccagcttggccaatatggtgaaaccccgcctctactaaaaatacaaaaattatccgggcatggtggcatatgcctgtagtcccagctactcaagaggctgagggataagaatcgcttgaacctgggaggtggaggttgcagtgagccaagatcatgccactgcactctagcctgggtgacagagtgagactctgtctcaaaaaaaaaaaaaaaaaaaaaaattggtcaaatgtggtggcacacacctgtaatccaagctactcgggaagctgaggcagaattgcttcaaactgggaggcagaggttgcagtgagccaagattgcaccatagcactccagcctgggcgacagagcgagactctatcgcaaaattaaaaaaaaaaaaaaaaaaaaaaaaggctggctgtggtggctcacgcctctaatcccagcactttgggaggctgaggcaggtggattacctgaggtcagaagttcgagaccagcctggacaacatggtgaaaccccatctctagtaaaaatacaaaaattagctgggcgtggtggtgggcacctgtaatcccagctacttgggaggctgaggcaggagaattgcttgaacccaaaaggcagtgagctgagattgtgccattgcactacagcctgggcaacaacagcaaagctccatctcaggaaaaaaaaaaaaaaaaaaagagaaaggaaaaccaatgccagtactagcaactcctcttcctccgaaaaaatgaaaacaagaatgtaggaagggaaaggaattatacagcttaaactaatgaagcagaaaggacaaactcaattttgaacccactgaatttgccacaaatattgtagaaaatattctcaaggactttacagttgtctactttgattggcacatggttcatacaacagtatttgtgtcaaggcacatcttactgttttctggcggtcttcctctttccattgattttgtcatgatggttgattttcgttgtcaccttcctcttacggattttagctctaacttttgtttccacatgtctccgtagagtaatgacgtctttcaggacaattttatttcctcgaaaggaagaaactcttttctttgtgtgcatacaaatggacctcagcccttggtgagagtgaggagaagagaaggtgagaaacctgagggcaagaagctgttctttccctttccagggcaaactcatttccacactatgcggattccaacagagccataccttcctgtctacggcggttggacctccaggctctctgctgtacatccgtggatccatcatgtccatttcgagaccagaagatagtcttcaggagagacacctaggaaataataatataagaatgacggctgggcacggtggctcatgcgtataatcccagtacttcgggaggccgaggcaggtggatcacggggtcaggagttcaagaccagcctggccaagatggtgaaaccccgtctctactaaaaatacaaaaattagccgggcatggcagcgggcgcctgtaatccaagctactcgggaggctgaggcagagaaccgtttgaagctgggaggcggaggttgcagtgagccgagatcacaccactgcactccagcctgagcgacagaatgagactctgtcacatacacacacacacacacaagaatgacatgaggctggcacggtggctcactcctgtaatcccagcactttgggaggccgaggcaggcggatcacctgaggtcgggagtttgagaccagcctcaccaacatggagaaacgctgtctctgctaaaaatacaaaattagccaggcatggtggtgcatgcctgtaatcccagctagtcgggaggctgaggcaggagaatcacttgaacccagcaggaaaagcttgtggtgagctgagattgtgccattgcactccaacctgggcaacaaaattgaaactctgtctcaaaaaaaaaaaaaaaaaaaaaaaaaaaaaaataggccagatgcggtagctcacgcctgtaatcccagcactttgggaggccgaggcgggtgaatcacaaggtcaagagatggagaccatcctgggcaacatggtgaaaccccgtctctactaaaaatacaaaaattagctgagcatggtgatgcacgcctgtagtcccagctactcgggaggctgaggcaggagaactgcttgaacccaggaggcagaggttgcagtgagccaagatcccaccactgcactccagcctggtgacagagtgagacttcgtctcaaaaaaaaaaaaaaaaaaaaaaatgacatgaatatacttcacacaactgaactgtacacttcaacacggttagatggtaattatcatcttataagtattttaccacaggttaacatgtttcacaacttgaaaaggaagtaattaccttcagctctctgagttctagaatttgtaacatttcatcccctgctccttcctgatctgcactggagcatcttccttctgtccctgctctactcagagttcactttcccttccctcacatcagcttcattgaggctggtttgaacttaacgcaaaacattctcactaatgactgaattcccaccaagatttccatattatcacagtatgcttttaatcttctaagatattaaatatttcttctcatcatagctaaaatgcaatgcaaatcccatctcagatgtgggtcagatacctatgaatctcctgaggtggtcattgaaatgacttttttcttgagacagagtgtcactctcaaccgtgctgaagtgcagtggcgctaccttggctcacggcaacctccacctcccagattcaagcgattcttgtgcctcagcctcccaagtagctgggattacaggtgcctgctaccatgcctggctaatttttgtctttttagtagagatggggtgtcaccatgttggcccatctggtcttgaactcctgacctcaaatgatccatctgcttcagcctcccaaagtgctgggattacaggcatgagccaccacacctggcctgaaataatatctttcaaattctttgtagaatttgttttttcctgatttctgcacataggataaaaaaaaaatcatgtactaggatttcgagagaagcaatgggtaatctaaaaagatgaaaagagcaaccacgtcaatcccacagctactgctagatttcataggaaaggtagctggcccagtttggagctaggggaaatgtcaaacacatgaagaaatgagaagccaagaaatgccatcacgcatgaatgcttcatggcacccatgatgtccctgctaaggaggtaatggtatagatgactagatgacaaggacaaagatgagaggtgcgaagttgtccaagtccaacagctcaactgaactttcctaagtggaattgttaaaaagtggtaaatttaaaaacttcccctggctcacgtggtggctcacgcttgtaatcccagcactttgggaggctgaggttggtggatcatttgaggtcgggttttgagactagcctggccaacatggtaaaaccccgactctactaaaaatacaaaaattagctgggcatggtggtgggcacctgcaatcccagctacttgagaggctgaggcaggggaatcacttgaagccaggaggtggaggttgcagtgagccgaggtcacaccattatactccagcctgggcaacagaaggagactcgtcttcggggtgagaaaagaaaaaaaaaaaagaaaaaagcttcctccaatttataccgaaaattctctgttcaggactaagtggcatagagaatgttaaatgtgcctagatatcttcataactcatatattttctgttttctacatatcttgaaaggcagtgccaaatgacgtgtaattatctaggtggtaaaactgaaacatacttcctcttcccttgaatataaaaaagcattgtggtattagtacttttatcttggatcattgttcagaaggaggttcagcccccagacaaccacatttttactgtcatgaatggcaagacaaaatgtagagctcaacttacccaaaggaaaaaaggctcaaaagacaaattatggcacaacttagcagccaaattcttaccaagtacagacttttgacatactgatctctctccagttccaagtcggaacatgcactttgaatgatgtcattcaaaattaccctgcccagacacacttttcattgattctcttggagggcagttctaagagtctctggggctttctctgcatcatgagacgcagtgcagttctgcccttcaccttccggcagtttgtcacctcgtccctatgacctcacaggaactttgtctcaggccaattgtttgttccttggcctctttcatttcccctaaaaatcatttgctgcccctctaaatggcctacatctccatctatctccctctcccctcagaagagggtgctctttaagcatcagccatccggcccttctagcagtctcatttttcagctggttcccatgtttatgcctgttctatgtttttcttttcctgttaagctgtctgttgtcagctcatttctgcagtgaatcttcagagaggagattggaagctttccttccacccatacgatagaactataaagcagaagagtttagaaagaatttcctatttaagtgacgaaacctcatactccatttgtgataaatagcacaaaggttaaaaaaacttatttttgaccaaaagctctgttgacattctattaaacaaacaccgacctatttaattttcataatgcaaatggcagatgttttcataattcttatactaataaatcatttccctgattttttgggtaaaaccacatattcataatgaagtccagaaatgtgaattgttttatataatttattcttatttgtgattacaagtatacctctacagaaagttagtatactcacccaaaggtaaactatccagagggtaatgacaactttataacttgtcggaaatgcaataatgacatgtaaccaaggacttccaccaaagtcagtcccacgatgatgatggtcagccagagtattgataacctggaataataatagttgaaataatgaaaaggtcaatgacactgacaatatttcactcagaaagaatcatccttagaaaccgtcaacctcctccaaaaggtaaccacatccctcagatatcaccgtgggattccactgctacaaaaaagaacagaagttagaagtcacatgtttttcagatggctggtagtgttttcaggcattgcaaatgtggggtgttgtctttcttggtataaagcagggatatccaatcttttgacttccctgcctatattaaaagaagcaaagttgtcttgagccacacataacatacactaacactaacaatagctgatgatctaaaaaaaacctcttttttttttttgagacagagttccgctccactcagtcgcccaggctggagtgcagtggtgcaatctcggctcactgcaacctccagctcctgggctcaagccattctcctgcctcagcctcccgagtagctgagattacaggtctctgccaccatgcccgactcatttttgtatttttagtagagatgaggtttcaccatgttggccagtctggccttgaactcctgacaggcgatctgcctgcctcggcctcccaaagtgctgggattacaggtgtgagccaccgtgcccagccatttttttgtttttgtttttgtttgttgtttttgagatggggtctcactctgtcacccaggctggagtgcagtggtgtgctcccggctcactgcaacctctgcctctcaggttcaagtgattctcctgcctcagcctcctgagtagctgggagtacaggtgcctgacagtgcactcagcaaatttttgtattttttgtggagatggggttttgccatgttggtcagggtggtctcgaactcctgacctcaggtaatctgcccgcctcagcctcccaaagtgctgggattacacgcatgagccactgtacctggccaaaatctcctaatgttttaagaaagtttacaaatttgtgttgaactgcattcaaaactgtcctgggccacatgcagcccgtcactcatgggtaagacaagctaagtataaagtaattatcttatcttttcttttctttttgttttgagacaaagttttgctctgtcacccaggctagattgcagtggcatgatctcaactcactgcaacctccgcctcccgggttcaagcgattctcctgcctcagctactgagtaactgggattacaggcgcctgccaccacgctcggctaatttttgtatttttagtagaaacagggtttcaccatcttggccaggctggtctccaactcctgacctcatgatccacctgccttggcctcccaaagtgctgggaatacaggtgtgagccactgcacctggccagtagttatcttttctttaaagttatttacttgttttttaaattgatgtataacattggatgcatttattatatatcacatggtaaaagaatccctctaaataatacttctctcttggattatatgaatctttgtcatttaaatctcagcataagtaaaaaaaaaaaaaaatacaatgaagagattacttcattcacaaataagtatcaaattttagtgcttaaaaattaacaaggtgggctgggcgtggtggctcacgcctgcaatcccagcactttgggaagccgaggtgggtggaccacgagatcaggagattgagaccatcctagctaacacggtgaaacccgtctctactaaaaatacaaaaaattagcagggcatggtggcacatgcctatagttccagctacttgggaggctgaggcagaagaatcacttgaacccgggaggcagaggttgcagtgagccgagatcgcaccactgcacttcagcctgggtgacagagcgagactctgtctcaaaaaaaaaaaaaaaaaaaaaaaaaaaaaaaaaaaaaaaaaaaaaaattatcaaggtggagatcatgaaaatggcatgaatagtgtgggatttctctaagattgttgatattaattccattagactcttatgtgagtgaagacgaagacttcccctgagtaagttcagacagcttgtgataacatttctacgtcgattcctcaggatttaactatatattcttgaaaacatctcaattttaaatgtttctttcaagatggtgaattaaacagagatagcccttcaacaggttgaactcagcatatgctgagtctgaaatggaaatgatgaagttagagaaccatacaacaatggtaatgatttcagaaacatggtgttgagcagaacaaagcagacacaaaagagtacctatggcatggcatgcatctgtatacgcgaaattccagaataagcaagctaacctatgataagaaagagactggctgggaagactgagagttcactttctggggtgacataatagtgtagatcttggctgggcatggtggttcacgcctgtaatcccaacgctttgggaggccgaggcgggcggatcacctgaggtcgggagttcaaaaccagcctgaccaacatggagaaaccctatctctactaaaaatacaaaattagctgggagtggtgccacatgtctgtaatcccagccactcgggaggctgaggcaggagaatcgctcgaacctgggaagcagaggttgcggtgagctgatattgccccattgcactccagcctgggcaacaagggagaaactgtctcaaaataaataaataaataaataaaataatgtagatcttgaaagggggttggtttatgctggtgtatgtactttccaaagttagtaaacttacacttaaggttatatattttggccaggcgcggtggctcacgcctgtaatcccagcactgggaggctgaggcaggcagatcacgaggtcaagagatggagactatcctggcgaacatggtgaaaccccatctctactaaaaacacaaaaattagccaggcgtggtggtctactaaaaatacaaaaattagccaggcgttgtaatctgagctactcaggaggctgaggcaggacaattgcttgaaccccagaagcggaggttgcagtgagccgagatcttgccactgcactccagcctgggcgacagagtgagactctgtctaaaaaaaaaaaaaaaaaaaaaaaagtcatcaaaccagatgacacaaatcaaatgacatttcactttgttttggtccattttctttgttaaaaacaagagtgcagcggggccatctcggctcactgcaacgtccagctcctgggcccaagcgatcctcccacctcagcctctccagtaactgggataacaggtacgcaccaccaggcccgactaatctttattggaattttttgtagagatggggtttcgctatgatgccctggctagtcttcaactcctggactcaagtgatctgcccacctcggccccctaaagtgctgggattacaggcctgagctgtgtaatttcatgccacgtgatacagcccagtaaaaaggaagaaaccccacgggtccagcgtctactcacagagatgcactgatggctgataaattccagtaggagcccaaagaggagccaaaagagcatccaccgcacccgcatgtcctggtcctttcagggcgccctgaggcggccaggacagaggtggaggtggcttagggcaggggggagggaaggggacggggaccggggccggatctgagttggggaggggagggggaggggagggggaggggagggggaggggaaggggaggggaaggggggaagtaagggaagggaaaggaggagaagggggctgttgggcacctggaggaggtggaggaggaggaggagaagaagaaaggggtctgggaaaggatccggttcaaattaagttctcaagcgctggtggaaggtttagctacaggtcacggagaagatcagggaagcaacaggacacgcggggcaagggagcgtgaggcttaggagcaatcagagggagacaaaaaggttctgctatccaccaaaccttcttcggtctgggccctcccttaccaaccctggggctttatactccctctccaccaatccctgatgaccccggtggtgcctcacaatggacagtgcctcacaatggacaatgccaagtagcgcccgcatcattccaatgacccctcccccatctcagtctcccacactcctcccaaagacaggtcctctctggaaccttcacaaacctgatttctggtcctccccaaccagctccctgtccctgcttctgggcgctccttccttcctgagctcccagggttcctcaaggtcacttatggcgacaaaacataaaaaacaaatgatggcaggatggcaggaagaacctcatacccaagcagagtgccaggttttacagcctccgctcagccattcatatcctaagcaacaaaacatcagcagggtgcggaaggtcccgatagtaaaccatctccatcacatccatgtagccatccgtccatcaacctgtatctcgggaacaaatgtagatacattcattttaagcatgcctggtacatttacaaaaattaacctgacttattttgttccagcaaatctcaatatatttgagagcaatcaaatcacacagcatgtttctgatcatataactgtgctagaagtcaatgattaaaagctaattcaaaattattatttgcttggaaattcaaagtgcccttataagacataaacataagaaagaatccaaaatgaaacaagattgcctttcaactcaatgatgagatcataacatggcaataaaatgtctccctctggcctgggaattcctctttgtggcacaaggttgtgtgatctcaaatcaccgctaacccacctagacattttaacatccgaaaccgagtgatgacgtccttatctatatcatcttactgcctgtgtgtgtggactttaaattctgaacccaaatgagggggagaaaaccaagttgactttcatgactgagctctcagggacgtccaaggaatctgtgcatttcaagaaacaaagttcatcagcttctctcctaaggtatttgcccacaatacccagagggcttggcagcatcatgtgtgatgggtggggagctccaagcaggtgggcaggacccaggggcctggtgaccaggacagacccccactgtccatcacctttcctggccctgtcctctgctaaacttcccacaggccttctgcccgatcacacagagtatgcccaaactctctcaggcctctggcagctgaaaaccactgctttaaatccctttaccatttactatgacataaggttattgtaaacaggaaatattctattgatgctacaaatggaaagccaatgcctttaccataaatagaaaaacaaccctaagaagcaagcaaaacaaaaacaaaacaggggctgggtgtggtggctcacgcctgtaatcccagcactttgggaggccgaggtgggcggatcacaaggtcaggagttccagaccagcctggccaatatggtgaaaccctgtctctaataaaatacaaaaattagccgggtgtggtggtgggcgcctgtagtcccacctacttgggaggctgaggcaggagaatagtttgaacccgggaggcagagtctgcagtgagccgagattgcaccactgcactccagcctaggcgacagagcgagactctgtctcaaaaacagcaacaactacaaacaaacaaaaaacagggttaacaaaagtatggaattcaattctttttatatgctgcagccatgttcctgccctagatttggctgggcatggtggctcacgcctgtaatcccagcactttgggaggctgaggcaggcggatcacgaggttaggagttcgagaccagcctgaccaacatggtgaaaccccgtctctactaaaaatacaaaaattagccaggcatggtggcacacgcctgtaatcccagctactcaggaggctgaggcaggacaatcccttggacccgggaggcggaggttgcagtgagccgagatcgtaccattgcactccagcctgggtgacagaatggaatgagactctgtctcaaaaaaaaaaaaaaaaaaaagcagccctagatttcggttgtggtggttgtaaaaggagagaccaagtaagtgggggttgaagtcagattagagcaaaagtgaatggcagagagtactataatgtccatgaagggctgctagagtcaccgtgatcatagcccaagcagagatagggaaaggaagatgtgagcagagtttggggtctcgaacaatggaggttattcgtgcagcccaggaaaggctccccaaagccaggatcaacctcccttggaggcggtccctcatggaggcatggtcaggcaccttagatttgagaccagctatgttgctgctgaccagctgtgtgaccctgggctggtttccttccacacaatgggagtgccaatggctgcatgcatgcaaagaccgtctgaggataggaggaagcaatctgttgagcacccgtgtacctgagtgtcatcacctcccaagggcatccttcgttccagagctggcaccttggaaggcccttggtcactgaaggcagtgatgatggtaacagcagtaaatcatcatttacggctgatgagggaaggccaggggtagggctcctaggtcctggataagaatgagggtctgggcactcctggggacagctgagtggtaggactcctgggtccccagggggcaggtccatcttcagtggcattgggcctaggctgggatgctgagttatccactggagcatcagcagtacaggcaggcacagaggcagtggatccatcggaggtggcaggtgtaggatcgtctggtgagcaagtagagtcaccaaatctggctgaccactacccccactacccccactatccccacagacgatgccctgtcccttgcctcatgctccggcagggtacaggctcgcacctggggcctcaaggagcatctctctaagacctctgtgtcctggtcattgaatgggcacttgagtcacccagggccattggaacaaagaggaagaatcaggccccacgatgttttgggagagtgtttagcacaggaaaatgcgcagaatacacgcacgacacgggggcactgtcagtgtgggagcaatggtttacaacctccagccctaatctgagcactctcacctgtgcaatctgaaaggaacaggagacttgcaggaaagacagtgcctggatttaacttaaaggaactaaaaatgttggaatttttactcttgatatccttccaaatcaactctctcaatgttcccatcctcaaaactatcatatggggtaactgaggcagtcagagatttactgactcaatgtcactcaattgattctgagttcactgctgattacatccgaccaaactgctttttctgaagtctactccgtttaatcatgctggtgatgattttgtgcggctctgggacaaactccacctggctgaagataaagcaaatctgcggtgacttagtcctcctgtcatttcccatcagttccccactctcctcctctgcccctccacagtctcccatgcaggctgacaccatatgacggccttaatggagtccaccgagtatttcaggttctctcctgggccacttgaaagtggatgtacccatgggatttgctttgacccaggagatgtgcgtggaagtgaagcgtgtcacctcgaggcaaaagagttgggagccattgagacgggccactctctccttcatctcttagagcagctgacagctcccatatggaggctgctcctttattctcgtggcaggatgagggcatgtggggcacagggcacaggagagccatggaggatgtgcagcatgggcaggaaaagagccttcagtggtgtacatttccatagtttggggctgtttcttacctacagtgatacctagcccatcctagcaggcatgcaccatctactccacactctgtgatgcagactagcctgccgtcagaacacgaactggtggtcagacacaggtaggtttcagttccagctctgcctcttattgactgcaacctcaggcttaactttcagtctctgagcctcagtttcaactctgtaaaatgaggtggctataccatctcaggttgcagagagaattaaatgaaatataagtgcatgtagagcattgaacccagggcctggcacacacagtgagtacacaatgttagccaggtagcttcataatgcatactgattgtcaatattcagacaatgcagtaaagtgttaccaaaaataaaagtaaacttatttgcatatgtattctttcaatctttatttttaaacagggtaaaactatgcatattctttcatagccagtgtttttctcttcatagtatattgttaaaataattttacttggaccgggtgcagcggctcacacctatagtcccagcactttgggaggccgcggtgggcagatcacgaggtcaggagttgacacgagcctggccaatatggtgaaaccccatctctactaagaatacaaaaattagctgggcatggtggcacacacctgtagtcccagctactcagaggctgaggcagaggaattgcttgaacccgggagacagaggttgcagtgagccaagattgtgccattgcactccagcctgggggacagagtgaaactctgtctcaaaaaatatgtgtgtgtgtgtgtgtgtgtgtgtgtgtgtgtgtgtgtgtgtgtgtgtgtgtgtgtgtatctatataaatctcaaaaataaaagatcatttttgagattatcattttaaaagacaagataatgttcaacttaatgactaatttaattattactattggactttttgtagactgcacagagcattcaaaacaaatgaaggagaataaaaaatatgtattacatgttataaaataaatgtgatgtggttaactcttttattcaaagttatagaacatacatatgtactatagaatgtattattatgagtcatgttaaaaagtagtttagaagctgttgatttgaatttccttttcaaattttgcaggataattttttttttttttttttgacagagtctcgctctgtcgcacagtctggagtgcaatggcgtgatctcggcccactaaaacccccacctcctgaatctaagcaattctcctgtctcagcctcctgagtagctgggactacaggctcacaccaccatgcccggctaatttttgtatttttagtagggacgaggttttgccatattggtcaggctggtctcaaagtcctggcctccggtgatccaccagcctcagcctcccaaaatgctgggattagaggcatgagtcaccatgcccagcctaaacttggcaagataataaatcacctttttaagtgtcgttgggcacttgtctggttgtttttctttaggttaccatgccagcaatgattccttttgagtttctgacagaagatagtggttttcatccaaataagtcaactactctaccccatccctaagccacttgtatggaaagaaaaagaggaagaagccagtactgtgactgcgtaagcttcccccagcatcaccggctatgagatgtgtggcagctgagacccgggaactgctcaagggcaccaggccccatctgtctgcactcactcaccttcctcaggtactcgcatgggcatgtcactgactttacatgctgctgcagctccttggtgagctggccctggtcatgggacaggaactgtggggtcaggacaatagagagcttcaccatttgcagaatgagaacaggggctcatgatgagtgccaacctattagataatttaaaaaaaaaagtgttgaatgagtggaaaaacaaggtgatgtttgagtctatagtggtcaagggcttcagaaaaggacagaaccaagttcaaattcctgtactttgaatttctacttcatgccatgcaaaattactttaccccttttaacctcagttttcttctgtgtgaaacaggaacaatagtttcattcgtcattcagtttctctcaagatttcacgagatcatacctataaaacatccaagtcatttaaatgtatcatcatttctgtcataattagtgggatccatttcactattattggatatacagttctgtgcctgaaacctacaaaaaaacaaaatgttaagtctaaaaagcattagtgatttctcatttttatattactaattataaccctatttaatcacacaaggccttgtccgcggcaggtgctcaataaacacttgtcgaatcaatgcatgtgggctccggagccacactgtttagattctattctgcctccaccacttatcagctgtgtgatctgggtaagataattcacctctttatgtctgcacttccctctccataaactatatataatgagaatccttagctcattcggttgtggtgaggggtgaatgatttggcacacaggaggggcttgttaaacattagctgtgatgatctccttccaaatcttcattttcagagccacagatgaggccatagtgcaaccaggtgaccttagagtgtaagtacacatgatcgccagctatgctctatctccaccataggtccaagactgggtagttctggcctggaggtttctgctgcatctgccttctcagtgttcacctaaggacttttgtattttcctcctcgcatccccacagatggggttcaggctgccggacacagctgggtgatgccagggcagtggtcacctgtgccagccccgtgaggtagctggaggatcattgttccttccttctcgggctctgggcagatgccagggctggggtgacccatgccctcaagtttcttgctttggtgggccacattttcccttggcaaagagggtaaaggtcacaggatgccggagagctgtgacttctctgtgccctgggcccaaactatgaagacctgacacactatgctaaaagtccaacgctgggtgctccccagagcttcttgcctcaccgcttctgctgagggaggaatgaatactatgtcctcccagagctttgggagcttgtagcaagcagcctccccagcgcaaaatctcttggaaacctctaactgtgtctgaaacattagtgcaaatgttgcatcctatttcccatatgtccgcatgttttagaaaaaaaccctcaatttcctaaatatgcaagaaaaatcggtattgtaggacaatgtgactttttaaagaatgttatttaaaaatcttccccacctccttttctgccctccaagactgccaaatacttgttgaacatatattattaaatgcctactacatgccagccatgattcatggtcttggggacacagcagagaacgaactgacaggactcctctcttatgtaactcacattcttatatgataatgataagggttaacattaattaagctgtcactgcatgttagtcacggtgcagtcattcccacacattattacacttaaacctgctagcaagcttgcaaggtagttagttgtttttcctttaaaaactgagtctcggaatgatgaagcactctgtccaatgtcacacagctagtaagtgtggagaccttgcatccaatcaatgcccgtctcattctaaaggccatgttatgtgttctccagcccatggagaataattttaacacagtcaatgaaatttctacacaacaatgttcttgtctcaagtccaagaatgcctcctacacctcctataatactggctttctggtgagtaaagatgccattctcatgtgtaatcaggtggcaaatggagatatgaccaaagtaaccacctgcctacactcataaccctgtacacactcttcctgtgtcgattcaattcaagtaccccttttgatcacttagcaaatctgacctttaaaagggttagggtttttatatccatgtaagtttctgtattgctttggaagtctctggttaaattaatactcttttaatagtgacctgtgattctgttttgatcaagtgttttcaaacttgacatctttgatgggtttctccagtgtcaaaatcctaaatcaagtctttttggcttaaaactaactttgggatttttttcagctgcatcccttggggagtctaaagaatgtatctctcatcttgtagaggtattaagtgattcgatttatttggtagattaaatgggcaggcattgtcaaatgtggcgatactgcatgggagggcactgtcaagtgaggtgacattagatctcatctcagttatatttatgggtatgttgttgatatgcgtgttccaaaaattgcatacatttatacaaatttaatatgatttgtaattttgatagttatgctaaatatttgctaaagttatatttgtataaacatgtcacgaatggctgggcactgtcactcatgcctgtaatcccagcactttgggagacaaaggcacgtggatcacctgaggtcgggagttccagaccagcctaatagagtgaaaccctgtctccactaaaaatacaaaaattagccatgcctggtggcacatgcctgtaatctcagctactcgggaggctgagacaggagaactgcttgaacccaggatgcggaggttgtagtgagccgagatcatgccactgcactcccgcctgggtgacaaaggtagaatctatccaaaaaaaaaaaaaaaagttattatttctgaagattgtatgaaatttataaaagtctgctggccctgatatgatgctgtcagtcatgattctgattactgtcttaaaatgctgcacataagtaattaaatttccttgtgaactgggaagtttcatcagacttttatcataactattgtttccatcatccacagttactgttttgaattcttctctaaaaatatttgtaattggcaatagtccaaattttcttttgttttctttcctgtttttgagacacagtctggctctgtcgcctaagctggagtgcagtggtgggatctcggctcactgcaaactctgcctcccgggttcacgccattctcctgcctcagccacccaagtagctgggactacaagtgctgccaccacatccagctaattttttgtatttttagtagagacagggtttcactgtgttagccaggatggtctcaatctcctgacctcgtgatctccgcgcctcggcctcccaaagtgctgggattacaggtgtgagccaccgtgcccagcctaatttttgcatttttagtagagaggaggtttcaccatgttggccagggtggtctcgatctcctgaccttgtaatccgcctgcctcagcctcccaaagtgctgggattacaggcgtgagccactgcaactgactttttttcttttttttttttttttttttgagacagagactcactctgtcacccaggctggagtgcagtggcatgattttggctcactgcaacctccacctcctgagttcaaacaattatcctgcctcatccttcggagtacctgggattacaggtgcgtgccaccgtgcccggctcatttttgtattcttagtagagacggcatttcaccatgttggccaggctggtctcaaactcctggcctcaactgatccactctcattggccttccaaggtgctgggattataggcgtgagccaccacaactggctcagtaaatacattttttattatcaaaaaagagtagtgtatggttggcgtattctgtgtagaatgtattttattgatgtctcctatttttataatttctgagttaagtactttttaattaatgctttttagttttgggcagattcagttgactaaagcacctcatttcccagatacatgaaataaaatatttggcttcttttccaatttcacactgatgttattttgtgaaaatcagtgctttaagataaatcgttatacgttaagataaacatgagaaacttgatctaatatttaatagttattcagttctacactttattaacttctacaccagcagatttagacattatgtaaccatctcaagaagtttcacttggatgtaatgcttcacgcttgtaatcccagcactttaggaggctgaggtgggaggactgcttaaggcaaggagtctgagaccagcctgggcaatacagcaagatcccatctctattttaaagaaaagtttcactttgggaggccaaggcgggtagatcacaaggtcaagagatcgagaccatcctggctaacatagtaaaaccccatctctactaaaaatataaaaaattagccgggcgtggcggtgggcgcctgtagtcccagctactcgggaggctgaggcagaagaatggcgtgaacccgggaggcagagcttgcagtgagctgagattgcgccactgcactccagcctgggcgacagagcgacactccatctcaaaaaaaaaaaaaaaaaaaagtttcggcaaattccatctaagaattccaccagagttctgttgtctccaatgtcatcttccacagatttcaagttgtgaagccctgaactgttaatttatcttgagaatgtatatttaagcttaatttaagactatatacctaaaaattgagcatgtaatttctataatttgtttatgtaagtttctgtaagtcataagtatgtggtttccaagtgtataatttatctgaatgtaataggcattaatatattttacattactgggaccatagtacagaaatttctaaatggtttgtaaaataacttgttatttgtgttgttgtaaaagcagttaatacaatggaaaaactcgtaataagaagatacagtttaacatcaaaaagtttacccaaggtaattatgagtactacctggcaaaacttcacggaagctgtggtatcacttttatgatggaagaatggtgtttgcattttgtgtaaaagtacttgcggctgggcgtggtggctcatgtcccagtgctttgggaggcgaaggcaggtggatcatctgagcccaggagtttgagaccagcctaggcaacgtggcaagagcctgtctctccaaaacctacaaaatttagccaagcttggtggtgtgagcctgtagtcccagctacttgggagactcacgctggaggatctctcgagcccaggaggcagaagatgaataaataaatggaagcaactgaatgggatgaggtctctcttgaaggagagagcaaaagagatttaaatagtaacaattataataaggctgggcgctgtggctcacgcttgtaatcccagaactttgggaggccaaggcaggcggatcggttgaggtcaggagttcaagaccagcatggccaacacggtgaaaccctgtctctattaaaaatacaaaattagccggacatggtagtgcgtgcctgtggtctcggctactcaggtggctgagacaggagaatcgcttgaacctggtaggcacaggttgtagtgagccgataaatataaaaagtattagagtactaacagaggaaagtttccactgatcaccttttagctttaaataatgcagaagcatttgcccagtttacttgtaattaaaaatcatgcatcattcacaatttatatcttttttgtttgtacaaaaatgaacacaagttattctcttttatctgtattgtgattggtttggtgagagggaattaggccacttgagagtttgtgtgtgtttacaattttctggccaggcacggtggctcatgcctgtaatcccagcactttgggaggccaaggcgggcggatcacttgagctcaggagttcgagaccaaattgggcaacatggtgaaaccctatctctacgaaaaatacaaaaattagctgagtgccgtggcttgcgcctgtcctcccagctacttggggggctgacgcagtaggatcgctcaagcccaggaggtggaggttgcagtgagccaagatcacgtcactgcactccaggaagggcaacagagcaagactccttctaaaaaaaaaaaaaaagaaagaaagaaaagaaaattaactttggtatttcaggttgtatttaaatggagacttaacatgaactatgttcataacacttgatcaaattaagtgtagatcgtctctttaataaagagatcatctggaactgcaatttctaactcatacatcattgctacaaaccttatttgtttactgtttctcttccagggaccatcagtcatcctttaaaattcatttcaagctctgaaaagatattttttgttacatgggcaatttacttttagtacagtaaaatgttatgtgaatttctacagtatgtttgccaaaatgaattatatctagaatacgcttaacaatatattctggaggcagctttcatttgaaattaggttcaccttctgagagtatgaaaaagttaatgggtttttgtgcctgaagattttgatgttgcatttggctacatttaatccactttcacccataagttttagcatctaaaaaaattaaatcactgctaatgcaattaaaatgcattatgaaatgcacttctgtccaggctggagtgcagtggcacaatctcggctcactgcaagctccgcctccctggttcacaccattctcctgcctcagcctccctagtagctgggactacatgtgcccgccaccacgcccggctaatttttttttttttttttttttaatgaggcggagtctcgctctgttgaccaggctggagtgcaatggcatgatcctggctcactgcaacctctgcttcctgggttcaagtgattcgcctgccttgctgggatgacagacgtgcaccacaatgtccggctaattttgtatttttagtagagacatggcttcaccatactggccaggctggtcttgaacttctgacctcaggtgatcccaccttggcctcccaaagtgctgggattacaggcatgagccactgtgcccagcttaagatctctgttttaatgttaatgctggtcagttgtgtctggattccagagggaggaaggtagaatgaggcatgttgacacctccccttcccatcatggcctaagctggtcttttcagtttactttggaatgtccttgctcaacaggaagggtccattcagtcggattgggtggcttagaattttatttttggtttacatctcaactatcacagcagccgggcgcggtggcttcacagctgtaatcccagcacattgggaggctgaggcaggggtatcacctgaggtctggagttctagaccagcctgaccaacatggagaaaccccccgtctctactaaaaatacaaaattacccgggcgtggtggtacatgcctgtaatcccagctactcgggaggctgaggcaggagaatcgcttgaacctgggaggcggaggttgtggtgagctgagatcgtgccactgcactccagcctgggcaacaagagcgaaactctgtcttaaataaataaataaataaataaacaaacaaacaaacaaacaaactatcacagcataaagtaggaatatttcgttactgtctagttaaactggttaatgcagaaaggaagtctggtaattccagttttaaagtaaaattttggacattgtaggattgattatttggcatagttgtgatgtttgttcctgcgttatggttttgttggcagggcagcctttaaggacctgtatattttcttctagactctatatattccctgtgagtattagttgtatggtcaaactggcaaattttaccataggtataaataatagagaatgtggaagaatagtgaatagtgtcagagatagttaaaagtccatacaatagtagagaaggtagtaagtaatagtggcttggactaaatatttgttgaataaatgttttaaaaaacaggctacctacaatttgtgttgaagatatgaatgaatgaagtttccacacctttatgtggagacctgataagtaagcaacaataaggaagggtccccaggttggggagagccccaagttgagaacaataatgaacaattattgtatgaacaattgttagagacagctaatcacaaacaacctgcgggcacaatgacctcattccacacgtagcacccttcagcaggaccctataaaactttcctccagcccttgcctctttgcaggtagccccttctctgctgagctgcccactgcaacatattttcacaatttctctaataaatctgcccttctttacccacaactatcttggtaaatggctttaccacctgcaaaactgaccctaggttgttgctacccgatatggtttggctgcgtccccacccaaatttcatcttgaattgtagttcccataatccccatgtgtcgtgggagggacccggtaggaggtaatcgaatcatgggggcaggtttttcccatactgttctcgtgatagtgaatacatctcactaaatctgatggttttataaagggcagtttccctgcacgtgctctcttgcctgctgccatggaagacatacctttttgctccttctttgccttccaccatgattctgaggcctctccagccttgtggaactgtgagtacattaaacctctttttctttataaattacccagtttccagtatttcttcatagcagtatgaaaagtaactaatacactacccgagacatcttaggagatttgtaatagctgtaatgccaggtccaccatatttttagcataaagcaaatgtttacgcgtgatatgactgcacgggctttctttcagctggagccatagcaactcaagtagtaaccctatcttagtctgattaaaagtaaatattagtctgggcatggtgggacatgcctgtaatcccagtactttgggaggctgagacagaaggattgcttgagcccaggagtttgagaccagcctgggcaacatggaaaaacaccatctctacaaaaaatacaaaaattagctgagctggtggcacacacctgtagtcccagcaccttgggagggtgaggcaggaggatctcttgaacccgggaggtggaagccgcagtgggcaatgatcatgtcagaggtgtgtgaaccagagcaactccatcttaaataggagccgggaaaaatgaggctgaaactactgggctgcattccctgatggttaaggcattctaagtcacaggatgacatagaaggtcagcacaaaataccagtcataaagaccttgctgataaaacaggttgcagtgaaggagctggccaaaacccaccaaaaccaaaatagagacaagactgacctcccatcatcctccctgctacactcctaccagcaccatgacagtttacaaatgccacggcaacatcaagaagttaccctatatggtctaaaaagaggaggcatgaaaaatccactccttgtttagcatatcatcaacaaataaccataaaaatgggcaaccagcagccctcacggctgctccgtctatggggtagccattcttttattcctttactttctctcttttttttttgagatggagtctccctctgtcacccaggctggagtgcagtggcgcgatctcggcttactgcaagcttcgcctcccgggttcatcccattctcctgcctcagcctccagagtaggtgggactacaggcacccgccaccacacttggctaatttttttgtatttttagtagagatgaggtttcaccgtgttaaccaggatggtcttgatctcctgacctcgtgatccacctgtctcggcctcccaaagtgctgggattacaggagtgagccaccgtgcccctcctcctttactttcttaataaacttgctttcacttcacactgtggcatcaccctgaattctttcttgcacaagatccaagaaccctctcttggggtctagattgggacccctttcctgtaactatcatgctactgcactccagcctgggcaacagagcaaggccctgtctcaaaaaaaaaaaaaaaaaaggaacatgacttaatacattcattttggagggtaagtctctcaaaataggcctttcactgggggaaaatggtaaaaatactccctggtaattcaagaattggagactcctgagatgctgctcatattagctgagcacttatcaatacttcacttttttccatatatactcaaggaacaagtgctatttaaagtgtttcactccactgtgctaggtgcaagactataaagaggtgtgaggatcaacacttttatgaaaaccagtgtcattctggatatagtttcagatgctagtgcaaaggaagctcttggtatacggaaaaagtattcaacaataaattaggcatggttgcttccattttctgcctcacatactttttttttcgtggttgaagtgatataatgtctatgatattttagattggcagttgcaaactagtggtcctcagcgtgctttttatgacacctacaaggtctgaagactttgatttcatattaaaaatctgggtttcaggctgggtgtggtgttgcatgcctgtaatcccagcactttgggaggctgaggcaggagaatcgcttgaaccagggaggtggaggttgcagtgagccaagatcgcgccactgcactcaagcttaggcaatagagcaagactccatctcaaaaaatgaataaataaataaataaaatctgggtttcaggccaggtgtggtggtgcactcctgcaatcccagcactttgggaggctgagatgggcagacagcttgacctcaggaattccagactagcctgggcaacgtggcgaaaccccatgtctacaaataatacaaaaaaattagctgggtgtagtggagtgtgcctgtaatcccagcaacgtgggaggctgaagtgagaggattgcttgagcctgggaggttgatgttacagtgagctgagatcgccctcctacactccaacctgggcaacagagccagaccttgtcttaaaaaaaaaaaaaaaaaaaaaaaaaaattctgggtttctggcatctcaaaaaaaaaaaaaaaaaaaaaaaaaaggaaaggtcagggcacatggctgctacagtcctctattaagcaatgtgccacagcaggggtccctgacccctgggccatggacatgtactggtctgtggcctgttaggaactgggccacagagcaggaggtgaatggtgggtaacaactgaagcttcgtctgtatttctggctgctccccattgcttgcattgctgcctgagctctgcctcctgtcagatcagcagcatcattagattcttacaggagcatgaaccctgttgtgaattgcacacacgagggatccaggttgcatattccttatgagaatctaattcctgatgatttgtggtggaacagtttcatcccaagaccattaccatcctgcgccccatcccttgccgcctgtggaaaaattgtcttccacaaagccggtccctggtgccaaaaatgttggggactgctgtgctttagaatctgccatgaatctgcagcctctattatatagctccctatagactttgcttcctaccgtcttacgttctgccttataggcatttgactttgcaacccttgtttttgttagtatgctacgctggtgacattgaccaaattgaccacacattaattataagcttagttggtgatgacctcaacggaataacgtgacataagtattgtgacaatacttcttgcatgtatctgcaggtggaattgtaaacctggtggtccgagatggtctaattccatcttcctatgtatctccttatattaatagtggtaacatttgtggtggtgattcagcatttcaatgcctcttctcatggcaacaacaaacgttttccttctgaatcaacattaacctagatgttactgcggatcaaaattagactctacattttcaaccacagaaataccgggcagtaaaaatttttcttaatattgattgcctacataggttgtgtaattagcatatgtttacagttctatgatttctgcgtggctgctacagagctggagggggtaaagcaacagtattttctcagttgtgcgagcagcattacattataataaataggtaatattaaactgggctgatgagagttgcaaaagactactttaatgttcatatggaaccaaaaaagagcccgcattgccaagacaatcctaagcccaatgaacaaagctggaggcatcatgctacctgacttcaaactatactacaaggctacagtaaccaaaacagcctggtactggtaccaaaacagacatatagaccaatggaacagaacagagccctcagaaataataccacacatctacaaccatctgatctttgacaaacctgacaaaaacaagaaatgcggaaaggattccctacttaataaatagtgctgggaaaactggctagccctatgtagaaagctgaaactggatcccttccttacaccttatacaaaaattaattcaagatggattaaagacttaaatgttagacctaaagccgtaaaaaccctagaagaaaacctaggcaataccattcaggacatagggatgggcaaggacttcatgtctaaaacaccaaaagcaatggcaacagaagccaaaactgacaaatgggatctaattaaactaaagagcttctgcacagcaaaagaaactaggatcagtgtgaacaggcaacctagagaatgggagaaaatttttgccatctacttatctgacaaaaggctaatatccagaatctacaaagaacaccaacaaatttacaagaaaaaaaacaaaccccatcaaaaagtgggcaaagcatatgaacagacacttctcaaaagaagacatttatgcagccaacagacacatgaaaaaatgctcatcatcactggccatcagagaaatgcaaatcaaaaccgcaatgagatatcatctcacaccagttagaatggcgatcattaaaaagtcaggaaacaacaggtgctggagaggatgtggagaaataggaacacttttacactgttggtgggactgtaaactggttcaaccattgtggaagacagtgtggcgattcctcagggatctagaactagaaataccatttgacccagccatcccattactggatacatacccaaaggattataaatcatgctgctataaagacacatgcacacgtatgtttatcgcggcaatattcacgatagtgaagacttggaaccaacacaaatgtccatcaatgatagactggattaagaaaatgtggcacagatacaccatggagtactatgcagccataaaaaaggatgagttcatgtcctttgtagagacatggatgaagctggaaacgatcactctcagcaaactatcacaaggacaaaaaaccaaacaccgcatgttctcactcacagatgggaattgaacaatgagaacacttggacacaggaaggggaacatcacacactggggcctcttgtgtggtgggggagggggaagggatagcagtaggagatacacctaatgtaaatgacgagttaatgggtgcagtacaccaacatggcacatgtatacatatgtaacaaacctgcacattgtgtacatgtaccctataacttaaagtataatttaaaaaaataagtaaataaataaataaaaaaagaaacaattgctggctttgcaattctctttcctccaaaatcgccaaggcctcaatttactcattgctgaaaaaggacgactctgtatatttttaaatgaagagtgttgtttttacctaaatcaatctggcctggtatatgacaacataaaaaaactcaaggatagagtccaaaaacttgccaaccaagcaaataattatgctgaacccccttgggcactctcttaattggatgtcctgggtcctcccaattcttagtcctttaatacctgtttttctccttctcttattcggaccgtgtgtcttctgtttagtttctcaattcatacaaaaccatattcaggccatcaccaataattctatatgacaaatgctccttctaacaaccccacagtatcagcccttaccccaaaatctttcttcagttgaatctctcccactgtaggttcccatgccgcccctaatcccactcgaagcagccctgagaaacatcgcccattatctctccatatcacccccaaaaattttcgccaccccaacactttaccactattttgttttatttttcttattaacataagaagacaggaatgtcaggcctctgagtccaagctaagccatcatatcccagtgacctgcacgtatacatccagatggcctgaagcaactgaagatccacagaagtgaaaacagccttaactgaagacattccaccattgtcatttgtttctgccccaccctaactgatcaatgtactttgtaatctgccccactcttaagaaggttctttatcatctcccccacccttaagaagtttctttgtaattctcctcacctttgacaatgtactttatgagatccacctcctgcccccaaaacactgctcttaactccaccgcctatccccaaatctataagaaccagtgataatcacaccaccctttgttgactcctttttcggactcagcccgcctgcacccaggtgaaataaacagccatgttgctcacacaaagcatgtttggtggtctcttcacacagacacgtgagacaggagttcgagaccagcctggccaatctggtgaaactctatgtctctactaaaaatacaaaaattagctgggcatggtggcgggcacctgtaatcccagctactcgggaagctgaggcacaaaaattgcttgaacccaggaggcagagtttgcagtgagccaagatcacactgtcaggcctctgagcccaagccaagccattgcatcccctgtgacttgcacgtatacatccagatggcctgaagtaactgaagatccacacaagaagtaaaaatagccttaactgatgacattccaccattgtgatttgtttctgccccaccctaactcttcaatgtactttgtaatctcccccacccttaagaaggtactttgtaatctccccaacccttaagaaggttctttgtaattctccccacccttgagaatgtactttgtgagatccacccctgcctgcaaaacatggctcttcaccccctatcccaaaacctgtaagaactaatgataatccaccaccctttgctgactctcttttcggactcagcccgcctgcacccaggtgaaataaacagccatgttgctcacacaaagcctgtttggtggtctcttcacacggacgcgcatgaaacacacgactgcacttcaggctgggcgacagagctagattccatctcaaaaaaaataaaataaaaaggagtcacctcccccgagaggcctctggaccaccccatctgagcaggccactcttccttctctatcttaccatcttgtttctgtcccagtagttagggctacctccagtaatcctatttgtccctttactgtttagtgcgtctcgcttgactagaagctccatgaaagcaagagaccctacctgcctccttcgccactagacccccagggcctggtatgtggtgatcgctcagggcccattttcttcctttcctcctcctccaagggtggggaaagagcatcagaaggtctaggtggccccaggcccaaacaatgctcctttaaaaggaaactagattgttacaaaggtcagaggctgaaaagttatttccgccttttatccctctaaattcttcacttcctgaaaaaacaaacaaacaagccactgagggcccttggactaaatccaggcctgagttgctgggcagaggtcagtcttgtccagacatgggaaaaaaataactcgagtcagacaggtgggtcaccacagaactaatccagcctgcaaatggcctgtgcaatcttcagctctgtccagacctgcctccctctggggatgcctttaaaggtgatgaatgatctggatgaatgggcttagaagataagagggaaaaacaaatatcacaggtcaaatcgttatttgtcttcaagtttaacaccgtctactggactaaaagatgtccaaagaatagttgttcaactatgtaaattcctttttttttttttttgagacagagtctcgctctgttgcccaggctgcagtgcaatggtatgatcttggctcactgcaagcaacctctgattttagtattattagtagagacagggtttcaccatgttgaccaggctggtctcgaactcctgacctcaggtgatccacctgcctcggcatcccagagtgctgggattacaggcgtgagccaccgtgcccggccaactacataaattcctaacaacgtatctccagaaagtataggcacaacagcacatgcagtcattcctgtaattaagtgctccgggaggccaaggcaagaagatcccttgagcccaggagtttgagaccagcctggacaacatagcaagactgtgtctctacaaaatatacaaaaattgggctggggatggtggctcatgcctgtaggcccagcactttgggagaccaaggcaggaagatcgattgaactcaggagctcgggaccagcctggacaacataacgagacccagtctctactaaaactcaagaaaattagccagacgtggttgcatgtgcctgtagtcccagcactttgggaggccaaggtgggtggatcacctgaggtcaggaggtcgagaccagcctggccaacatggtgaagtctcatccctactaaaaatacaaaaattagccaggcacggtggcacacacctgtagtcccagctacttgggaggctgaggcaggagaatggattgaacccgggaggcagaggttgcagtgagccgagatggcaccattgcactccagcctgggcaacagaacaagactccatcaaaaaaaaaaaaaaaaagaaagaagagaagaaaattagccaggtgtggttgcatgcacctgtagtcccagcactttgggaggccaaggcaggaggatcaatcaaggctaggagattgagactgcagaaggaaaccctgtctctaaaaacaaggtccagctaaaatcagggtccagctccaccacaagcgcagctccaggggctgttgagttttgcctctaccattccaagtagtctctgctccagaccaagtcccaccatctggcagtcatgtcagtccaaccacagtcatatcagggcgcttccagtcattgagtgccccttgaggaggctggaggagaggccaatgacatttgcacttgagactccagagtctagatttataaccactatgttacggctgccagtgtggctgcaaggacacttctttcattcattcatttacaatagatgtagcatctgctgtgtgccagatgccattctaggttctagggaaacaaggcagagcccctgttttccaaggcatccacattctaggaaagactgctaccagcctggcgtggtggctcatgcctgtaatcccagtactttgggaggccgaggtgggcggatcacttgatgtcaggagttcaagaccagccaacatagtgaaaccccgtttctactaaaagtacaaaaatcagctgggcatggtggcacgtgcctgtagtcccagctactcaggaagctaaggcaggagaatcgcttgaacctgggaggcagaggttctggtgagccgagatcatgctactgcactccagcctgggcaacagagtgagactccatcaaaaaataataataataataaaataaagactgctactaaacaataaaataaccaaaccagatagatgacttcaggtggtggtaagagctttgaaagaataagcaaggtaactaactggtcagaggaagggagatgggtgcattccctcagatagaccgccccagaggtctgcctctctgacatgacatctgagcagagacccaacaggaaaaggaagaggctgctctatggccgggtacggtggctcacacctgtaatcccagcactttgggaggcccaggcgggcggatcacgaggtcaggagatcgagaccatcctggctaagacggtgaaaccgtctctactaaaaatacaaaaaaattagccgggcgtggtggcggatgcctgtagtcccagctactcggaaggctgaggcaggagaatggcatgaacctgggagacggagcttgcagtgagccgagatcgcgccactgcacttcagcctgggcgacagagtgagactccatctcaaagaaaaaaaaaaaaaagaaccaagaggtgtccaggcgaagagaacagcagatgcaaaggccctgtggcagaaacaatcttggtatgctggaggaataggaaggcagccagtgcagctggagcaggataggttaagggaggatcaaggtgatgagggcctggaaagaggggctggggtcgaatcaccagatcctgttggttgcaatggaagagcctggagtttattctcagagcagtgagaagccactggaaagttgtttttttgtttttctgtttttgagacagagtctagctctgtgacccaggcagactgcagtggtgcaatcttggctcactgtaacctctgcctcccaggttcaagcgattctcctgcctcaggctccccagtagctgggattacaggcacatgccaccacacccatctaatttttctttttcttttttttttttttttttgagacagagtctctgtcacccaggctggagtgcagtggcgcaatctcagctcactgcaacctccacctccctggttcaagcgattctcctgcctcagcctcccgagtagctgggactacaggtgcatgccaccatacctgggttaattttttgtgtttttagtagagacaagatttcaccacgttagccaggatggtctcgatttcctgacctcgtgatctgcccaccacggcctcccaaagtgctgggattacagtcgtgagccaccgtgcctggccagccaccggaaagttttatgtaagcaggggagtgatctgttttatcatttagaaggatacacacctcttcttctttttttagagacagggtctagttctgtcacccaggctggagcccagtggcacaatcatagcttactgtaacctcaaactcctgggctcaagtgatcctcctgcctcagcatcccaaagtgctggattacaggcatgagtcaccatgcctggtcacacttctcattctttaaaccagacctcatttgtccatctcccccatcccccgccccaccccacggactgtcctataatgcccatacaacaggtcactgtttagaaagtgctacaaagttacaaacacagtcccttctgagcctcccaccaatgttggtgggtacaaggtcaaaaaaaaaaatctcatctatctaaggggcataggagactttttagttagagggcccaattatagtcctcctgaaaagatgccaaaagtccccttcaacacttagcaaagattcaagaaagatgaatctcacattctttgtatgggaaatgaggaacttgacatcttcaatataatggattccactaaaataagatgacgatcaataggaaccaactaaaaaaatacttgactagctgttattgaaaggctgaaattcagctgacataagcagtattaatattgagctagaaaataattcgcattgaattcagcccaacttttgttttctgatttgggtctcttctaaattttttttttcttctggacattgagaacaatccaatttgaaggcctcaatgcccaaatctacactcttgttttattctatatccttggtttcttctttttttttgagatggagtctcattctgtcgcccaggctggagtgcagtggcgtgatcttggctcaatgcaagatccgcctcccgggttcatgccattctcctgctgcagcctcccgagtaattgggactacagatgcccgcccccacgcccggctaatttttttgtatttttagtagagacggggtttctccgtgttatccaggatggtctcgatctcctgacctcgtgatccacctgcctcagcatctcaaagtgctgggattacaggcgttagccaccgtgcccggcccacacctaggtgatttttaaagttcttctagtagagacagggtctcactatgtcgggtcgccgtgtttgatgtcagttttccctgccagaatctacaatctccttgatcaccattatatcccaacgaagagctcagtacctggtacaaagcacatttgatcaatacttgctgaataaagaaataaaaatgaagaggcactccagcctgggcaacagagtgagatggtctcaaaaaaacaaaaacaaaaacaaaaaacgactggaaaggagatgagggtacttgtgaagccatattatatgacacgctctgtgctaggacttttatataccttgtctcatctcttcatctcatataatccttacaagtacctcaaaagtggggaaatccccatataactgaagacgaaggcagttcagaagttcattgatttgccctaaggttcctcaatttgcaaacgtcaggccaatgatccaaccccaggtatgtttggcagtgaaggaccagttgagtcacagctgcaagtaaccaccctgcagtggtccctatcttggccgttagcttacattgacatttaacactcaaatttactcagtaacaccagctatcatgttttccactaaaactccacagcattctggcaacttttctattttagagcaataaagtaaattgttagcatccctttgacatataaatatttctacaaatagtaattctctagccattcatttggagtatttaaaactcaacattcatagcacattttatgtgacaaagaacttatgttcagaacacaaaaataagtcgtacgtcttcattaaaaacaggtgaagaatttgaacaaacatttgcaaactaaaatacaaatgaaatacactcaacatcattaaacaagaaaataaaattatgagataatcactaataatcactacatatgcaccacagtgattaaaatttttttaagttaagccacgtgacccaacaaggtgcattcactcaagagaaacgcaaatatatgtccactcaaagacttgcacatgaatgttgagagcaggtttatactgaatagcgcaatgtgaaaaaaccccaaaatctagcaaaggatgaagggagaaataaactgtggtaaatacatacaatagaacactactcaataataaaaaggattatattcctgatacatgcaatatgggtgaaccgtaaaaatatcatgctgagcaagagaagccaaacacaagagaacatgttgttatgatttcacgtacatgaaactttagtaaagacaagtctaatccatagtgacagaaagcaaatcagtaactgctgacaggggcaaatgaggagatgatcccaagggaaccttctggggtaagacgctgttctctatctcgatcgtattggtggtcacacaagtgaagacatgttagaactcatcaaaccatacacttagaatgtgtaatataaacctcaataaagcaaaatttaaaaaaaaaaaccacctttaattttctcttacaaaaaaaaaaaaggaaaaccacttaactttaattttctccaacaactgattctggtacacagtataccttaatgcctgcatccacggcctcacgtcatgctgtttacatgaacgtaaagcttcgccgaagagtggaataagacagtcctgccagagaaaaaccaaaattactcaacgtaaaacaggctgttgatatgtttgcagatatatagcaagtcttaagtccaagactgcaatatagtttggctacttcagattgattgcagtagttttatctattacactatacccttacatcatttatcttctactcacaagaggcaagcacacagtaagagaaagccttttgttttgaagggaaatcttcttcagaatattaagtctaatttatcaatatacttaataaagcacattacaaaaaaaaaagtcacagcacatttactataaagcagactgcagaaaaacattacaactaatgctttattatgaagttctcgaagatcaccattcattcagaagcccccatctctggtcgaactttaccccatttaggatgaagaggagagatctttgtttgcagcaaatctaaaatttacgtgatctgcctaaaggaactgtctttacatacaccacctcccaccccaaaaatagaagaaaaaactgagcaatttgccatccttgcgattatctcaggttcttccatctgccccatgtacttcccaaatgaaagactgcctgaaaacagcatgttagatttctggatttaccagcttgcccaactacaaatcctattccaaaaaactcaaaaaataaggtctttgttctacagtaatgaccattaatagtcataagagtgtgcttgtaaaaatatacagacctctgttgaaagtctgttagaaactgtggtctccaaagcagacgagcaatacagctgcaaggtacttagaactggcaaagactgtgaaactgttaaagtagaaagtctcagaggtccaatagcgatgcgggatgtttgcttcaagtactttaccacatttctgaaacaaaatatttactgtcaattaataaaaattacaattcataaccactcaaagaataaagcaattgataagatgctatcaaattgacatccaaagttagggggcagtaagaggagcagcctgctctataataaaatggtatcagcaagtcaagacatttgcttttggggatttttacattttatttcatttcaacctcagtttttgttggcaagcagcattcatatatcatatgacttctacaactaaaatgaagctattagcactagtatttagtaatctagtaactctccttccagccctcttcaccccatgtatgtttatcacatgatatacacaatgtacatttacctccgtaagagtaaacttactcagttatagactgccacttctgatcttgttctatcgggtttaaagcagttgccaaacaaacagaacttcttaacaatggaacttcaatggatttctgaggttcccttggatctggacttcacatgttacgaagcagttttttcatgtctacagaagttaaatgaaatgtcattaagttaatgtgcttttattataaattttgatttatgtttggcattattaaaaactaatcaccaatgaacagctcctttaatatttcaggcagttaaacactataagcattactgagagctatataaaaatcatacttcatacaaaattactgtacctcagacccctaaaaagcagttgccttcaaaggctcaaaaatcagtaagtcgaggtcaggcgtggtggctcacgcctgtaatcccggcactttgggaggccaaggtgggtggatcacgaagtcaggagttcaagaccagcctggccacgatgatgaaaccccgtctctactaaaaatacaaaaaattagcttggcacggtggcagacacctgtaatcccagctactcaggaggctgaggcaggagaatcgcttgaactcagagggcggaggttgcagtgagccgaaatcgcgccactgcactccagcctgggcaacagagtgagactctgtctcaacaaaaaagaaaatcggtaagtcaatctactatttaaggggacaaatctagacctgcattagcaaatcttgctcaatccagaatactcattaaactttttaataacatcttatcaagtgttccatttgtgataaagaacttaatgagccacatcaagatgaaaatcaagaaaaatatttagctgaaacactactttgtcctttatcaaacaaaatggctagataaatctcaaagtattaaggtggtcattttttttatttgacttaattttaagtgcttttcatttcccaaatcaaacataaatagggcagccctaaatttgttgcttcacatgggattctgcccccacaaaaatgtaaaataacttccagattttccagtaaaatatactaagccaaacattttgagcaacttgtccactaaaataactttaaaactattttctcaagtacctacctattttttcttttgatcctccagcaagtagattgatattttctcctggtaacaattctaattgctcggtacatttgacaaattttccagactcaaagctgcttaatgatctgtaattaaaatattggttagcttgtattcctatgcagcctgtggaaccattaaaaaaaacaaacaaacaaaaacagaacaaatcctaggaagacagcaaagtacacagcacttttctgacaaaattccttccacgaggatgccattattttggtttttatgttgcagatgtgactaccacttaattagtactcaaattggagtggcaaaccagaaagtcacagctacagactttcagtggagctgactcgcccgtgtctccttcctgttttcatgtgttgcagcctgttctcttcagagcctgacacactgacagtagacctctgcaggacaactttgacacccagttctctccaagctgccagtgagctccctgtgcagcctcactcctcacctacagcatgagcccttgcagctctcccagcatcacaatcttgtatctcagtcctggcttctttcactgctggcatccctccgtctctccctttttcacctacttttcttttttcaaagaattcttctctttcatctgcttatatgaaaaataatgacacctctgaaattctttcctgtagttctgcagcatcaatgccaggaagacaggcctcatcctcccagcttctatgctgctcctttcagatcccttaccctgtccccattttcatgacacgggctctccagccaggaagaagacactgtttctcactctctctcttttccatctttgcctgtccctctcgctgtgtaacttcccttataactcagcctgaggccagtgctagaaaggcacatcacctgacttattctgtgcctgattctacctagatcagtgcaaccactggcttctcagggggacccttgagtactgggcactgatgaactgctgccaacacagtcatcatttctgccattaaaaggtcctaagtcctctccagtggcaggttccccaagtccccactatgctctataatgccctatgctttcagctaatgactcagtcctcagaaaaaacaaacaaacaaaaaaacacaggctttaatttcctctacccctacccccaatccaccatacactgccgaaattctgtctataccaactttgactgctttccttgaggcagagaaaaggtgagggccagttaatctatcaatgttctttctcctgtttcttcaacctctgctttctagtggctccttccccttggccaaaagaacataatctctccaacatttaaaataaacatctcatatttccctccagcaacagcttcctatcctcgacttcaagaaaaactcactgaccaaataacttacctcaagcttttcattttcaaatgtctctaccactcaatactattcaatctagcttcttctgtctctctacaaaactctttttccttataatccctagagcatctgacaaggctgactactcccatctggatgtcctatatctagggcacttcccttctcaatgtccctgtatttttttgaatggcttcctcttctatcctttcacaaaaatgctaaactaggattctgacccaggccttccttcctcttcactcactattctccagaggcttctctctggtttggttgcttacaaaggctctagagtatagagactgaaaaggaaagagggccttttctgtgtactaatcatctgcaaatctctcaagcttagactgtctccttagttcaaaatccaattcttaacagcttacccaacaatctcatctgcacatttcattagaaatcttaaaacagggcttgttctctgtgtgctcctactccagttaatagcattgtttctcttccctctaccattgcccccataaattaatggtctccatgcttccatacttgccccgcacctccagtctcttcaccacagcagaatgaaccaagtcagatcacaacacatctctgttcaaatcccacctgaaattttcagtcttactagaataacagccaaagttcttttctcagttcccagctacttctctgcccttatatcctactgtttaaggcgctcctaaacacacaggcctcccagctatttccagaacactccaagcccatcattctcacatcaggtctaggcccaaagggcatcctgatgggcatgtcttgaccttgtgtcttccctccaaagaaggtcagctttacctaactgctttccttatggcacagaaaaggtgagtgaggtccaattagtccttctatcaataatctttatctaatctttgctttaaaaggttggaatttgtgtctgttttatgtgctgcctgggtcacagcacatgctcagtgaagcaattacacattaacccatttagcagtagaaggcaagggtatcagacaaagtctaatgacctttatcttcccagccaagtgtctgcaacagagtgagtgctcagttttgaattacagaattaataaaagcacagaggaatgagaagaaagtttaatttacagatgttcacaaactctgtcctcattagaataaatgtttttgatatattcagacctcatttcgaaacaaagccatcaaatgtgattctttctaaagcagtacaaatttttctttatattcactctggcataatcttcaaactgtattaaggttttagaacgacaggttctgaaaattaataccaaatgactatctcagcagtgttttcccattatacaaataccttccctcatctctgatgtcagtttcctgttgtcattttcataatggcagtaagttagaaatataaccattttgtattactacatatgaccaattttaatatttttttgccataggaaaaacatcatagttattggaaatttgttttataactggaaacagaaagccttactttatatagttgaagtcagctttcaggttgagggaagtgctactggtactctttttcaagtcatggatagcgttctgccattcctgcacagcagcccaatcggcagttgagatgtagcactcacatgctttgtttcctaaataatttataacctcaggggaagagtcagtcggtttggacagcacactttttctggattcacctgaaagtattttataaaataagaagagagagattcagatcaattagaaatatttcaaagagcacagaaacctaaaaacatgataagaacatcagtacgaaatatattactataacttttgctttatttaaaaatactgaatgctcaccattcagacaatgtttcaggctggcactcttacacccagcactggctaaggtgagcaccgatttgtcaaagctggagatgcagcaatcaacacctgtcatggcacacaggtgttcctggtactccacagaggccttttcaaacctgaaaagcaaattgaagcagtcttatttctttatttatctaactacttactttttttttttgagatgaagttttgctcttcttgcccaggctggagtgcaatggcactgtctcagctcagtgcaacctctgcctcccgtgtacaagcgattctcctgcctcagcctcctgagtagctgggattacaggcgctcgccaccatgcccggctaattttcttgtatttttagtagagacggggtttcaccatgttggccaggctggtcttgaactcctgacctcaggtgatccacctgcctcggcctcccaaagtgctgggaatacagatgtaagccaccgaacccagcctacctaacatggcaaattttgtttttttaaatattgagtgggaaaaacagatcataaaaccatgtgcctatgtacgctgatgttttggtgaagaatggaggaaacgacatgaaagaaaaaagaattacaaagcgtatggatatggaaatatgggactacaaaaggacacacaacagaagttactacaaagatatggaagtatgagcagttcttttattttcctaagttcgcaagatttcattaaactaacataaatggacacagaatattatggtacaagctcctctacctggaggaagcaatgagtctgaatgtagagttcactggactaacgagcaaatactctgacaataaagggtaatttgtatcagactctgagggggaaggagctcaactagggatcaagttcaaaagcatttataaaacaactgacaggtcttgttttacagtgtgatttgccactaattcttaaataagaaaggcactccagtattgctgctaactaaagaacaaactgaagatgcctcctggtgaagggatttatagcaagcttcaatgctgaaagcaaacaaagctgttttaagatttggctacaatgtcagtgagtaatacaaagaatttaaacataaagtaattctatcacccatttccttccctccaacctacctcccttcagcctgttgagccactgagttaatccacagaagatgttttccaacaatagatgatgaccagacagcaattccctgtatagcttcaggacaatgaagttcacatagtgcttctaccaccatcataatgcttacttccaattcattcccctgaaaacgcattcagaaaagttagtcacccaataccattaaaacataaatccctataaaatttacaactgatcagtctgtgcctgcttaaagccaaatgtatttaacaattattgtcacaattttcacattatttagctcagaattctttaaaatgttacatataaaatagccacaaagggtgactaacagaaccttagcagcacatggatgtttgtacccccaccccaaagttacccaaaaacatttaacctgtgacctctgtaggaataacacatggagtaaaaagaaagcaaaaatgaaatataaataaacaggaattaaggaatgattaacttcatgtgtttgaaaactgcttgacattacctgaattgctaaacattttgttatttttggattccagttatttattgtgagcccactttcaagccaggaattactcaagcatttgtcatacgttataaaaacaatttctcctggccaggtgcagtggctcatgcctgtaatcccagcactttggaaggccgaggtgggcggatcacttgtggtcaggagttcgagaccagcctggccaacatggtgaaaccctgtctctactaaaaatacaaaacttagccgggtatggtggtgggtgcctgtaatcccagggactgaggcaagaagaggcttgaacccgagaggcggagcttacagtgagccgagatcgcacaactgcactccagcctgggcgacagagtgaaactgtgtctcaaaaaaataaataaataaataaaaattttcccccataaacaaattttcagaattacctttaaagttctaaactttgcacggaagaaatagagttttaacgtgttctaacatgaatattgttttaacatgaacaaaaacatgaacattattttgacttctaacactgttttaacacgaataaaataggtaactctggcagttgttgcttttacaaaatacaggatcaaaacctttgaaaatgaatccaagctttaacttattttatccatagattaaatcataccaaaggaattaaaccatgtttttcttattaacagacttaaaatgaatttcaaacacaccactttacctgagataggctggttgttttcatctctgtaagcaagtcaaagccatgtctcactgtcactgcaggctggcctgccaacaatcctaccctcatgatggagagtcgaatccgcgttagccagtcctgacaagtttggcgattggtatacaaaaaagttctaatgacctttacgataagagaaagaaaagctcaggactggttcaatttgtaggtaaggatgtctcacctatatataaaccaaatacacaagtctattgtgatttcagctctgcacatactgccagctgtgaccattaaactgctataaaacaacactatctcccggaaaccaaccttgggaggtgaagttaaggcattagcacatccctcgtatgcattatacattaatttctccagattttccagatactgcagaagaagaacaagtctaagttggttgttaccatggccttcatcactgtctgcagttgtccactgactaacatcctgatcagggtttaatgtgtgacctgcgagacttcgaatgatacctgaaagcaaagacaacattctgaatttttaaaaatcttaaaagttcctagaataagtgtgagttttttatgaccaattcacatttatcaagtatcctctgtctacccatcatttaaaaataaaaaatcccaacatgaaagatctttcattttaggggaaaaaaatatatattttttccacacaactcccataagttttggaaaaaaaacaaacatatttccaatgcaattattcaatgaaagcttattctaacaaacaaacctgaaaattattgacttttttcaaaaaaaatcatataccctcaaatctttaacaaagatttaaaaatccattatttctcaataaggctttgaaagtattcacatcataaagcttgagcgagttaccttcaattgtctggaaggtgtcttgagctctgcccagtggggttctcagcttagaaagaacagtgaattgtgcagcttcccatatggcccactgccaaaggatagcatctgtcttcaggagattgcgtggaattgttgactggtcacgcttatccagtctctggcagctatagaacagtctttccaaccaattgtccttcctgggaaaagtagtttcatatttaaaagacaatgacaacttcattttaataatgaaaaaaaaatgcaaggggaatgggaataaggaactgtaattttccctactccaaaaaaaggcaaaacctatgaaattgagaagcattatgtccccccctctcattttgaggtcttgtatagttaacaggatgaggtacagtgtggaaggatgattagggtaaacggctcatgccagtcaggaatgaaactcattcaatgcaactaagcatctctagaatatctccacccccaccccactccccaaagtgttaatgacatcacatcagttaactgttaaccacatttcattactcaatttcaaagcccatttttgtttctacagatgctatcttcaaagcaattttcctattgatgaaaactgaaataacccatatgagaagaatgttacttgatactctgccacccccaaacatattttctcttcaaaactgcatgtaaagtcaagggaatcttaaaattttctttcccagataaaatagtcaaagaaatgtcttaccctgttctatgagagttcccatacaaaataaaactaataacatcagagaaatcttgggggtggaatgtattacttggtgctttactcatgtgacttcttaatgctaaagaaatttcttgaatttctgtgtgattgttatcgctgtagacagaaaataaagttgttgttatgcaaaatattttagcttaaaaggttagcacatactgtaagtggattatttacttattaactcactggaggtaaaaatatagtaaaattgagactttcaaatggatacagagatgtgattacaactttagatcctttttttattcacctcagatgggtcatgtgccgacatcataagaggatttgagggaggcatatcaaacatgtgaacataaaaacccaatcattatgcttatctattacaaaaggatcaagtttaggctcttaaaagctcccaaatcaacttgatcaaaaacaataaaagattactgtttagtttttcaaatatctgagctactaagaaacatattttggcactacatgagttattctatactaattattgtgagcctataaagctcattaaaaatttttaattttcttgcagacctgcaaaatttgattatttgacatcacttcaatcactgacaagcagggccataaaagatgtgtcattaatgctctaataggtgatgtgtcttctcctaaagtagacaaccagtagaggctgtaaatatcacagaatgtctttgctccaaaacaactgttataccttaggacaacacctaaaggaattgatttcaacagttttccaaatgcttgtcgaatacaagttccacggtgcactagttgaacacggcaaacatcaacacatctatgaaagaacgaaatagacaaagcaggtgtgttaacagttccaggttattagggttaatgtcaaaagacatgatcttaatttcatacctctgtaaaagatcatctggcaaggaagaggatagagcatgtagactgctgcatgcctgcagacagatattcacatcttcaacgagagctattaaacattaaaagacagttactttcagctggccaaaagaaattatatcccagtttgtcataattatctgaatccattcattcattcaacaaagagtgagtgcctactatagactaggcactgttcttgtccagaatcctcattgactgtcacatttggaaaaatgacacattcaacaaaacccacgtaatgtaactgatgggtcatcacacaaaactttttctgagagaaaatgtaaaagtatatgtaaactataaacattcacgttagcttaaaaatgtgacaatcacttcaaaacatttttctaatactaagaatgaaaaaaaatcaagactgtgtatctgtcattaaaatgaggattacacatcttcaggtcaggaaaagagctcgattcatgaccatctcccattaccaaagacccttttaaggactgataaacaaaatagaaaaaaaaaaaaacagagtcttactgtcagctaaaaggcctttgcaaaatttatggaaagacggaagacagaataaaggtgcatatgtttcggacttcttcattacaacagctacttccaaagcccaagtcattaacagtttcctgaaacacaaaatatacagttgactgtacattaaaaaaaaaaaaacaacaaaaacaaaaaaagttaaaagcctagtcttcttacattggttttctcttggtttttcaaacatctcaaacaataaaaaataaaaataaaaaatgaaactatagaaattactgtcaaaattgttgtgtgccttttaagaaaacctcccaacgcagcatgataatagcaaagaggccgggcgtggtggcttacctgaggtcaggagttcaagaccagcctggccaacgacatggtgaaacaccatctctactaaaaatacaaaaattagctgggtgtggtggcgggcacctgtaatcgcggctacttgggaggctgaggcaggagaattgcttgaacctggaaggcagaggttgcagtgagcaaaactccgtctcaaaaaaaaaaaaagcaaagaatattaaaaatctatatatattcttctatgaaacactgggggtgggggattgaggtttttcatgtatttcttttcagaaagaataagaaagcctagattaaataataaaaccaaattataaggtgtttgacaataaagaagctgctctacctcacctctataatccacatttttttaaattttttgtaatccacatttcttcttctcaaattataaaggcaaattaacaaagttaggaatggttaatactatataatatctgttacctcgtgtcctggttatctttcttaagtaacattcccagaagatttaatataattgagaaatgtttctttgtggccgtagttacagtgccaatcacagctccatcaaacaaagaaggagaggaagaactgaggctactaaagataaagtgatcatgcctgaaagacaaagcatagattatcttttcatctttaatcaaagaaagcaagcaagtccaaagttaaatcaacatacatctttaaaatctatccattaaaaaaataaaatgttttgtggggttcttttcttaagaaaaatttgtgaatacagtacctggtacaatgaggatacaatgtgtagagcacagcatactgaatggcagggaagtgaacagccaggtcactgtgcacaatcatcagattcttactcagaagtgcaaagacagttggagatagcgcccacatctgatcacgtacaaaacaaagtaagtttatggcttctccaaaataagcacaagcatacagagtttatccttcaaaacaggggtatttggacatttttaaattaaaattacagattggaagggatctagtacactacacctgggacaaatacttttttgtgaagtcagtaaagcctttgcgtgcaatatagcatctctatgcaatgcagcaactcctcgtctatcgctacagtaagaaaacagccacaggtcaggtgttgtggctcacacctgtaatcctagcactttgggaggctaaggtgggcagatcacttgagcccaggagtttgaaaccagcctgggcaacacagcgggaccccatctctactaaaattacaaaaagtagctgggcatggtggcgcacacttgtaatcccagctactcgggaggctgaggcaggagaatcgcttgaacctgggaggcagaggttgcagtgacccgagatcataccaatgcactccagcctagatgacaaagttaagactctctctctcaaaacaaaacaccagccacacacaaaacacaggaatgagagtacctgtgttccaagaaaactttcttgagtcggagtctctcgctctgtcgcccaggctggagtgcaatggggcgatctcagctcactgcaacctctacctccggggttcaagcaattctccctgcctcagtctcccaagtagctgagattacaggtgcccatcaccacgccctgctaacttttgtatttttttagtagagatagggtttcaccatgttggccaggctggtcttgaactcctgagcttgggtgatctgcctgtctcagtctcccgagggattacaggcgtgaaccactgcgcccagcccaacaagaactttctttacaaaaacaggcactagtgttgtgatggttgtacacttctgtgaatatagtaaaaatcagtgaattatacacttaaaataacagacaaaaaacaggtgctgggctgtatttggcccacagaccatagtttgctgatctctggtctaaacagagccctttgtatgtgccttttgcggaagtagactgtatttcctcaattttccatatactgcaaatggcaaggtgccctgttcaataaggaaacagaggcacaccctgccaccctacaccttttccatccatctttttcctttacactgccaagacactccactccacctgactgccccatccccacccactttctccttatttctagagtacaggacataaacatctttgaatctgtaaataatgtgaataattttcctcaaaaatcaagctttcatgtttgaagaagagtttattgtgacttcaaacataaactgtaactggtaataagcgaagcagctatggaattatacaaggcaatccaatctaacaacacggagcacattgaagcgcaaacatcaaattttaccttcttcctcctaaaaactttattccctaattacatccatttctttctttgtttctttcttttttttttttcttttgagacagagtctggctctgtagcccaggctggagtgcggtggtgtgatctcagctcactgcaacctccacttcctgggttcaagcaattctcctacctcaccctccaaagtagctaggattacaggtgtgcaccaccacccctggctaatttttctatttttagtagaggcgagctttcaccatgttggccaggctggtctcaaactcctgaccacaggtgatcagcctgacttggcctcccagagtgctgggtttacaggtgtcagcaaccgtgcccagcctacacctattattttctattaaaaatgatgtttttcaactctgtgtggtccaataggaagaagaaatacacaaaccataaacaataaatacaaatcaagagcagggccacgtcaaattacttaaaaaaaaaaaacacacgggctgggcgcggtggctcatgcctgtaattccagcactttgggaggctgaggcaggtggatcacctgaggtcaggagtttgagaccagcctgaccaacatggtgaaaccaagtctctactaaaaatacaaaaattagcccgtcgtagtggcaagtgtctgtaatcttagctactcgggaggctgaggcaggagaattgctggaacccgggaggcagaggtggcagtgagccgagattgcaccactgcactccagcccagttgacaacagcatgactctgtctccccaaaaaaaaaataaaataaaataaaaaaaaaaaaaagtccccccaccaccaccaaaaggaagactacaggttcagtatcccttattcaaaatgcttgggaccagaagtgtttcagactttgtatatgtttggatttgagaatacttgcatatatataaaatgagatatgtgggggatgggacccaagtctaaagacgaaattcacttatgtttcatagacaccttctattcatagcctgaaggtcattttatgcaatattttaaataattttgggcatacaacagtttggactcatcacatgaggttgagtgtgggattttccacttggggcatcatactggtgctcaaaaagtttcaaattttggagcattttagatttaggattttcagattagggatgctcaccagtaagtgttatgaaaatattccaaactccggctgggcatggtggtgcccacctgtaatcccagcattttgggaggccaaggcaggtggatcacctgaggtcaggagttcacaaccagcctggctaacatggtgaaaacccatctctactaaatacaaaaaaattagccaggggtggtggtgcatgcctgtaatccgagctacctgggaggctgaaacaggagaatcgcttgtacccgggaggcggaggttgcagcgagccaagatcgcgccattgcactccagcctgggcaacaagagtaaaaacactatctccaaaaaaaaaaaaaaagtattccaaaatccaaaatcgaaaacacttccagtcccaagtatttcagataaggaatattcaacctgtatgaatgttcctagggaaaaagagacagccaaaatataagaccatgtataagaactaacttcagtacacagaaagaaaaaagtaccaggggaagaagaaagagaccgcattttaaaacaactatacaaatttgagctgtaagaaacactgacattttctgtaagcatgctagagcaaataggagaaattcataagacattttctagaaaataaaactaatataaaaaaacttatcaagatttgtcaaggaaaaagaagaaaagttaaatataatggcaagaaaacattcctaccaattttatttatccaggcatgtcttaaatatggctgtttgttacatacagtgattctgcagacatgttgacataacagtgaaatacataaatatgtaatgagaaaaggcttaactgttgataaaacaaagtcattacaattaaaggctcacccctattagtgagtttttggcatttccaattgtagtcagggcactgaggtcaaatttaactacaaattttgcattgtctacattgaacacatgattcttaaaagcctcatgttttatttcagaacaggactcaggaagttgcagactgtgcaggaggttgtttagggcacaagtcatttctcccaatattaacttataggcagtctccaaaacaggaatattcttcaagctgagcactgcttgataaacagcacgggctacagcaacaacctgaaaaacaaaaaattcaaggaagtgataaatggaaaataaatcttctaaaattatatggaaaataaatcactatctgtattagtgctgatgatacaaataaatttaagatcgatcaattcactgtctgtagcatttaatattttaattttttaaaaaccaatcagaaaactgacacagatcagtatgctatttcaaatctattaagttttatcacaaataaagagtactataaatgaaaactgtcaataggaaatttccaaaatggccgtttttgttttttttttttaataatcaacatcaaaagacatatgcaaacagcagtttaagactgggtttcttaaatctaccaggaaagtctgtggtggatttgactagggggtggttgaaaagccagtcatttttgtttaccaaatatacagtacttcttaatttataactttataaatgtgtcaacttgttttacccttatgaaaatttaataaatttaataacagcaaaagatgcatagtctgaaaagagtatctggcacaccattcatgaaagtattcagtatgattatcaagaaatataaatttaaaagaacaaatacaatcactatattctaaatcaaacatttcacatttcactcaatttcacttatatagcctggggtaagcaacattaggtccaactcttcagtgactcaagttgtcaaaattcattatcagtgtattacttacctctttttctttatgataacgcaagaatagtagtttagatgatggtataaacagtttttctacaaatgatgatggcagtttcgtatttatctgttcaacaatctaaaagaataaaatttttaaaaaatgagcttctcaaattacaaaaagacatggagaaaccttaaaggcacactggtaagtgaaagaagccaactgaaaaggctacatactatatgactccaactacatggcattctggaaaaggcaaaacgatggagacagtaaaaagatcaggggttgccatgggcttaagatggggggagggaggagtggggagagggaacgaggaaggagtgggtagaacataaaagatttttagggaagtgaaactatcctgtatgatactggtaataggggaaacatgtcattacacatgttaaagtccatagaatacataacacaaagtaaactataaaattagttaataataatatatcaatattcactcctttgtaataaatgtaccacactaacacaatatgttaatgagggggaaactgttgggatgaagaaggtatatgggaactcactgttttctgctcaattttctgtatatctaaaaaatgaagtcttttaatttagaaaaatatatctaagctatattttaaggccttaatactgtgacattaaagtgtttagacacctaaataggacacacgtattttacagttatcatgggcattttttcacattagcaaagagaggtgtaattctggcagaaatgctcagcagaatgtcatctagaatttgctgtaaaataatctagttggagatgaaaggatagcaaagaggcctagatgaaaccagatgggccatttgtttctaattatagaagctgagtgttaaatatgtacaaatttattatactatgctccctatttttatgtgcttcagaacgtccataataaaagtggggggaggatatttatggttaagaaattaaaggaggccggccgggcgcggtggctcacgcctgtaatcccagcactttgggaggccaaggcaggcagatcacgaggtcaggagatcgagaccatcctggctaacatggtgaaaccccgtctctactaaaaatacaattgtgccactgcactccagcctgggcaaaagagcgagactccgtctcaaaaaaaaaaaaaaaaaaaaaaaaaattaaaggaggccaggcatgattgctcacacctgtaatcccagcactttgggagggcaaggcaggaggattacttgagaccaagaatttaaggccagcctagacaatgtagcgagaccccttctctccaaaaaatataaaggttagccaggcatggtggcatgcatctgtagtcccagatagtcgggaggctgagtgggaggatcacttgagcccaggagtttgaggctgcagtgagctctgattgtaccgctgcactccagccaggggaatacagcaagatcctgtgaccaaaaaaaaaagaaagaaaagaaaagaaaaaaagaaagaatctggtgcgtagagcaatgtttcctcagaaaaaacgagtaaagctacactgagactagctatcaaccactaaaaatagaggcctggcagagtggctcatgcctataatcccagtactttgggaggccaaggcaggtggattgcttgagcccaagaattcaagaccagcctgggcaacatggcaaaactccatctctacaaaataatataaaaaattagccaggtgtggtggtgcacgcctgtagtcctagctacctggggggctgaggtgggaggatcacctgaacccaagaggtcaaggctacagtgagccaaaatcatgccactgcacttcatcctgtgcaacggagtgagaccctgtctcaaaaaaaaaattgcattaaaaataaaagtaaatagacactaaaatgaaagcatagattataagactgatgaatgtactctaaaaaaattatataataaagcaaagcccttattttttttcttttttggagacagggccttttttgtcaccttggctgagtgcagtggcacaatcagagctcacttcaacctcaagttcctgggcttaatcgatcctcctccatcagcctcccgagtagctaggactgcaggtgcacaccactacaccaagctaatttttgactttttgtacagatggggtctcactacattgcccaagctgtgccagaattcctggatgcaagcaacccttctgctttggcctcccaaagcgctgggattacaagcatgagccaccatacccagacaaagcccttaatttcttacatatccatttaagggcctgaataaaccaacacattaaaaaggaaaagaataattcacataccagcgtgagtaaattcaagactgagatgatataatcggtaccacaagtctggcaattctccagttggtctaatccatatgtaatgaccatgtcacaatgtatagtcatgctaggatccaagctgccgagcaaaacaccaacacgctcattagcagctgtcaacacagcctcagaaaaaaacacctggtttgcagccgtcacacatctcattactctgtacagcacctgtaaatggggaaaaccagcagctttttaaaaaaattcacgtgcttccacaaagcaagaaaatactttttatttaatgcaatttcaactgaaaattaactgcttgccttgccagcagtctcttaatattctagttctcagtagctgaataatgatgatacctttactacaatatgtaaacatgatcttggctaaaaaatcctaaagtgctactatgacaggaaatggaatctgccatcctctatttcccacatacccaacttcgtttctcccaatgtcactaaatggctgaagctcagaatctttatcatgaaatacaccacgacagtaatggtattgacagcatgggaatagcctgcccacacatactacaagctagctcttgggcttttgggaatcaatctttcaaaactgaacatacaagtcactttaagcttattaaagtttctatctactgatggtctcttttgaaagataagcactctcatgcttgccacataatatcttcaaaaatcatattatttccaatacacacacacacaaaatcccccacttaactataatagccaataattgtgtactaaatttctaataaaataggggagaaaacagagcaaatgttaaaaaatatttctataatatttaacaaccaatacatacaggattttatttagtctacccatagttttcattaaaagtatccttagaggttgggcatagtgactcacatctatcatcctagcactttgagaggattagctggaaggttctcttgagtccaggagtttgagaccagccatgtcaacataacaacacctcatctctaccaaatttgtttctaaattagttgggtgtggtggctcacaccagtagtcccaccaactacttgagaggctgaggtgggaggatcacttaagcctgggaggtcaaggctgcagtgagccaagatcgtgccactgcactccagcctgggcaacagagaccatgtctccaaaaaaaaaagagttggggggagagggcggagggggaagcattcttggccatgcatgcacagtggctcatgtctataatcccaacactttgggaggctgaggtgggaagactgcttgaggccaaaagttcaagaccagcctgggaaacactgagaccccatctctacaaaaataaaaaattagcaggagctatgctgggaggatcacttgagcccaagagatagaggctgcactgagtcgtgatggcaccaccccactttaaaaaggaaaaaaaaaaaaaagctgggtatggtgacacccgcttgtagggctgagtgaggtgggaagttcacctgggcccaagagttcaagactacagtgagctatgattgaactactacactccagcctgggtgacagagtgaggttccagctccaaaaataaataaaaaaaataaaaaccccaccattctaccattctcaaaggcctaaaagatcctcataaatcaatatacacctatcctataaattatgtcccctttattttatgtctgaattaacggctttttatttcaactctgtacagtcttcaaacaaccaccttttagacattaaaaatgaagcaaagatattaaaccattttgaaaccatattggtttaaaataccgatatgccggtttcatttatctttaagttctgacatttctgctcaagtacacaacttactatataatcaatatcctattttatttagcaacatgttcagcaaaagtatatgctcctaaaagcaagttttatcctaacggtaaaattttcatcagttagattaaattttttatgactgtatcacacatgcttctttctccttattcaaagcagagtacaatgcctggggttcatttcttgtgtcttttccactgaaccctcactggatgtgctatatacagtgcagctaatgtctgaggctgctgaagtgtggcaatctagctacctcatttttaatttgtttatgttctttgatatcaggctatcaaagaatataaagatacacaagttttcatatgagttccatcttatgctcagagaagattactttctgaggcttctcctatagtgtgctattcgtaatatgttgaaaaactaaaaggaaacccaataatttaaaagtaaaattataagaaatattatttaaaaatgaaagaatgagatttaaaaattcagagtggccttttgtcatgggagggtaggggagttggatgaaaggaggatgagctataacaggattccctgcttttctggttgtttaagaaagcagtcagacaatatatacatatatacatacatacatacatgctaaacaaatgaaggattaataacagttcacctggtaaagagaagcatttacaatgtaaaacaattttatttttgaatgacacttcaaatgcccaaaagcacttacatctgttacgtatgcctcagtaattggagggcccgaattgggctgaggctttccccagtgctcctcaccacagtactaaatacccggagaagcgcagccagctttggtaatgacactgatggaggagggacgtcttcatccactgattccccagaggccacatggctgaggtcctagatgtgaattcacagcattcttaataagtagtacattgtttaaaaaaacaaaacaaaacaaaaaaaaactctaaaatatttcaatcaattcattttagaatagatttttaggcttttagaaagagaactgtggcccatgagaatattcatgactctgaatataaaaatgggttttacctaattatttcaaaaagccaacattaaacccaatagacaacaaattaaggaaataatctcttaaatcaactcagaaagctgttggggaaaaataaattctagcacatatgctctagttatatgtaggtataaatgaagacggaagcttttgccactcctgaattagtttttggctaaaaatctcattctaggtattctttgagccactcagctcaacagtaagtcctccaaaccaagagcatgcacatgaagagcaaagggagattacaagacctggtctacagatgtgtaactgaagaagtacgatatatgaaaaggacaagattcgcaaaaactaggataccagaaccaatgtatacatctacctaaaattaagcaccaaaataacagaagagaatgagatcttaaggataacaaggggaagcatctctacaaactagaatgtgtggcttatgagaggtagatcagctttaaacgtgggctgtgaaaaaagacattctaggtgtgggggcaaagaaaaaacaacgcagaagcaaaacatttccttgcttttctaggaaagagtaaacacatcagtacagctaaaggtactgaattcctgttgactacaagcagcaaagatgaaaaaaacaagatgaggccaaaatctttatgggagccttgactggttgatctgaataggggagaaacacaaagagattcagataagagatggcacagagttaagccatgacagtggggccagaaaagccaagtaccagtaacagaggcttcagcagcgctcttaaagctcctatgctatattcgtacagccacaaaagctggctgaagccaaggcttgtcctccaaagtacgattcaagatctcctgtacatatgtaagaggaaaatctttaggagcttttggtgttttgtgtttttttataacacaacatcaatttgctttaagactctgaagactgggaacaaaaaataaaaataaataacaaaatatgtctttagaaaaataccagctaccgagagtatgtaaagctttgcgaaatacgaagcttgcaacgtttcttttagtctctccagtaattctcctggtaacttaaacacatctgaaataaatgtttaaaatactgactgggcacgggggctcatgcctataatcccagcactttgggaggccgacgcggctggatcaccagtggtcaggagtttgagaccagcctggccaacatggtgaaaccccgtctctactaaaaatacaaaaattagctgggcgtagtggcgggcacctgtaattccagctactcgggaggctgaggcaggagaatcatttgaacccaggaggtggaggttgcagtgagctgagatcgtgccattgcactccagcctgagtgacagagcgagactccgtctcaaaaagaaaaaatttttcaaaatattgcaatgggcttgtaatttctgcttaaatgtcaggaggtctgagccattttaaaataaatctagcacaatttaagattttttcttaaccaaaattttaagaaacagctttctatatactcacctcagcatatgcttccatgtcttctagaaactgaccaagtagaggcgtagaaaatgcaagatcagctacccaaaatggctccaaactctgcaaccacccttggaatcgcgtaagaaattgtgaaagggtaggggggagaaaaaacaccaaaaaatccaaattaaaaaatataagaggcttcttttaaaaagtatctggttttcaagcagcataccctaaaacatgtcctatatcataaaattaagactgctaaacatgctgatcacgattaaccaatacctctttaattaatacctccttaatttctgcagaaattaacaggtaaatgttatttccttactttttcagtaaatttcatatctatattgtcactacacatgacttaagactaaaatgccacaatctaccattggcccggctaatcccagggccacatctaaccattaaaggtgtatactcatctcctcagtgaaaatgaaacagaccactatcacctgaatatcttattttcaaaagtttattacaccaagtaagttacgagaaactatgacacttgaaacaagctgaaatgtgcaaatgagccacgctagtcattcacttaactccaaaaaagtgggaaacaaaaccacttctcatttatgacaattctccaaattaaccctatatttccttttttaaaaaaataaccagaaaaacaataaaatgtgacaaataacttggatcttccattgtccacttcagggtattgccactgcaatatattcttaccatatactttcctaccagtacaaactacaaataacttgggtaagtcctgtctgtacttactctacccacctactagtaatttcctctgaaaatatatatttagctaacaagtcatgttcatttacaataaaacatttctctgaattagttttcttgcattattaaagaaatggtattgatagatggtcactgggggaccactgctcctccccgacagtatttaaataactggtataggctgcaagacttaccagatacctgctgcgtgagcgaaggtttctgagtatgatctctatgccatccaactaatataccaactgtatccttgatggaaacaaagagagagggggccaatcattttaagatattactgcaatccacctgtggaccatttcacagcaaaagatcctaaaaggagcatctatgttctacctacttgacattctagaaacttagaaaggggagaggggcaggaaaataaaagaactacatttctgacagcaatgaaatagtttattttcttcaaatattttaaggtacgaacgtcagaaagaaaaatgcggcatttaaccctggaacctcaaatatcactgattatattcaaaggagcagaggcactgttttccatctgattcctcagttcctcacacacacaaccatccccctcaccccatgatctgaacagcggaatgaggaactcaccctaaaattagtgctgaaaatatgagggtaacatcgagccaccaaaagaatgcacttaacacatttgcaaagcaattctggtgtatccacattttcaagaattgactgcaggctggtcattacaagcttaaaaataaaagttacaaaccgtgaacattcaacaaaatagggagaaaacaagcaaattaggttcattatttacgaagtgcctacataaaaacctgagtatgagaccaagaaaaatagattctgtagttttagttaaaaaaaaaaaagaattgacttgtaaatcccaactgcttgggaggctgagacacaagaattgcttgaacccaggaggcagaggttgcagtgagctgagattgcaccgctgcactccagcctgggaaatacagccagactccatctcaaaaaaaaaaaaaaaaattaataaataaataaaataaataaactgaaaatatttcgctccactaagctgttaagctaaaaacagatactgttttctcttcttcaatgtttgttaatattagtcctttgacatcagttaacattagtccttaataacatctgtttacaatatccctaaatgctctctttaagattctacctgtgattaaatttcaaatacaaaaaagtaaaatggatttgggaaacttttctataaagtacaacaattactttgcaatccaaaatataaagcaaattttatataatttatgctttagtatattagtacttgcttcatattaaaattaaggaagatcagtatggcaccacacatgaataacatgcaggctcaggttaccattatacataaatttttaaaataaatatatggcaaaaataaaataataaataactatttgtcattccattgaaagaatatttattttgcagctgttaaaaaacatttttccctaaaaaaggaaaagctgtgctttacatagcaatcttatcaaagaaatgctagaatcagaaaaccatcattttaggctgggtgcagtggctcacacctgtaaccccagcactttgggaggacgaggcaggtggatcacctgaggtcaggagttcaagaccagcctggccagcatgatgaaactccgtctctactaaaaatataaaaattagcagagcacagtggcacatgcctgtaatcccagctactcaggaggctgaagcaagagaactgcttgaacctgggaggcggaggttgcagtgagccgagatcgtgccactgccctccagcttggacaacagagcaagattacgtctcaaaaaaaaaaaaagagaaaaagaaaaccattattttgcaatagccaatgttataatctacacaggcacagactatcaatgctaaaaatcatttaaaagacatcttggggtaattacagaaatttgaatatagaacacatatgtaataaaattcattttcttaggtatgattacaatattcttgttatacagaagaaaaaccttattcttgggagatgcatactaaaacattatggggtgaactgtcatcatgtgtatggttttcagatgctcaacaaaagtgtgtgagaaaataaaactgtggcaaaatattagtaactggtaaatctaggtgaagcatatattatgaaattattatcgtatttacaggtatttattttactggtgcatctatctttctatgaatgtgagaattttcacaagagctgggaaaatgttcataattatgcatgcagaataagcccaagctggtggcattctgttcagttacaggtaattttctgaatcttccctcaaatttttctcaaacctctataatcaaggggaaaatgtttcattttgttttgcttttttgagacagggttgcctataatggagtgcagtagcttgaccatagctcactgtagcttcaacctcccaggcacaagcgatcctcctgcctcagcctccaagtagctgcgattacaggtgcatgccaccatgcccaacttattttttttccttttttttttttttttgtttgatagaaacagggtttcaccatgttgctcaggctggtctcaaactcctggactcaggcaattcaccagcctcagcctcccacagtgctggggttacaggagtgagccaccatgcccagttaaaaatacattttttattaaaaaaaaaaaaaagaatattccttatatttcctttatattttttaaactacatacccaaaataaagcatatcaaaaactgtaaaaaaaaaaaaaaaaaaaaaaaaaaccctaatatcagatattccaaacacaacaataccataatttaatcacttaaaatcttactcaaaactaaatcaatgatcttttaggccaggtgtggtgactcatgacactaatcacagtactttgggaggccgaggcaggaggatcacttgaggtcaggagttgaagaccagcatggccaacacaatgaaaccccatctctactaaaaatacaaaaattagccaggctaatggcacactcctgcaataccagctactcgggaggctgaggcaggagaatcacttgaacctgggaggcagaggttgcagtgagccgagattatgccactgcactccacgctggacaacagagcaagactctgcataaaaaaaaaaaaaaaagaatgatattttaatatattcagatacacaaatatgaaatacaactaagtagagccggtattcatttacacataattatcttataccatttggaataagaatttggggcacgttagcaaaccaaaaggctcagaaagaagttgtgatatttagttcttgtctccctctacaaatgtgaagcactcttctatccggcattactagtggagttcctattttcaactttgcaaattctggtcctaagcaatctcaaaaaaaacatttctaaaaaccaaaggggaaaaaaatctttttttttttttttttttttttgagacagagtctggctctgtctcccaggcaatggtgcgatcttggctcactgcaacctcggcctcccgggttcaagccattctcctgcctcagcctcctgagtagctgggactacaggcgcgtgccaccacgcccggctaatttttgtattgttagtagagacggggtttcaccatgttggccaggatggtttcgatctcttgacctcatgatccgcctgcctcagcctcccaaagtgctgggattacaggcgtgagccaccacgcctggcgtgtaagccaattttttagaagaaatctctccctctctctccacatatatgcatatatgtatgtagcactgatccttgaacagtgtatcctttactcaaactgagaaagaggaatttttaaaacatatttcctatcagtagataacccctattctatgattcccttcttcaagctcccctccaaggacatgtgttaaagggacaattttcttcccaagtatatcatgcattttttcccccttcattcttacctgcattacagatgaaaaggctttcttttctcctacagtctctagtgctttgtaggtggcacataagtagaggagtttaacttcatcttttgcagatgagctaaatttgctaaaaatccacttgaagatcttctcagcctcatagctcagagaagcacaaagaaggccgagacagcaagctccctcctgtctcaactcctgaagcaatttgctactgtgtttattttaatgcaaacaaaaaacacacacaaaaggcttaagttttctatgatgacacgagtaatacatcttacaaaagaatgtcttaagtggttttttaaatttctattcaaactacataaaaggttgaaattttctccactctaaatactacattctgtctagcctgcattgccctcaagtatctgtctgacatcactttctttttacaaaatcaattatttacaaacagtgagggaaggcccaaaaatgctaaattccatctcaaactgtattaaataactctcagaaaagggcagcaacaaataagtagataaaacactctatacataactacattctacataatatccaatatgtaatgactataaaataaaaaatggtaatagttaaatacagaaacttaaaaggataacagtaatgatttacatagaactttaataagtaactctataaaacaaaaccatcaaaaggcactaaggtttatgaccagctgagataaattttgggtacttgccaacactgcaaatctttgggaatcaccataacaaaaaatgaccacacacctctggagactctaatagccagagaatatatggtttggatccactcttacccaaagaaggaaattcctttttacctctattctctaagcagtttcaaattctcttgtttacaaaaactaattttattcttcatgcctgcatcaagagtttatgccattccataagtcaagactcagttatccagtgagactagcaaattaaaaaaataaaatattccagccaggcacggtggctcatgcctgtaatcccaacactttggaaggctaaggtgggtggatcacctgaggtcaggagttccagaccagcctggccaacatggtgaaaccctgtctctactaaaaatacaaaaattagctggcagttgtggtgcacgcctgtagtcccagctactcgggaggctgaggcaggagaatcacttgaacccgggaggtggaggttgcagtgagctgagatcgcaccactgcactccagcctgggcgacagggtgagactccggctcaaaaaataaatattcttttcaagtggattccatttgtattcaaccgtaattaacacataattaatgcagataaaaatgacaagacccactgaaatgtcaataaatgttcataaacaaagccagtgggtttgtcttcttgtgtattgttaagtaatttctaaaaatatattttaaagtcatttaaaccgaaccattattagttacttacctttcattaagcacatcatgtacagcagccaagatatccaattgtttaactagtacctttaaaagaaaacacatttataaaaacttcaaattcctatacttttaagaatagcattgtgtacttttttatttgtcttccctccaaattctaattcaacagtactttactttctttattattcccactccccaatgagcatgtatcaggaatgtcatgtttcctttcagcctatgaaagaaattcacccactggaaacatagagctgtgaccatcaacaaaaaaataaactcaaaaagcttgtttcatttactttgaaatccatttgaaaaattgactgacggatggagggatagatggagagatatgtgacaaggcagtatttagggtaaaatgttaacgacaaaaattagatgatgggtttaacagattcaatgtcaaattctttcaacttgctatatatttgaaactactcataataaaatttggaaggaggagaaacttgctttgatccaagtgtcatctgcctcactagaccattttcattaattttctcctgctcattgtcaagttctttttttttttttaagatggagtttcactcttttcgcccaggctggagtgcaatggcgtgatctcagctcactgcaacctccgtctcctgggttcaagcgattctcctgccacagcctcccatgtagctggaattacggtcatgtgccaccacacccagctaattttgtatttttagtagagatgggggcttcactatgttgggcaggctggtatcgaactcctgaactcaggtgatccacccaccttggcctcccaaaatgctgggattacatgcatgagccaccacacctggcccatatcaagttcttaattggtgtaaagaaagtgaagaaaaaaatttaacccttcctatactttgttacatttctgttgttgttttaagagacaaggactccctctgtcgcccaggttgacatgcagaggtgtgatcatatctcactgcaaccctgaattcctgggctcaagtgattcttccacctcagccaggtgtagtggcacatgcctgaagtcccagctactcaggaggccacagcgggaggatagcttgaatccaggagtttgagactgcagtgagctatgactgtgccactgcactccagcctgggcgacagagcaagatcttgtctttaagaagaaaaagaaattacatattagagagcattaagttcttgatcatcataatacagactttccccattcttaaactactcaaggtagcattacctagtttattatggaaacacaaaaatcctcatatttccaaacatactatacttaccagcttattttctggttgctgaataaattctttcaactgctttacagtagccaatcttcggtctcggtcgttttcccgggtgatcctccgaagaagatatgacagtcgagactcatcacaataagacatcgatctctctgtgaatatataaacattttgttgtccactgagtataaataagcaaaggaaattttaaattttaaaataattttaaaatttttaaaattaaaaattatttaaataataattaaattattatgggggctcatgcctgtaatcccagtactttggaaggtgggtagatcacatgagttcaggagtttgagaccagcctgggcaacatggtgaaaccctgtctccacagacacacaaaaaattacataaactagccagccaaggtggtgtgcacctgtagtcccagctactcgggaggctgaggcaggagaatcactggagcccgtgaggcggaggttgcagtgagccaagatcaccccattgcactccagcctgggtgacagagcaagaccctctctcaaaaataaaattacatcaaaagtcacagtccactggtcaataaaagctcagggaatataggtcctatcgctcttttgttcaactctgtattccaaatcccagcagagtgcctggcacataacagaccctcaaaaaaatatttgctgaaggaaacaagaaatgaataaccctaggccaactgaacacctcattccagaggactggctgggagagaaaaaagaaaggccttagtaacaactttctttgggtccattccaaactgttttcaacatgcaggtaaagagcccgggtgtaggtaaattaaacaacttccaaggggtatggataaagtctcaatcgagtaaaaacaggatataggcttctacttatcatctaggtatcccactggaggaaagcctcttattcacattatcatcatttccctgggatgaagttttggggagccataatcacacatttagttcaacaaatgtctaattatcatctaccacatgcaaggcatgcctccactagaaaggtagcaaaccacaacttttctccctttattttttaatcacaagaacaagcaaacaatagtgaatactattagtatattaacgatgcctttaaaaactagatttttgctgggcgaggtggctcttgcctgtaattacccagcactttggaaggccaaggcaggcagatcacttgagcacaggagttcgagaccagccttggcaacatggtacaaccccatctctacgaaaaatacaaaaattagctgggcacagtggcacatgcctgtaatcccagctactcaggaggctgaggtgggaggatcgctttagcctgggaagcaaaggttgcagtgaaatcacactagcgcattccagcctgggtgacagagcgagactgtctcaaaaaacaaaacaaaacaaaaaactcaatttttgcaaaacattttcaactgtgctatttaccataattagccaatacatacgtaaacaacaaatcacaaagggtctgacagtttcatttctaaggtatgagaaaaaattgataataaaagaaaccagaaggctgggcatggtggctcacacctgtaatcccagcactttgggaggccgaggagggcagatcacggggtcaggagttggagacctgcctggccaacatggtggaacctcgtctctactaaagatacaaaaaattagccgggcgtggtggcacgctcctgtaatcccagctactcgggaggctgaggcaggagaatcactttaatctgggaggtggaggctgcagtgacctgagatcgcgccattgcactccagcctgggtgacagggagatactccatctcataaataaataaataactacaagggggaacaacacacactggatccttttggagggtggggggtgggaggaaggagaggatcaagagaaacaaccaatgggtaccaggcttaatacctgggtgataaaataatctatactacaaaccctcatgacacaagtttaccactgtaacaaatctgcacttgtatcctgaatttaagttaaaaaaaaaaaaaaaaaaaaaaaagaaactacaatgactgagagaagaataggatttttacaaatccgtagcccatagagtatttcaataaggacagataccaaatatgtcatcaagttaccagctgggaaattaggctctacttacaattctgtcactagcaaactacatgaccctgagcctttgaagaagaggaattctctactgaactactttagaatcgctgtttagcttctataatatcataagtctaaggcttcaaacactctattttaacaaacagcatacatagcctttgaattcattccacttgtgaaaacataaaaagaaatcagttttttaaaagttatataccaacaataaaagctacaggcacaaagattttcaccaagatacacgaagcacacacacagtataaaaaataaaaaaaaaaagtcaaaaactaaacgtccaaaaagtaattacatctgacaaagcccataactcagctttaccgataagtttctctttaaggaaaaaaattatcattacctctaatcctctgaactttcttttttgttgttgtttttttgagacggagtctcgctctgtcgcccaggctggagtgcagtggcgcactcagctcactgcaagctctgcctcccgggttcacaccattctcctgcctcagcctcccgagtagctgggactacaggcgcccgccaccgcgcccagctaattttttgtattttcagtagagacagggtttcaccgtgttagccaggatggtctcgatctcctgacctcgtgatctgcccgtctcggcctcccaaagtgctgggattacaggcgtgagccgctgcacccggccaatcctctgaacttccaaggcactcacctatacagtgaggctatgtcataaggcagaaatgctatcagtgtatttaactttagaaaagtgcccactcaaggcagggcccggtggctcacgcctgtaatgagcacgtgtgatcacttgaggtcaggagttcgagaccagcctggccaacatggtgaaaccctgtctccactaaaaatgcaaaaatcagctgggtatggtggtatgcacctgtaatcccagctacttgggaggctgaggcatgagaatcacttgaacctgggaggcggaggttgcagtgagcagagattgcagcactgcgctccagcctgggtgacagagcaagactctgtctcaaaaaaatatattgaaaacaacaacaacaaaaaaaccagaaaagtacccactctagggggcggggggaaggagagcatcagcaagaatagcttaatggatgctgggtttaatacctagatgatgagatgatctgtgcagcaaactaccatggcacacgtttacctacataacaaacctgtacatcctgcacatgtaccctgaacttaaaagagagaaaaaaaaaaaaaaaagacagaaaagtaccccctctctacatatatctatatcctccacaggcccaagagttcaaggacttgctgtagtaggagcctactatgcactatacattcaatatccacgataattgggtaaaccttttctgtaagatcttatccagtcttctaatcttgttttaagagaattctcttttaaaatgtactatagcctttctagtgggaaattaacaattcacaggaaaagaatgtaaacaatttttacctgcacagtagactaatcaacttatgcctttgcaaggcattagtaagaggcatccagaataagaggagatacaagtctttggaaggtgtatgtgattggtccccgttttcccagccttaccctgtgatttcctcatgtctttggtggctaaagcacaactgccatgctgaacactggtgaactcagggctggtcacattgttaaccctcagctcttgccccaatgacttccgaccataagtattttccccagatcccccattgacaccgtagccacctacaaacagccatgtgtacgtcatttaaatatgattgttcgtttcattcagtcaatttcctgatagctcaggatcttatgactcaatctgcagctcaaccagcctttgcttctcctacctttttcctgtactgtctgccttgaaaatcattttcatttcttttaatacacctttgaagttaaattaattttattttgatcccttcattggaaaataagcaaagaaatgaaaactaaattaaatcaaattttgcaccttgttttaaaactttcttgaagtttagagacagtagccaagaggaacttcaaccttagctaaatatttttgaaaataaaaacaaaaatagtattgtatcttttttgtaagaaaactgcattgatgaattatgtatggaaaaattttaaattttaaaaataataaagtggataaacgtcctatgaagttttcagaaataacactgcatttgttattcatattttaaatatattagaagaaagtgagaaagttgggggtgtaagaaggcaggaaggtgggataggtaggttcaaaaaacatgcttgtagcaataagaaaatatatatacccttttcgtcattctgtatgtcagcgtggactctggtatcatcgtgcctttgccgagacaccacagctgaatttgaaggttgcagtccgtaagaggaagaaccacctctatctctggatgaagaatattttaaattacctgggtcggctgatgcactatcagttctataaaaagagaaaagtttaagattagaactttaaataacataaataaatctttctttaaacaagcctctcttctcccaaattttacatttaaccattactattgtatttagtgtaatatgcactatatattatatgtaagcactcagccgtctaataagaagtctttcactgggaagagagtctcaatggatgaaatgccaacttttcactctcttctactgttctaaagacccattcagaaatatgaataactactgggattagggtgactttgctggttttagcattgaaagtctcctgttccaggcaaaacaggacaattggttactctggtccagtgttctcctcacatgacttgataataagaataattctttctaattctcccccatggagacggttaatcagtcaaaacatttcagcctttcctgtcataaaaataaaaaacactggcagcatgtcagggacgggcaatgtcttaccaagttattttctaagtactgattaggtactgtagtattgaagaccccattgaagatgccttaattgtaaagagtagcaatcaaaattttaaaaagtaaaaaagaagacattttaagaaaataaaaggtatcagaaatgcaataaagttatatcagaaagttgtagttcgtaatctatttaaaattcaggtactgtttagaataatacctgatgcttattagtaaacaagtagggtacagccaagggtaaaagtgtgtcctcatctaagtatctgctctatgcttcaactgcctcataagtaaaacagagctgagttacaagacttctcatgagtgttactctttcagccatcaatcataaactatcaagaaagaagacaacaaaataatctgttatagcatatgaaaaatccaagtaagttcttcccctactgattttctcctgagaggaacaattttgaggaaaagaaaaagaaaaagaaaaagaaaatcacttctatgatatttactaaaaatgctttctcaaccttttagaacctgaatcttttagaaaagtttaggacactggcaaggccagaaactaacctattcctctacgctttgcccctccctctatggtgtaaaagtgacagcagtgtttgtatactgtatatatttcgtttagagtttattagtctttccttgctcccaaaaatactaaacataaaactttgcatgagctcaatcagttggacaccttgatctgcacttactgcaatcactgttaatacagaatgcagacaataggtccaattaaacttggatatctaactggtacaagtcattacttataaaggatctcaatctgaaacttcatgaaattcaaaacctagcatactaaaatgactaaggctccataaggagtatcttctaatattcagagttcacttattcataaagctaagtacttcgaacataagggaaaataaaatctatggaatttcaagaaaaatgtatgagaatattttctgagtatactaagtctataagcattaaaatattaactcaatggaccataacttttttaaactaatgaaaagacattccttatgtacctaaaaatagcacatttaacatgcgtctatataaatcatagcataccattactttctgaaaggagactgaaacgtaagagagcttataatcttttctgacagggtttgaactttatatgtatgccacagtaagctcttattagatgagcgaataaaataagcacttgactaattcagaaacacaaagataactgaagtctgccaatatttaaacgtatcttcacttcctgttttcatcatgtttacttatctcctacactacctttactattaagagttaaatgtttgtatcattttctggtgacacagtagtaccataaggcagcagagaatacaagttaaaaaaagatctgggctcaaatcccagctccagcactgaaaagtatgtgtgcttttgcacaaattacttgatctccaagccttggttgtctcttgcataaaatgaggatgatacctatctaacatgtaaggttgttgtgaggctaaaataagataatgaattataaagaaacacttagtttgcagggtatgttaaaagttgttatgaccataatacaaaataaactcaaagtttccagtctaaaagacaatgtacaaacagttcatgagtatatgaatataatcaaaacaagtttttacagtcaatatagagcaacttaaatacttcactgaagaaagcaggtaatctgttgctaccaacaatgtgtttccaactaggaagcatctgatttcaaactaaactgtaaaaccaggagcagcttccccgttggttagaaataaggtttctaaatcccctaagttatgaacactgagatttttttcccaaaaaaaatctgtgttttcagaaatataacaaaaaaaactggaatagagccaccgtctcagaaatacctcaaaactccctagttgccaaattattttaatacaaattgatcaaagcatccccaaccagaactcaggttgtaagcattctgaacctaaaagcacaaaatggtttagcatttataagaaatttctatttttatacaatcttgactgcttaggtttcaaaaaatgtcaatgtcaggctgttagcaccaacaagatcatcccagtccaataaatagagaactgttgaagaacggaaatgagcacttaaaatgaggcaatcaaagccacaaaatagaaactgcagatttgaactccaagaagcaggcatgaatgttaggctagttagttagaagagctgaaagggatatcatctgccagaattagtgtctcaatttagtgaaaaaagaaaatctatctgttaagtctaagaatcctagcaaggaaccaaaaatacctctacagcccctttaatattctaaaaatatcatggagagaaaaaaaaagaaatgcataaatttccccaaaacgatcaaactgaagttaaagcctgatgtacatgccacatgagaggtaagtttctaaagctcatacctcaaaaatcgcctttgtgatgttgtgcatcaagtcaatctgtaagacagtagttacaatattagtgaagacagtgggttaaaacatttgttgttcaaacatggagcaaatatcattcatgagttaggtgcctttagttgaactatggtcccattagggttcatacattaaagcaaaaattgaggtggaaagacactctgtgccttacaggataaagaggcttaatgtggcaaccaaaaaaattttagtacataagagaatttaaatgttaactatcacatacaaatcacatgcaaatacagttaccacttattttagttacctattctcaatatacagaaaaatgccacaaatctaggaggccattcgtttcaaatgaccggaatccttagacctcacaccaacaagccaccatgtgctggggatggtatcgcctgactaaatgtagccttgcagtccattcttgtaagtattagagagaaaaagagagagagcgtcatctctggaaagtgtgaagtcagggaattccctactaggaagcatttccataaagcaccccaaaatgacttgatgcaaacaccacacctagtggtgtcactggagtaagcatcatattacttcaaattgcttttacctaggtttattaagggattttgctctcatggtgagatctaatttgtaatggatataaaccaggaaatgagatttgcactaaagccaatgaagtaggaatgtacttattctctaaagcagcaaagatagtctcactgtcacagagcagttataggatatgttgctttccatactaatggttaataccacttggaaatgatttacccttcaaaaataaattcaaggttttcccctgtaatgcctcttgcctggattcaaacatgctttaatgaggaataagagaaacggtgaaactatgaataaccctgggccttgtatcattacattagaaacactgctctaaatatgagtctatggctaaaatattaatttgagaggctcagggaatttattatacaaatctcttcttgcagagaacttttaagttcaaatttaataaaacaaaacagaaccattccatgtcaaaattgtaaatgagtatgcatcagttttgcaatactgaaatattaaattaatataatttattggtaaaactaccttagctacctaagtattaagtgtctataataaccaaatcttaattatccatttatgggtgatttgtttccttttttgagacagggtctcactctgtcacccaggctggagtgcactggcatgaccatagctcactgcagcctcgacctcatgggtgcagcctcgacctcatgggttcagcctctcaaacagctgggaccacaggtgcatgccactccatttagctaattttttatttttatgttttttggagacaggtgtctgattatgttgctcaggctgctctcaaattcctggactcaagcaatcctcccacctcagcctcccaaaatgctaggattagaagcatgagtgaccacatctggactgtcaccaatttttaactgtctgtcaactaaacagccaatatagactgataaaatatatttaactattgtaaaattgtaaagaattgtatcttcaccaaggagaggtctggcttttacctgtgaattctggaaggtaatctctaaactcttgaaatgtcatacctaataagagggtcctggccaggagcagtggctcacacctgtaatcccagcactttgggaggccaaggcgggcagatcgcttgaggtcaggattctgagaccagcctggccagcatggtgaaacctgtctctactaaaaatacaaaaattagccaggcatggtgacgggcacctgtaataatcccagctactcaggaggctgaggtttcagtgagctgagatcatgccactgcactccagcctgggcaacagagcaagactatctccaaaaaaaaaggggggggggggcggcggtgggggaaagtgtccttgttcatctgggggctttaggccacagcacagtctaataatgtggcttatggtgggggctttgagtcacatggatcagcttggcctccagtggggctggagactaaggttagccacatgggcatgcaaccatggaaccccagtaaaaacgctggacataaaaaatagagtgagcttccctggttggcaataatccatgagtatggtcgcacaccagtgccaccaggaaggtgtcatttttcacaactctacagggacaggacaattagaaactccaacatttggaacttccccgaactctgccctatgcacctctacccttggctcgttctaatctgaatccctaaactgcaataaactctaaccatgggtatgagagctttcaatgagttctagtgagtcctcctggcaaatcatccaacctaagagtggtcttggccaggcacagtgactcaagcctgtaatcccagcacttcgggaggcccaggcaggcggatcacttcagctcaggagtttgagaccagcctggcaatatggtgaaactgtctctaaaaaatatagaaaaactagccaggcgaggtggtgtgtgcccacagatccagcaactcaggtggctgaggtaggaggactgcctgaacctgggagggaggagttcagggcgcagtgagccgtgatcatgccactgcactctcaccggggtgacagagagaggccctgtctcaaaaaaaaaaaagagtggtcttgggaacccccaaacttgcaactagtattagaagcaagggtcatcttatggactggactccctcttactctgcactcatatttaaaaccattaaatatactgtagctcaaaaaaagttgcttgtttgttttgaaaaagggtctcacactgtcgcccaggctagagtgcagtggtgcaatccgagctcaagcaaacctcccacatcagcctcccaagtagttgagaccacaggcttactccaccacgcccagcaacttttgtatttttttgtcccattctctacaacattcccaaaatgttgcccaagctggtctcgcactcctgagctcaagtgatccactcacctcagcctcccaaagggttgggattacaggcataagccactgcacccggccataaattttgttttttaataacatttccagcaaacatgataaagatttgacttcagtgttgcttattttccttccaaggaacctctaatattctctactttcagaactccaatcaaattagccagaaagagcaaacgaagccaataaatccaggagggcaatagatctgattttaacccttgtttcacatgcacaattgtcttcagagaaaagctgaagaaagtaccccctcacctccatgccccaatgctccttttctctgacttcaagtgggcctctgatgctgcccacatttccctcaccaggtttctttcctttccaaaacatctgtaaaactttctgcacctttttccttctcccaccactaccagtggatgaccttatagatttctgctccatgagaaacagaagccatttgacagcaccctcagcaagagctaacattttagctcctaacaagagctagtgggcaactgatccaagcagtttacatatgtttatcatgtcatttcgtgttcaacacaatcctattagttataacttgataactaaggtttcataactggcctatggttgcacagcttgcaaaaggcagagtcagaactcagacccagtactgtctaatgtttgagctcttcaacactccatcactgcctgtcatcttccttctaatatatccacaaattcacctgcatctgcacatacagcttttcttcccatcatcttcgcataatggaacaaataaacctcctatccatagaaatcatctgtctattccccccattttccaaggtatgtcttgtctttttttttttgcgatgtagtctcgctctgtcgcccaggctgaagtgcagtggcgtgatctcgactcgctgcctcccggattcacgccattctcctgcctcagcctcccgagtagctgggactacaggcgcccaccaccacgcccggctaattttttgtatttttagtagagacggggtttcaccatgttagccaggatggtctcgatctcctgacctcgtgatccgcccaccttggcctccccaaagtgctgggattacaggcttgagccactgcacccggcctgtttcttttgtacgttgcaaaatctcccattttactactgcttatcacatcatcaacatatgagcactctcaaaagtcttactttaaaaaaaacaaaaacaaaaacaaaaaatggccgggcacggtggctcatgcctgtaatcccagcactttgggaggcgaaggcaggcagatcataaggtcaggagattgagaccaccctggccaacacggtgaaaccccgtctctactaaaatagaaaaaataaaattacctgtgcgtggtggcacgcacctgtagtcccagctacttgggaggctgaggcaggggaatcatttgaacccgggaggcagagcttgcagtgagccaagatcgtgccactacactccagcctggtgacagagcgagactccgtctcaaaaaaaaaaactaaaggccgggtgcggtggctcacgctggtaatcccagcactttgggaggccaaggtgggtggatcatgaggtcaggagttcaagaccagcctgcccaatgtagtgaaaccccgtctctactaaatatacaaatatcagccaggcgtggtggcgggcgcctgcaatcccagctactcaggaggctgaggcaggagaatcgctcgaatccgggaggcagaggttgcagtgagccgagattgcaccattgcgcttcagcctgggcggcagagagactccatctcaaaaataatcataataataataaaataaatttaaaaattaagaaaataaggccgggcacggtggctcacgcctgtaatcccagcactttgggagggcgaggcaggcagatcatgaggtcaggagtttgagaccagcctgggcaacatagtgaaaccccgtctctactaaaaatacaaaaaattagccgggtgtggtggtgggcgcctgtattcccagctagttgggaggctgaggcaggagaactacttgaaccccggaggcggaggttgcagtgagccgaggtcacgccattgcactccagaccgggcaacagtgtgagactctgactcaaaaaaaacaaaaaacaaaaaaaccctttaactgcctttctccctctatcaatctaatagcctggactcttcacagacaaacctgttgaaaaatttatcttccttgccttcatttactttttaacccactttaatctgggttccacctgcaacacaccactgaagctattcctactaaggtaggaactgccactcaaggccttcttggctctaaaatcccatgagcctttttcagttcaccctacaatttctcaataccactctaaagtttatgagttttttagttaactttaatccagtgactctttctactttatcccaatccaagtattctcctccttcttcacttcattttttttttttttttttgagacagactctgactttgttgcccaggctggagtatagtggtgcaatactggctcactgcaacctccacctccaggttcaagcgattctcctgcctcagcctcccaagtagctgagattacaggcccctgctaccacacccggctaatttttgtatttttagtagagacggggtttcaccatgttggccaggctggtctcgaactcctgacctcaagggatccacccgcctcggcctcccaaagtgttggaattacaggcgtgagccaacgtgcccggccccttcttcacttctttaaccagcttagatttcattgtgtatcatttcaacaacactcttgcctatacccttaactcttaagattctcatcacacccatctggcaaaaccccaatcctggataaacccaacgatccatcaataagcaccacactcccaggtcctccagtgtttacttcccattctatacatgcactatccagacattcccattctcttcaaattccaaaatatcctatcacctcccctccccatacacacattctacttcaccaacaagaaaaaaggtaccagctgggcacagtggctcacgcctgtaatccccgcactttgggaggccaaggcgggtggatcacttgatgtcaggagttggacaccagcctggccaaaatggtgaaacctcatctctactaaaaatacaaaaattagctgggtgtggtggtgcgcacctgtaatctcagctacatgggagactgaggcaggagaatcgcttgaacccaggaggtggaggttgcagtgagccaagactgcaccactgcactccagagcctgggcaataataagagcgaaactccgtctcggggtggggtgaggaagataccataaaatacctgtacccgattctagaccttactgaggattccatctacttccaccttactgtagcttttcaaatacttttcccactgaactaaatcccccccataaacatgcaacactttctaatgtattccattgaaaaatacaaaaacatataaaaaggaaaaactccatcaatcccacacgtccctccatcaaacaatctgcctttacttgctgcagccaaactaaagttgtctagattcccctctcccatttcttcacttcttctagctccttaacacacactggtccaatttctgccccatcactcttggcaaaatccattatgacctccaggctgctaaatccaagatacagttcaggcctcaatctgctcatcctttcagcagctttcacagggcttctgagtagggttgagcagttttgccctgcacacaggtgccctgcagaggaatgaggtgggctgaatgaaactccttttttaaaaattcttggctggcatagtggctcacgcctgtaatcccagcactttgggaggctgaggcggacggatcacttgaggtcaggagttcaaggtcagcctggccaatatggcaaaaccccatctgttaaaaatacaaaaattagctggccgtggtggcgggcacctgtaatcccagctactcgggaggctgaggcaggagaatcacttgaacccaggaggcagaggtttcagtgagccgagactgccccactgcactccagcctgggcaacaagagagaaactccatctcaaaaaaaaaaattgtttatgccaactaattgtacacctaaatgcaccaagttcctgactttctccttgcatttatttatttatttatttatttatttatttatttattaggtctcactctatgttgcccacgttgtagtgcagtgtgtgattacagctcactgcagccttgaactcctgggctcaagagattcctctggtcttagcctccccagtagctagaactacaggtatggagtggctctctgcctttatttctaacccaagctaccttacaaccttaaaaagagacgctgcttcgccgggcacagtggctctcacctgtaatcccagcactttgggaggccgaggcgggcggatcacgaggtcaggagatcgagaccatcctggctaacacggtgaaaccctatctctactaaaaatacaaaaaattagccaggcgtggtggcgggcacctgcaatcccagctactcgggaggctgaggcaggagaatggcgtgaacccaggaggtggagctggcagtgagccgagattgcaccactgcactctagcctgggcgacagagtgacactccatcctaaaaaaaaaaaaaaaaatttattatatacatacacacacacacacacacacacacacacacacatacacacacacacacacacatctccccagaagcatcaatatttactgaattagagtatttcattacctgttataaaaaacaaacaaaaaaaccttccattatactaatttataaaggaatcaaaacaaaatgggttggcgggtccaggcacggtgtctcacttctgtaatcccagcactttgagaagccaaggtgggaactcgaggtcaggagttcgagaccagcctggccaacatggcgaaaccctgtctctaatacaaaaattagacgggcctggtgacatgcgcctgtagtcccagctactcgggaggcagaggcacatgaatcacttgaacccaggagtggaggttgtactgagccaagatcgtgccactgcactccaccctgggagacagagtgaaactatgtctttaaaaaaaaaggcggggtgcagtggcacacacctgtaatcccagcactttgggaggccgaggcaggtggatcacctgaggtcaggagttcacgaccagcctaacatggtgaaaccccatctctactaaatataaaaaaattagccgggtgtggtggcacatgcctgtaatctgatctacttgggaggctgagacaggaaaacagcttgtacctgggaggcggaggatgcagtgagccgagattgcaccattgcgctccagcctggacaacaagagcaaaactctgtctcaaaaaaaaaaaaaaaaaaaaaaaaaaaaaaaaaagttggggtgaggggaaggttcaacttaaagatacaattactaagtgtttcataaggaatgacttatttcataatggagtaggagtttgacaccagcatgggcaacatggggaggccccatctctacaaaaaagtaaaaataaaaaattagcgtgccaagcatggtgggtcacacctgtaatcctggcactttgggaggccaaggaggaaggatcacttgagcctaggtattcaagaccagcccaggcagcatggcaaaaccccgtctctacagaaaacaaaaaaaaaataaagtagctgggggtggtaacatgcacctgtggtcccagctattgggagggtgaggtaggaggacttattgagcctgggaggtggaggctgcagtgagctgagatggttccactgcactccaacctgggcaatggagcgagactctgtttcagaaaaagagagaggaagccaggcgtggtggctcacgcctgtaatcccagcactttgggaggccgaagcgggtggatcacctgaggtcagcagttcaagaccagcctggccaacatggtgaaatcccatctccactaaaaacacaaaaattagccgggcatagtggcatgcacctgtattcccagctacttgggaggctgagacaggagaatcacttgaaccaggaggcggaggttgcaagtgagctgagattgtgccactatactccagcctgggcgacaaagtaaagctctgtctcaaaaaaaaaagagagagagagaggaaaaataaattagccaggtgtggtggtatgcacctgtggtcccagctactcaggaggctaaggcgggaggattcccagagcccaggaagtcaaggctgcagtgagcagtgattgcaccactgcactccagcctgggcaacagagcaagagcatatctcaaaaaagaggaaagaaaagaaaagaaaaacataaaaacaaatgttcctttagttttaatttttattttttagtttattatggctgttttactctcccccaagtaaaacagccatacacaatttgctgaaattttccttagtgtactttgaaatctgtggaacagaactggcaatcgctaaattctatttgactctagttccatttaatattagactggtgtggaagtaactgcggtttttgccaaaaccgcaattacttttgcacctacctaataggtataaaatatgtaacttcacttaattttatcctttatgtatctccctatattatgtacctatggacatcaaacttagtacagactgataaaaggctgaatagacaactctggtttcaaaaatccagcttctcacaacatcagacatactagtatacagcttttctaatttcacaacacatttccattttttggtctttcacaatagagaagatgtgtgtacttttgaatactctgatctgtctacaatctaccaaaattggaaggtgtttttattatacagtttcatccttttagaaatatagaaagatcctaagtttgggcacagtaagacactcaatatagatctactactaaacaagtaagaccaattacacaattaatgtcctaataccccgagtggagaagtaaaatctacttgttttctgttgacttgaacgccttctcttctttgttgaattaatcaatctatttgactccaatgtcaaattaatcaatgtcactttagaatattaaaatgtacaattatgaattacacatttaattttaaaacacatcattctgatctctgtcttgattgatactagaagattatcttccaaactaaggtggaaaaaatgacagactttagctattggcaatgataggtcatttttttagggaagaggagtaaagagggccacctccataggtcagatatccctttgttctaagaagccaccacccctgtttcttcatatgaaaaaaaccagaggcatccagtggttcccaaaaccttctcaactttacgcttgaggaacccacagatttcaaataatacaactgacctaagacactcatttgtttaaccattctttttttaactttttattttttttgagaaggagtcttgctctgctgcccaggctggagtgcagtggtgtgatgtcgctcactacaacctctgcctctcaggttcaagtgattctcctgcctcagcctcccgagtaactgggattacaggcatgcaccaccacatcccgctaatttatttatttatttttttttagtagagacaggggtttcaccatgtcggttggccaggctggtctcgaactcctgacctcaggtgatccacccacctcagcctcccaaagtgctgggattacaggcgtgagccactgcccccggcctgcttaaccattcttaaatgtcgggtgcagtggctcacacctgtaatctcaacactttgggaggctgaaggtgggcagattgcttgcgttcaggggttcaagaccagcctgggcaacgtggtgaaaaccccatctctacaaaaaatacaaaaatgagccgggctgttggcaagcgcctgtagccccagctacttgtggatgctgaggcaggaggcttgagcctgggaggtcgagactgcagtaagccaagtatctgtgccgctgcactccagcctgggtgacacagcaagaccgtctcaaaaaaattgacagaagagttgactgagagcacagtgaatgaaaaggaagactataagccagtgccatataaatgcttactgttggaggtatgcttctatggaacacgggtttgctctcttgccatatgacattcacatattcagccacctggaacacttcctgtcagtatgtgtgaagtatcatgtgtggtcaaaattgtctcaacagtcattttccacaccaactggcaaactaacactaaaagaaatcaacaagtattgctttttcaaaagcctaaatcggctgagtgcgatgacttacacctgtaatcccagcactttgggaggccaaagcaggcggatcacctgagtcaggagtccaagaacaggccggccaacatggtggaatctcgtctctactaaaaatacaaaaattagctggacgcctgtaatcccagctactcaggaggctgaggcaggagaatttttccctgtaaccgggaggcaggggctgcagtgagtcgagattacaccactgcactccagcctgggagacagagcaagactccatctcaggaagacaaaaaaaaaaaaaagcctacatcaaggaaaacagaaccaaaacaccagggacaaaatggtacataagaggcaaaaaaattttcaccaaaattattcagatgaacaataataaatgtgcctgcatctgaagatgttctaaaccttcatttaagcaagaagcaagatcaagatctgttccgtcagttacctggagtctgtcatctttctgaataggggacagaatcacctcaaatttaactaataaaaatttatgacttggcaaacaccccaggtatttttattgactaacaaatcagctatgacaatcttagcaacaaatcaagttatgctatggggtatgtccacacttccctgttccctctacaacaggagaaaatcaaatttttccaacatcctaacaaactgttactgcctgtaaccaaatgtatcacagtatcgtctaccaaggcgttacatcctgaaactttcctacaaaaagcacagcttcaaagaaaccttgcaagctttcttgtaagctcctcccttcccccatcgcccctccccagagccaagaaataaagcacttgaaagaaacaacatggataatatttattaatagctcatgtacatattccataactacataagccatttggcttcatacctgtcagcaatgaagtcagctggccctagcacgtggctgcgactcttctctatttatttagaactacaaactacaatttacacttttccaaaagctgtaggactatttgggaagggcactttattcttctaaaaggttactaaattctcttatatacttatactgatcacaatactgaaaaataatagaaaatccattgtcattcatttaccacctaatttgttaagatgccagaaaaccaaattttacacatttcaataaaaaggcaaaactaagcatgtcaatcataggaaaaaaatacttaatcaactaattttatttaaagcactcacaaactcttaagtggtacaagacaagtcaacgctgtttatcgaacaatatttttttttacgactaaacatctcaattctagactcaggcactaattattaaagtcatctagttatatacaccaattctcaacagacacagttttttttggaaaggcatattaaacagactaagatgtgtactacccattagccaaagataattttattgatttttctaacgagtcttcaaatgttacattctaacatcttagcaaattatttccaaatactgctggaattacatgtaactatcaggaaacaaaagggcttctctttttttttttttctttttttttttttttgagacggagtctcgctctgtcgcccaggccggactgcggactgcagtggcgcaatctcggctcactgcaagctccgcctccccggttcaggccattctgcctcagcctcctgagtagctgggactacaggcgtccgccaccacacccggctaattttttgtatttttagtagagatggggtttcaccgtgttagccaggatggtcttgatctcctgacctcatgatctgcccacctcagcctcccaaagtgctgggattacaggcgtgagccactgcgcccagccaggttttttttaatgtaattatttaagctgtagttttcacttcttggttttgggtaatagatcttgtgagaaaagatccaaaccaattttgacttctgctgaagtatttaacttgactttgaaatgtgatctttgttgacaggtcaaagaaattcattgatcctatttatcaggtatgggaaggcatgagtgctgaagagctacaggagttcaagaaacccatgaaaaaggtcagtttgtgattgattgagcacactctcggaatctcctttctggttccaggtcacagtcagatagtaagtggcaagttgctcgtgcgtgtaatccccacactttagggggtcaaggccagaggattgctggagaccagcctgggcaacacagtgacaccctgtttctacaaaaattttttaaattagctgggcgtggtggtgcacacctgtaatcccagctcctctggaagctgaggtgggaggtcaaggctgcagtgagctgtaaatgcagcatggcatttcatcctgggcaacagagcaagaccctgttttctttaaaaaagcacaccgaaaccgtgtcttactcattctgcctttataaaattccaggcccaggttttgttgttatttaaagagtctatggcttttttggataaattgcttaaaccagacacttcacatactgacatgtgagaagcgaaggttaattacaaattagctgaacaaatttagatctttgccacttgcgcattctcaccaagtaacaatctccagttgactcatgttgaaattgccccagcagtttacattagttttatagatcttcatgaatgggtggtgaagacgcaggttgcaacataccctccaggtcacatgaagtggagctgagacagttacagttagagaggaaagttagaatccagtaataaagaatttcgctgctctgttgcttgggagcacatttgttttctcattaaaagcagcttcaagatggcttttttgttgttgttgtttttcataagtaatcattaataagtaatcattggaaagccccaccacacccaaccaattagcttcgtgtggtggcaggcatctgtaatctcagttactcaggagactgaggcaagagaattgcttgaacctgggaggcggagtttgcagtgagttgagattgcaccgctgtattccaacctgggcgacagcgccagaccctgtctcaaaagaaaaaaataataatataaagtgaccaggtgtgttgactcacgcctgtaatcccaccactttgggtggaagcaggaggatcactggagcccaggagtttgaaaccagcctaggcaacatagtgagaccctgtctctatattaaacacacacacacacacaaaggcagccagactatgcactaggaactgccctgggaatccctttgtgttctcacaacaatcccatttcacagatgaagaaaccaaggcacagaaatattaagtaacgtgtccaggtgcggtggctcacacctgtaatcccagtactttgggaggctgaggcaggcagatcacaaggtcaggagttcgagaccatcctggccaatatggtgaaaccctgtctctactaaaaatacaaaagtcctaggggtagtcagcccctctcaccccaccctcatcctctcacacaagagtcatttactgtccctccagttatgcccagtcacgcagacactctgctgctcaaatgccctcaccccatcctcagcctgctcccaggccacctccctccagaatccaccttgcctgccaggtggccatagggaccctcgccatactgtctgcttgtggcagtgccctccagcctggggggtcttccagagcagatctctggccaagcgcagtggctcatgcctgtaatctcagcaccttcagaggccaaggcaggtggatcacctgaggtcaggagttcgagaccagccttgctaacatggtgaaaccccgtctctactaaaaatacaaaaattagccaggtgtggtagtggtgcatgcctgtagtcccagctactcaggaggctgaggcaggagaatctcttggacccgggaggtggaggttgcagtgagctgaaatggtgccactgcactccagcctgggcaacagtgagactctgtctttaaaaaaaaaaaaaaaaaagagagcggagttctgatataagctgccctggcacatagtgagcctccagaaatggtcccttgacctctaaatgcaccaagacccagggaacacgccctctctgagcaccctgacaatgtcccagtcccaacacggtaccctgaagctgtccccaaagtttcccctgccacactccctgaccactctctggtatctcagagccctagcaacagccctatagagggagggttctaggcatggggcaggcatgagcactgtgcttataaccaagcaaaacactccctctgtgccaacataggtggggcaggtcacgctggggtctgtttgccctgtctgcccgctgcagcctcctcggggagggccagggttgtctgtgcatcctgtgagccccagggtctatgtgcacatatgtgtgtctgtgcctttctctctctctctgtgtgtgtgtgtgtgtgtgtgtgtgtgtgtgtgtgtgtacacggcgcatctgaattgtcctgagtgccgtctcgggtatccttgagctgtgtgtgcatgtgtccccctagcggtaagtctcctcggaataagggaagaaaaggtgctcttttgatgttattattcccccagcccctcccccgctcacctaatcccatgtgtacagtgtcatggaaccttaccatgttgtgtgtgtaatcccctgtgtgcagtgtcatggaaccttaccatgttgtgtgtgtaatcccgtgtgcggtgtcatggaaccttaccatgtgttgtgtgttatcccctgggtgcagtgtcatggaaccttaccatgtggtgtgtgtaatcccctgtgtgtggcatcatggaaccttaccatgttgtgtgtgtaatcccctgtgtgcagtgtcatggaactttaccatgttgtgtgtgtaagtctgctctgttagcaactccgcaggattcattcacaggtgccccctccacagttgactcttctctttcagagggttcctggcatagtctgtctgatttttcctttatacacaaccctatagggaagatccttgcatatatgtcttggcaaatagataagttcctggaagtagaattgctacatgtgtttaaaagtttgttaagacggtaacaggttttctagaaatgttttactaattcttccacggacagtgcttgagaacaagttttttctacacctttgctaaggctggtaatttttaaaaatggtgttaaaggcacatgtctactttgaaatcataactgtttgtttgtttaaaggagacccttgagaaatgaaaccctaaatttcaggaacttcatctcttcatctgtgaaaacactttgtccacacttattgttttaaaaagattttttttttttggccataaagtagtatatgttctattgttctgttaagtttgaagtgaccagcccaccacagttaggtcactgagtgttttggttgcctggttattctttcaggaatgtttgaatcgaaatgctcacaatttatttccccagaagagagaattttcagaaatctcctaagaaagtctgatgtccgttcatatgatctgtttgctttgttagtagagaaaactacctttggagactagttgtagcatggaaggggaaggcagtagaaatagttttggggtgaggcgagcagtcccaggggaacacgaaggcagcgtttcaggagtgctgctggttagttttccacgccatcactgcacattattttacaaatccctgtttctagttcagaaggcaaatgacagtttctttagaaaatgtaacactgtaatcttgtaaaatgaaagtgttccagttacatcattttcggttatttcagaaccattaaagttctgacagcctacttccccaatctctttgtagactgtggcccaaagaaggcttagagaaataattttgaatcttgattttgttccaactctgttccttaaatgcctaagaactgtgattttttgagtatttgttaaaagcctactgtgtcagccaggcatggtggctcatgcctgtaatcccagcaccttgggaggctgaggcgggcggatcacgatgtcaggggatcgagaccatcctggcaaacacggtgaagtctctactataaatacaaaaaaatacaaaaaattagctgggcgtggtggtggatgcctgtagtcccagctgctcaggaggctgaggcaggagaatggtgtgaacccgggaggcggagcttgcagtgagctgagatcgtgccactgcactccagcctgggcgacagagcaagactcggtctcaaaaaaaaaagcaaaacctactgtgcacagagctccgaggcctgccccagtacaaagcctgcagtctctgacccaggagaaagtgtgcacagctgcaggtaccttgatgtgtcaaacaccattgcctctggctgccgaagcttctgatatctgctgatagtcttcagagacttttttaaaacgtgatacatggcttctgtcttcctgatttcaagattctctctctgtctttggcttttgctgaattgataataacatgtcttggtgtgggtctctttgagttcattttccttagagttcattgggctcttggatgtttatattcatgaaattgggaaagttttcaatcattatttcttcaaattatctctctgcccttgtctttcttctccttcttaaataccacaatgtatatattagtccacttgatggtgttccaaaagtcccttaggctctgtttacatttctttgatctttcctttttttttttccttttttcaatctttttacttcctgttcctcagactcaataattgccattgtcctatattcaagttaagtaattttttcttctgcctattcaaacatgactttcaatcctactagttaatattttatttcagttattgtacttttccactctagaatttttttgtttccttttaaagttttctacctccttattgatattgctgttttgtttgtacatcattttcttgacttcctccacatcttcctctagtttttaaagcatcattaagacagtattttaaagtatttttctagtatatctgccatcatgtctttttcagtacagtttccattcatttttttttcctttgatcctttgatgggccataatttcctgtttctttgtatgcttctgagttttattaaaaactggacatttgactctaataaagtggtaattctggaaattatattttcgtcattctcttaggtttgctgttgtttgttactttttatttattgtttttgttttttggattgttgtaggctgtctcggtgcttaggatcagcctggggtgtgaaactaagttcttctcaggcattttctgagcctgtgtctttccctgagcatgtgtggttactttatatttttctttatatatacagttgtgttttaatgccctaatacttaatatatgaatcccaaaagaggaaaatgagaaaaatgaaggatggtgtgtaaagggagctagtcctttaaagcccctgtcacttcaaatagaggggcaggagcttgtgccatgccaggagtttagggggcattaatagtttggaaacactgtaaattaattagtaatttaatttaatttaaattgacagccttttctctgtctgttaggctatgtgcacctcaatgtaaatcaacagaagggtttgactaattggtgaagcaacatttattgcagtctctggtttggggatgaatgcagaaaggctttgcttctggttcagccttaccctggaacaagatatacatatggctctacaggttaaacaaagccaaaacatcatggtttccatgctccttagagttcctgattaatgagaagagcatctcatattccaatactcctccaaattgtgtggctctagaattttatttctaacttctttatccccaagatcattaaaactgaattacagaagctattatcccagtgtcctacaataggtctgacagctgtaattctgtagccctttaggaaaaaaacagtcttggtaggactcttagaagcatggcttggaggactgcaggtttgccatctcatccatggatgtagagtgggatggatgacttggctctttactcaaggcaatttttgttattaggtgaggtcaagaattggctactgtcctcaatttgatgccttgctggaatatatgactgctcaggaaataatgattatgtatgccagaatatggggagtctctgagccccagattgggctgtatgtgaacaaatgtttgaattcactggaactggagtctcatgctgccaggcttatcaacacctacaggtaagtcactatgctactgctcttttctgttgatgctgctaatattgaggttcttgctgtttgaaatgaagcttacagctccacctaagctcctcttcccacaattacctacttgtgaaactatctaatgttctgctaggcttcagatgccagtaacaaggcaaatcaatacagttccacatcttcccttttcagagatgaaacgcaaagtcttggttctatttgaactatatcctctgaacctcaaaaaaaggagtgtcttctcttcctagtgtccctatagttctttgtctaccaagtaaggaggaatgtaggccctttgaattatgatgtgatttatgtgtcttggaaaccataacactctaagaacatgccactgataatgctgccaaaattaattacataaaagtcactcctcgatatctcaaattaaaatgaattgatatagacgcctgtaattgggcctgctacctaatcaaagtcacatataatcagcattgggacatccatgttaagtgtttgctgggactctcagcatttgggaaatttgtactaactctttcctatacatagctgatatgtatagccattttttctctcactttttctctccttctttggccatgaagtgaaggaaacaaacgtaggctgagtactgctattgccctaatgggaaggtcttcagtcatcttcctggatgagccatcaactggcatggacccagtagccagacgcctgctctggaacatggtgacaaagacacgtgaaagtggaaaagccatcgttatgacctcccacaggtatggctcattgggaggcttggttgaaggctagcaagagttttagtggctataagaaggaattatttaggcccagtggataatattggacactaaacttgcctgagtatgttagctcctcatcaggaattaggattcatgttaatcctaataaatcaaatggccaaaaatcctcactgagtttaaaaaaaaagtgaggaaaagacaggacttcagaagatgttctatttgaaaattgagcgctgtgttctttttcgtttgaaaaattcccacttcccatctatgtgctttatgattggaaaaatacaaattctgattgaaaatagggtcacaaaattctggctctgattgaactacacaatgtcttccaaaagagaactttttatttttacccttacaacattctgcccttttgttttccaagtatggaggaatgtgacgccctctgtaccagtctagccatcatggtgcaagggaagttcacttgcttgggcagccctcagcatctcaagagcaagtttggcaacatttacatcctgaaggtcaaggtcaagactgaagataaattagaggattttaaatgttatgttgcaacaacatttccaggtaaattaagttgtgctacctttgtcagaaatgtattaaattggccgggcgcactggttcacgcctgtaatcccagcacttttgggaggctgaggtgggcaggtcatttgagctcaggagtttgagaaatgtgttaaatcatatttgttgttctcaccatccatatgatttatgtcttcaataccagttttctgtgagttattgataggtattgattttctataatgttcctttggcaatgtttgatattatagtctcttatgccagattatgctaagtttcacaaaaagcagaagtcctcacaaactcttacatcacctaacaaggcacttttatgtttgtgctgtccatataaattagttgggcgcagtagctcatgcctgtaattccagcaacttggaaggctgaggccagagaattgcttgagccccagggtttaaggctgcaatgagctatgattgtgccattgcactccagcctggcaagaccccatctctaaaaaaattaatgataataaataaaaactaaaaataaattatatatctaaagtcctattttagcataattctcaattatttttacagattattcatgccaaattttaaggttttttccttcacactgctcatgcaactttatgcttttgctgtctcagctaggatatggtattgaaatgcaaataagaactggtatttctctcctttcaagagtagtttggtttctgagtgccgtttcttcatgctaaattcagtaagcacctctccgcctacatggaacagtacaagagagagcatgcatttcgatctcttatctctctttccttaacctaaagcatgggcaatggcaaggcttttaataattctggtttttcatcttagtttccactttgttaggctgagcaaaataccgcagaagttcccgttgtgtgttaggctaaggggttgaaaatttgtctcctaggcaatggaaaatagcaaaattgattacacagtaagaatgaaaatcagggccgggcacagtggctcatgcttgtaatcccagcactttgggaggctgaggtgggcggatcacctgaggtcaggagtttgagaccagcctggccaacatgatgaatccccatatccattaaaaatacaaaaattagctgtacatggtagcacacacctgtggtctcagttactcaggaggctgaggcaggagaattgcttgaaccggggaggcggaggttccagtgaacagaggtcatgccattgcactttagcctgggtgacagagagagactctgtctcaaaaaagcaaaaagagaagaaaatcagaaaatagatacgaaatggatggtcaagcatatgtggagaacgagctgtgtagaaaaattatcacctcggtgttggtcatagtgtttatggtgtgcccttgacacatgtagatggatatgtccattaagaagttgaatattcatttatgcattcatgtggcaaatatttttgaggacttattgtgtcaagagttctatttgatgtgatcaataaatcactttaggaaagctctataggctgggcacagtggctcacgtctgtaatcccagcactttgggaggccaaggcaggtggatcacgaggtcgggagtttgagaccagcctggccaatattgtgaaaccccatctctaccaaaaatacaaaaattagccgggcatggtggtgggtgcctgtaatcccagctacttgggagactgaggcaggagaatcgcttgaacccagaaggtggatgttgcggtgagccgagatcgtgccactggactccagcctgggcaacagagtgagactccatcttaaaaacaaaaacgaaaacaaaaagctctgcacacttcaagataacacagaaaaacaattcaacaaaatcgggtaaacaataaatgacccagactagtaacttaatagagaaattgaaattactttttaaaaaatcaaacagaaatcatggatatgtaatatacagtgaataaaatgaataatgcagtagaaagcattaacagcagagtttatcaagcagagaaaaatatctcaactcaaaataggttttttgaaaatatacagttagatgattaaaagaaaaattaagaggaatgaagaaagctcatgggatttatagaacagcatcaaaagagccagtgtttacattattagagtttgtgaggaagaagaaaaaacaaattgttggaaagcttaaagaaataaaagcagaagattttccaaatactaagaaaaacataaatatccaggtacaagagggtcacatatctgcattcggattcaatacaaacaaggctacatcaagacattataattaaatggtcaaaaatcaagcacaaagagaggatctgaaagcagcaagagaaaaaaaaagcaaataacatataagggagattccataaggctagctataggtgtctcaaccaggacctcataggcaaggagagagtaggatgacatgttcaaagtactgaagagaaaaaaaccctgccaaccaagatactgtatccaatactatgttgaataggagtggtaagagaggacattcttgtgccagttgttcttgtgccagttttcaaggggaatgcttccagcttttgcccattcagtatgatattggcggtgggtttgtcatatgtcatgtcatggctcttattagtttgaggtatgtcctttgaatatctagtgtattgagaacttttaacatgaagggatgttgaattttatcgaaggccttttctgcatctattgagctaatcatgtggtttttgtcttcagttctgtttacgtggtgaatcacatttattaatttgcatatgttgaaccaaccttgcatcctagggatgaagccaacttgatcatggtggacaagctttttgatgtgtgggtggattcagtttgccagtattttattgagaatttttgcattgatgttcatcaaggatattggcctgaagttttctttttttgttgtatctctgccaggttttggtatcaggatgatgctggcctcatagaatgagttagggaggagtccctcctttggtcaccagcctacatgtacctgtaggaggtagctagagacccctattgggaggtctcactcagtcaggaggaaagggatcagggacccacccaaagcagcagtctggctgcttattggtagagcaggtgtgctgtgttgtgtgggacctttccttgttcggactgcctgtattcttcaaagctgacagactgaagcagctgagttgaccaaaccacagagatggcagctgcgcctcctccaggaacttggacccatctcagggagactctaactcactgccatttgttggctgggattccaaaccagtaggtcttaactcgtgatgtgacgtggaagtggggcctgcagaatgacactgcttggctccctggattcagcttccttcctagggatatgtacagatggacctctcaccttgccagggatcccaaggctagagtatataaaactcctgggtctctgtgtgtgcctgagtggatgctctgtcaagacttcacacagctctgtgtatcagacccaaggccctggtggtgtgggctcatggggggatctcttgatctgtggattgcaaagatccatgggaaaagcgtggtttcctgggcaaggtctcaccatcactcactgcttctcttgtctaggggtggtggttcctttggctccgtgtagctccttggtgggccatctccactccctgctcttctttgttctccatgggtcgagtttttagcctagttggtcccaatgcgagaacctggatatgtcagtcaaaggtactaaattcactcacccctctccgttcctctccatgagtgctgtgaaccgcagctacttctaataggccatcatggatcaggtccctctgcaaacattagacttttagaaggctcagttttcttacattgggcatgtcagctgataatttattgtacctcaaatcctgccctcaataattgctatgaactccacataataagatgatttcatgaggaataaatctgaaagcatgaaccgtgtcatggataccaaaaagagtgggttagcgggttatatctcctttcgtattgacctcctctattcacccctccacagtatataattaagtaaattccattattactccatatccatcaagagaatgggaacagagaatggcttcctctcactttctcaattctctgttcttccaccttctcacctctcccttctgtgccttttgtcctccaacatacacttgataggaattgggggagtggaggagaggcttatctgagttgggggctgaaggggagattgcaatggtaactgtgtttttgttgctgttgttaaaggtgtttggcattttggaggaagctaaagagcaattcgatttagaagactattctgtcagtcagatcacactggaacaggtcttcctgacctttgctaacccagagaaagcatccagtgatgatgaaaacgaggtgccatgagattcagttacaaccagtgacccttgtgtctctcatagatgacacctggatgcatgggggaccttcctgtgcatgtatatcttggtgtacatatatttatgtaataaagcttttcccaaagaagaaagtttgtccccttcattgcagatttagatgagcggcctgtgtatccagcatgctcaaatccaaagacatttggtgaaattcccattttctctccttgagatatgaaagagcagcatttatcagggttgggacaggaacctgttcctgagtgttctggacatttgaacagaaagatccagtaatgatggagctgtcagatgggacagcccaaagaacaagagctttatgtttcagcagttgagttatggataagaagcgcataaggcctggatcacatcagctttcctatggatacacacacacacacattcacactcacacacgcgtgcagatatacatgcatatacacatatatctaatataaattcatcaatgttggagggctgagttgggttactatttcagacatccaaaataaagttcatatgcttcagttgaaagagaatttttgcaccaagaacatttgggatccatgaccagaaaaaaaaggattatttaaaaatagtgtgttttcttttctacaattatctcacctctaataaagaagaaggagaaataaagtggagagagagggacacagagatattttcttctgattcttgcctaggtagatagatggagtcccccataaataatatgagaaatctaatcaccttttcaggattcatagacaactaggatggttcttgcagaattgcaagatgaagagagtctataaaggtgctctattttggggtggcttgttcaatgttttcaaatccttaattggatattgtttattataaagtgacacccaccagatgcttactgttcttttttttgttgttgttagataaagagggaatttgagtttgtttctatgaagtgtctaggagcatacgaagtctccaattaaaacaaaattgagccgggcgcggtggctcatgcttgtaatcccagcactttgggaggttgaggcgggtggatcacctgagttcgggagttcgagaccagcctgaccaacatggagaaaccccgtctctgctaaaaatacagaattagccaggcgtagtggcacatgcctgtaatcccagctactagggaggctgaggcaggagaattgcttgaacctgggaggcagaggttgtggtgagctgagatcgtgccattgcactccagcctgggcaacaagagtgaaactctgtctcaaaaataataataataataataatagaatatagctctttctctggttcataggctatgctcacctgagtgtaaatcaacagaggtgtttgactaattgctaaaacaatactcattgcagtctccaggttggcagggtggggaaaggctttggttctggttcagcctttatatggacaagatgttgtacaggtttaacagtgcaaatacctccatggcggccattccccctggagttcttgattaatgagaagaccatgtcataatctagtactcctccaaaatgagtaggctgtggaatttcatttctaacttctttatccccaagatcattaaaactgaattatggagcctactattccaatgtcctacaatagatctgacagctataattttgtagccctttagaaaaaaaatatcttggtaggactcttaaaagtatggcctggaagactgcaggtttgccatcttatccatggttgtctagtgggatagatgacttgggtctttacttaatgcaattcttgtaattaggttaaggtcaagaattggttattgtcctgaatttgatgtcttgctagaatatatgactgctcaggaaataatgatcatgtatgccagattatggggagtccctaagccccagattcaactgtatgtgaagaaatggttgaattcacttgaactggagcctcatgctgatgagcttatcaacacctacaggtgagtcattatgctgctgcactttttgttgatgctgctaatgttgaggtgctttcttttgtccctgctgtttgaaatgaagcccatagctccacctatgctccttttcccacaattacctaattacgaaactgtctaatgttctactaggtttcagatacgagtagtaaggcagatcaatgtagcttcacgtcgtccttttgcagaaatggaacaataaatcttaggtttttttgaactgtagcttctgaacctcaaaagggatcaattaagagggagtttaggattgctaaagcagctagaatttgaagagcagggtgatgataaagacgaagcgggggcccagaaatttgaatggggtttgctgtgagtcatgagctggcctgtgccatgtgcaaagggagagatgctgtgaggcctatcagagaatggcacctgctagactgagaactgaatgtgttaccggtggacgatatctgagttactggcggtgaatctgtgtacatctgcagctacctcaattcttgcctcctcagaagaaagaaatcaacagaggggcataaggcagaaaaagagaccaaggcaagtttcagagcaggagtggaagtttatttaaaaggctttagaacaggataaaaaaggaaaggaaagtatgcttggaagagacccaaccaggcactgaggtcaagcgctctgtttaacagtaatctttataggctggcccctttctcatgattcttcccttagggtgggctgcccgcatgcctggtacccccctcacccgttggaggtgagcatgcgcagcgtgtttaagaagttgtacccatgcccatctgagactttcttccctattctggtggagtaaccctggaaagtcatactccgccattttgtctcttaatgcacatgcccaggaagttgcttctccctggtgtctgcattcaattaacactgttaatttagtgcaacgggtgtggactatcaggaaatggcctctccaatttatctttttttttttttttttgaggcagaatttcgctcttgttgcccaggctggagtgcagtggcgcgatctcggctcacccaaacctccgcctcctgggttcaagtgattctcctgccttagcctcccgagtagctgggattacaggcacccgccaccatccctggctaattttgtatctttagtagagatggggtttctccatgttgttcaggctggtctcaaactcccgacctcaggtgatccgcccgccttggcctcccaaagtgttgggattgcaggtctgagccaccgcgcctggcccaatttatcacttagagaggcaatgtgataactgccaaatcatcacccgacattcctggtggatggggggagagccctctcctgtcccgctcatacctgtctaactacctgtaacaaaggtagacccagagtttacatagtgcagaaaatgtcggaattcttactgagagccacagtagagataccttactgagcaccccttacagttataactccagaaaagccatgccttagaagtaaagatcatgtcctagaataagatcaaaaacctaaatagacccaccctaataaagaataaaataaaagcctgacagaatcaaagggagcacgcaaaatatacgaaagctgggaaaagacgtttacttctgtgaaccaaaagtatctgagacaggtctcaatcaatgtggaaagtttccattgccaaggttaaggataagcgcctgagaggtatgtctatgcctttctccaaagatgatttcaagggcttcaatatttaaggagaaaggattgatatgggtgaaaaggaagaaaatttgaaatcttaattccagctctttgggaggccagtccagtggactgcctgaggtcaggagtttgagaccagcctgagcaacatggcaaaaccccatctctatcaaaaatacaaaaattagccagatgtggtggcatatgcctgtggtcccagctactcaggagactgaagtgggaggactacttgagcccaggaagtactggaagcactcaagcgtgagtgacagatcaagaccgtctcaaaaaaaaaaaaaaaaaaagaaaaaatttaaaaatgtgtgggtatacaagagacaaagggttgcatccccttgagtctttgatcagcctttcactgaatatacaatttacatgtgagaggatgggcagaggaatactcacttatgtcattgtctggctcagagaatcttcattttttttacataatacaatgtaaacaatagggcagaggaagccatcagatacacatttgtttaagatggactttgagttctgtcctttgtcctgcacctgtgaaaataagctatcaggcctggtgcggtggctcacacctgtaatcccagcactttgggaggccgaggtgggtgcatcacctgaggtcaggagttcgagaccagcctggccaacatagtgaaaccctgtctctactaaaaatgcaaaattagccaggcatcatggcacatgcctgtaatctcagctactcaggaggctgaggtgggaaaatctgcttgaaaccaggaggtggaggttgtagtgagctcagatcatgccattccactccagcctgggcaacaagagtgaaactctccaaaaaaaaaaaaaaaaaaaaaaaaaagagggaggagggagggaggaagggagggagagagagaaacagagaaagagagacagagagagagagagaaaggaaaggaagaaaaggaaaggaaggaaggaagacagctatcaatttacattgccagggtgaaattcaacaaaactgttttagggtaaagatcctcagatccacatggaattgccctgtgggcaaattgtaaggtaagttatgtagctttttatccttatagctatcttatttaggaataaaacgggaggcaggtttgtctgacatcattcccagcttgaattttccctttggcttagtgatttggaggccctgagattttttttcctttcacacttcctaactcattttatctatgacagaaaaatgcatgaatggggggaatgaaagtgaaagttaaagccagtatcactctggaacataaatgcacaaatcctaaacaaataagtagcaaattaggtctagcaatatattaaaagaataaaacatccagaccaagttgggtttataacaggaatgaaaggtttatttataatttgaatcaatcaatataacttaacacagaataagaccaatctgttcacctcaatacatggaaaaagtatatgtgaccaaaaacaataattatagaatattagaaattgatatgaacttttttttcccccccgagacagagtctcgctgtgtcgcctaggctggagtacaatggcagtgatctcggctcactgcaacttccgcctcccaggttcaagcaattctccctgcctcagcctcccgagtatctaagatttcagtcaactgccaccatgcccggctaatttttgtatttttttttcagtagagacagggttttgccacgttggccaggctggtcttgaactcctgacctcaggtgatccacccaccttggcctcccatagtgctgggattacaggcatgagccactgtgcctggcccagggaatatttcatcagagataatacctgacagggtaggattctgaaaggaatggggaaggaaatgccaacatcgaaattatgcattggggaagccatgattaatgcctctggccctaagatggcaaggtaatgttgttcccaagtataaacccacatcaccttcctctggtgtgttttactcctactgttgcctgctttctctttacattctcccaccccatactcaccgcgagcgctcaggctaggtagttaggctccatagagtcaaattggaccccacattaacgaaactaacaattcgagctttccagcaatgaactcatctgctcttccatgtctactcttttcctgtctgctggtttcctctcccagggctttcagtgtgttctacgcagaaaccagttcaaggactgggttttcttctgcaataaaatgctggagttgtggcagagacctccacagtgagaacagccacggagttggctaggaggtgacatgatgtggaagtggtggatgtgtccacaagatggcactcctaatttgtagcttaatgcttaataggacattttgcaattgacaaacttgggattttatgatttatgtagctgatatcatgaattatgtttcaaatcctgccacattttgaacagaatttatttttgcccctttctgatattgggtcataacctaagaatgagaggacattataagcaggtgtgggtgtgtgtgtgtgtgtgtgtgtgtgtgcacttgagtgtggagacttttgtgttcctcctacctgacctgaactgttgaatgatgaagttacaatgattggactcaggggtgcagctagctaacttgggaattggggttttgaagtactggagacagctttgtatgccatgttaatgaatttgaattttatcctgaaaaacgtggctgtcgttgaagaattttaagcaggcaggtggcttgatcagagcactgcttcccagatttcactcaatggtacctgtataacacattcatgatttttgctgtatctccgtatcatcaagttacttaacgtttttacaccaacttttattattttataaatgtacttaaagaggaaattcactactagcattgcttgccataatcaaaataaatatattattaaaatggaacagtgctaaataaggtgtacacatggacatagagtgtggaatgacagacaatggagactccgaaaggtggaggggtgggagagaggtgaacgatgagaaagtacttaatgggtaccatgtacattattcgggtgatgggtacactaaaggcccagacttcaccattactgcaatatatccatataacataactgtacttgcgccccttaaatttatacaaatttttaaaaggaaaaaatggaagtgttcatctatgtaccaacttaaaatcatctcacgcaccactagtgttaaatctaccacatgtggggaaactgtgtggtatgaattgggttgagggcgtccccagcaggcacagaaattgggttggtgccaggttcttaatgcccagatcttaattagagagcccaagtccgttgtaggcctggagcaattcagacacaaggcaaaaagaaagtacatttgcctatgccttgtaacgtctacaccaccagcctttctgaaactattgtgcatacgaagtcatcccaggatcttgtaaaaacaccgattcggatccaatatgggacctggagttcatacatttctaatcaactcctaaatgatattgatgctgatactgtcggtttcccaaccaagcaacgtagcaaggtacgaaactctaaagtccctaaagggcagggaccacgcctctcgcgttggcatagtgcctagctcaaggcactttctgggttaacactcgctgaggaccggagtgaacgcccccgccccaagtcgtcacgtgactgactttctccaactgccggtttcggctcacataacacacctactatccaaaacatttctattttcctaacacaaaaactatagctaagtttttatattctatgtagccccagcctaggacgtaaattccacgagaccaaaagccttgtgatgattccccgaggttgctgaccctcccggtgtgtcccgggcctgctctgggggacacagcggcgaatacgttgaacgaggcccctgtttcacggagctaaagatccagtaaggacttcacccagcgagaggcaactacgccgggcttcgatacccaatacctctgcagaaaggtggagtggcaggaatctcctgaagcctccaacgtccaggaacgcggaaacccagggcctccagtgcaggtgtcatcccggagggcgcatgcggagtcccaagagaggcgcgtcccattggacaatgctgagcggaagagcccaagatagcggggggagttgtgacaggctgctgcagacgtacttagaaaaggggtgcatactggatattcaggctaggagaagaacgcaaaaagcagtgacgtacattattctctgcatatatttacttgggaaattgtgcgtctccctattctgagtcttggaggaattggactggtccaaccttataaagagagcagtagagcgcggcagtatagagagtacctcacgaaggggacgtgggaaagtgttagcggggaacgctgggaaactcccggcctccgccaccatcttgctttcctttaatccggcagtgaccgtgtgtcagaacaatcttgaatcatgaagctactaaccagagccggctctttctcggtgagctcaggtggcgggtttgggaaagggctggggagcagtgtgtcgacaaggtgatacgaggcggaggtgtctggtctggggtctgggccttgggattcggtctgcccttcagctgaaccctgcgggccaagtgggctgcagactgggtcaggctttggaggcccagctcatgctgtgagcacaagagacctaacaccgggaaacctgaagagaggggcaggacgtgagagcggagttgaagcgagtccttggagagacttctgaaggtcactccggtactcaagtgctggagaaagagaccgtgaaacccagggggagcgggaggacggcgcacttagccccccaccttcactttatccgctgcagcctctgctccttggtttatcacggagcgtcagtttccccagcgaataaaagtataagaaaggagctaatgcagatagaacacttattacagtacctggaacttcattgttaaatactatggtgtcttagtagtctaacgttgcttttcttgatcgtatgttagacggttcctccaagacgtctctgtttgtcctcaaaagctccttaattaagtttccccttcaagcctaaattaaacatagctgtcacttggggaaaactcacacatcagggttatatcactgtgggacagtggttattaagaggggtaagggggaacacttaaaaaatcatagcgagggacagaatgcccccagggaaccggtggcgatgtttggagacatatttagttgcaacaacttgtaaggagggtgctattggcatggagaggccagggatgctgctaaacttcgccttacagcaaagaattatctagccccaagtgccagtagtagtacctgtgttgagaaacccccctagatggagatgcagaagaccagacctgggcatggaatgttcttatgctttatgtttacataaatgtgctgtgggctatatcgatttaggctgtaattgcattaaccttccaggtatacctagacacaccagtgattacccttggagggaagcacggttagattggcaaaagaccccaacatttccttctccattctattttgcaacagaaaaagctcagagaaaacagttggagaggcccaaagtaaacaaattgcagtaaacttgaaagcaattatttatgtgtctaattttagcactttatataggagaataaacttagatatatcttgttattagaacaaaataatttagaagattgcatgacagttactaggataatttgctgatttgaatgggacgattaagaagcacattaccggcggagcgcgatggctcacacctgtaatcctagcactttgggagtcagaggcaggcggatcacttgagatgaggagttcgaaaccagtctggccatcatggtgaaaccccgtctctactaaaaatacaaaaaaaaaaaaaatagccgggcgtggtggtggtgggcgcctctaatcccagctactcaggaggctgaggcaggagaatctcttgaacccaggaggcggaggttgcagtgagccgagatcgcaccgctgcactccagcctagacgacagagcgagactccgtctcaaaaaaaaaaaaaaaaaaaaattaccaacaaagagttactatttgggcacatttggttggaaaacacctaaaatctcacttggtaacggaattatagattattcatatttgaattgctatgcccatatatcttaaaagtttactttttggaaaattataggccaaaattacaaagaaggttaactataccatacccagcaaactaaattgatgacgataaagtaaagctaattgtaattcataactgaaaagcagtactaaaagcaagtgataaccagcagccaacctagtacagcactaatgatgtacaacaaacagccttctggacagcacagagtggaggcattgcagactgtgcagggatgtccgggaaactccagtgaggaggtgttcattgggtcttgggagcaccaaattttattcactcatcatctcctctaataacctcatgaactttagtcataatcagaatgatttgtatggcattgtataacatttgccaaaacaaactgaataaaatgaatgcattttgggtccattatctaatatttaatgggaccctttcaccctaccagtaactgcattttatatattgagaatctgatgtggatgaagccattattaatctcaggatgacatacatgtcataaatgttttatttagtcaaaaaaactaagacctttggttgtgtggtcttaatacagcacacaagagtgaagatacaatggaaaatattgagggcttggaggaagttggtatatactttgtctttttcttttttttttcttgagacggagttttgctcttgttgcccaggctagactgcaatggcacaatctcggctcactgcaacctccgcctcccggattcaagtgattctcctgcctcagcctccccagtagctgggattacaggcatgcatcaccacgccccgcttattttgtgtttttattagagatggggtttctccatgtttgtcaggctagtctcgagctcctgacctcaggtgatccgcccaccttggcctcccaaagtgctgggattacaggcgtgagccaccgcacccggctagtttgtcttttttaaaggttactaagatgattaaggagatgaaaccatttcaattggaaattagactgaacggatgacattcattgggcagataaaagaagcaagaagctgaaacctataaaaggttgtggacacaggccaggtgtggtggctcccacctgtaattctagcactttgtgaggccgaggcgggtggattgcctgagctcaggagtttgagaccagcctgagctatggggtgaaacgccatctctactaaaatacaaaaaattagccaggcgtggcagcatgtacctgtaatcccagctacttgggaggctgagacaggagaatcgcttgaatccaggaggcagacattgcaatgacccgagatcgcactgttgcactccagcgtgggacacagagcacgactccaactcaacaaaaaaggttgtggatggggtgatctgacactttttcaaaaaatgccaaagctttagaactacacagaaccatgaaacttttataaggtaactgaaagataagaaaatacagtgattctttacatcatttaaaaaataagcatcaagaactctataaatcactaataaatagaggtttaagaatggcttgggtaaactggtgggttagtaagtccataataagttatgcagctaggcggggtgcagtggctcacgcctgtaattccaacactttgggagaccaaggtgggcagatcacttaagatcaggagttcaagaccagcttggccaacacagtgaaaccccatctctactaaaaaatacaaaacaaaaactagctggacatggtggcacgcacctgtaattccagctatttgggaggctaaggcaggagaatggcttgaacccaggaggtagaggttgcagtgagctgagattgcgccactgcactccagcctgagcgacagagagacactctgtctcaaaaaaaaaaaaaaaatgttatgcaggtaaatcctcccatggaggtggttattgctccttccacccccgaacaccctctgtcgcttgggtaccctaagataccatgcttttatataaagcactgttcttgtgagaaatacgtgtaacctgtgttttttatgtttagagattttattccctcaaagttgcccccaaagttaaagccacagctgcgcctgcaggagcaccgccacaacctcaggaccttgaggttagtcccactaacttgctcgctggaagctatacatgccttactctccttggtaatacgaagacattcattatatctctactttattttaaatacagtttaccaagttaccaaatggcttggtgattgcttctttggaaaactattctcctgtatcaagaattggtttgttcattaaagcaggcagtagatatgaggacttcagcaatttaggaaccacccatttgctgcgtcttacatccagtctggtgagtatcttcacttcctcaagtgtttggaaatgctgtggtatcttggtcctgtgaaaaagaaaaactaagatcaatgtctttatattttgattccttgacctgccataacaaattaccacggactgggtagcttaaaccaaataagtttatcctgttacagttctagaggctagaagtccaagtcaaggtgtctaagccaagccaagatatcagcagggctgtgatccctctaaaggttctaggaaggcacaaatcctcccctgcctgttcctagcttccagcagttgcccacaacccttcatgttccttgacctgcaactgcatcactgcagtctctgcctttgttgtcacatggccttccttctgtctgtgtccacatttcctcctgataaggataccagttacattagatttagtgcccactataattcaatatgatgtcatcttaagtacttaaatctgcagagaccttattaccaaataaagtaacatgcaaatattctggctggacataaatttgggggggaacactgttaaacccagtactgtcccctaatgtaaaatgagaaaccacaagatatttgccacagagaagcactaaattagtatccatatgaatgttgatgttagagcataagaaatcagtaaacaaatttttaacaggaagtgccgcaaattgaaagaaaattaactctttttttcccatatacaagtctctttcagaatagactaatgaatccagtaagcttgtatttgacagtggaaattttacatgaatgtacttaatgtaaaaatgtatacttaagctttttgttgagccttgttttataattcttaactaaaaaggatgcaggaatttagtaaaattctttttaaatctgctcacaacagattttgatatagtgtgatgtttggcaaacttggcattgaaaagctacaaagataatcattctttctttttcaagacgacaaaaggagcttcatctttcaagataacccgtggaattgaagcagttggtggcaaattaaggtttgttaaataagtaatagaaaatagtgaaaatgccagaaaatattcaattttaagggaacttttctctgttatcaaggaggttgaggatttcttaagcaacataagaaggaaaagactgatgaatttgagtatatcaaactgtaaaacatctttatgtcttaaagtaaaaatttaagtaactgtctgggagtagatatctgcaatatataggcatacctcagagatgttgcaggttctgttccagaccaccacaatgaagggaatattgcagcaaagcaagtcataggaattttgtggtttcccagtgcatataaaagttatgtttacactatactgtggtctactaagtgtacaatgacattttgtcttggaaaaaaagtacataaccttaattttaaaatattttattgctttaaaaatgttaacagttatctgaatcttcagcaagtcataatctttgctggtggagggtcttgcctccacgttaatggctgatgactgatcaaggtggtggttgctgaaggtggtggtgactgataatttcttaaaatcagacaacagtgaagtttgctgcattgattgactcttccttttgtgaaagacttctctgtagcatgagatgttgtttttagccgtttacccacagaacttctttcaaaattagtcagtcatctcaaaccttaccacttttttatcaaccaagattatgtaatattcttttttatcatttcgacagtgttcacagcatcttcaaccaggagcagattctatctcaagaaaccactttgtttgctcatccataagaagcatctcctcatctgttcaagctttatcataagattgcagccattcagtcacatcttcaggccccacttctagttctcttgctactcccaccatagttgcagtttcttccccctctgaagtcttgcctctcagagtcatccataagggttggaattggcttcttccaaactcacgttaatgttgatactttgacatcctcccatgagtcacaaatgttcttaatggtgtctagaatggtgaattctttccagaaagttttttaatttactttgcccagatccatcagcgtcttcactatctgtggtagctgtagccttacaaaatgtatttcttaaataataagacttgaaaataaaaattactccttgatccatggggtgcagaagggatgttctattagcaggcatgaaaacagtgtcaatctccttgtacatctgcatcagagctcttggcattgttgcagtaataatttgaaaggaatcttttttctgagcaatgggcttaaaatattcagtcaaccatgctataaacagatgtactatcatccaggcttttttgttcatttacagagcataggcagagtagatttagcataattcctaagggctctaggattttgagaatggtaaatgacctcatcctaaagtcaccagctgcattagtccccaacaagagtcagcttgtcgtttgaagctttgacgccaggcattgacttctctagctacgaatgtcctggacggcatcttccaatgtaaggctgttttgtcagcattgaaaatctgtggtttagtgtagccaccttcatcgatgatcttatgtagatcttctggataacgtgctgcagcttctatattagcatttgctgcttcactgtgtactattatattaagaagatggcttctttccttaaagctcatgaactaaccacggctagcttcagacttttcttctgcatctcacctctctcagccttcatataattgaagagagttagggcattgctctggattaagctttgacttaagggaatacagtttgatctaatccagaccagtaaaactctgtattatcagcaataagtctgtcttgctttcatatcatttatgtgttcagtggagtagcactattagttttcttcaagaactgcactggtgcaagaggcctagcttttgacctgtatccgtttttaacatgccttcctgacttccttagaagcttaatcctttctagcttctgatttaaagtgagagacatgagactcttcctttcacttgtatacttaggggccattgtcgggttattcattagcttaatttcaatattgttgtgtctcaggagtaggaatatccaaagagagggagaaagacttggggagcagctggtcagtggaacactcaggacagaaacagcatttctttttttttaattaatttatattaaagacagggtcttgctctgtttcccaggctggagtggagtggtgcagacataccttattgcagccttgaactcctgggcccaagcgattcttctccctccgcttcccaagtagctaggactataggcacatgactccatgcctggctaattttttattttttgtacaaatggaggtctcactatgttgcccagactggtcttgaactcctggcctcaggtgatcctctcacctcagcccagcatgctgggattgcagatgtgagccactgcacccagcccagattttttatatattgtgttgtcagtggtaaagatgatagagaatgtctcattctgctgataggagtataaattgatacaaccacttaggaaagaatcaaggaatatctggtaatattgaaaaaccccacagtttttaatcacattcacaaaggtattctttataaagactggaaacgatctaagtgtccatctttagggaaatgggtaaagtatgacagagtcatgatgagaccactatacagccattacggaatgaactagatccatacgtcaacatagcacaactgaagggcaaaatagagtgtgaacaagcaagtttcaagatttctttaaggtattttaattttttaagcagaaaaatactatgtagtgcttatgattgtggtttccagagtgggagagagtgagggaattggtcttggaagggtacgaaaagatcttcaactttatttgccattttaaaaaattgtggtcaaatgtatataacataaaatttatatatatatatatatatatatatatatatatatatatatattttagacagtctcgctgtgtcgcccaggctggagtgcagtggcatgatcttggctcactgtaacctccgcctcttgggttcaagcgattctcctgcctcagcctccgtggtagctgggattacaggcgtgcgccaccatgcttggctaatttttgtattttcagtagagaccatggtttcaccctgttggccaggctggtctcaaactcctgacctcaagtgatccgcccacctcggcctcccaaagtgctgggattacaggtgtgagccactgcgcccggcccaaatttatcattttcttaagtgtgcagttaagtggcattcagcaaccatcaccaacattcagctccggaacttttctatcttctcccacctgaaattctgtacctgttaaacaatggctgctcattctcccctcccctcagcctttggcaactgccattctcttttcagtctctacaaatttgactactccaggtacctcataagtagaatcatacaatatttgtccctttgtgactggcttattatccttagcataatgtcctcagggttcatctgtgttgtaacatgtgaccagatttcactccttttaaggttgaattatttgctggtttttaaaaaaattttgaattttagttggttaatatgtggagttttgttatattattgttcgcaccttttatacttcagaaattttctttccaaaggaattggttgatagaagattataagggaaagcttactatcctgattcagatgatttactctagtttattttccgattcagtgtgaccgcaacaagggaaaacatggcttatactgtggaatgcctgcggggtgatgtgtaagtacctgtgtgtgtttaggacttctgctttgaaagaaatactaagctgctcacttctggtctttgtaatgcgtcattatgacctctgacttccattttggattattgttcataaactgctcaaaaacactgcttaccacaagacctaaagtttcacattgagagcattacagctatgtagaatctcaaatgttggctttacatttttgactcataattcttatctcgatgtcttctgtagtgatattctaatggagttcctgctcaatgtcaccacagcaccagaatttcgtcgttgggaagtagctgaccttcagcctcagctaaagattgacaaagctgtggcctttcagaatccgcagactcgtaagtacatttccagatcacatttgattctaagatactgggttttttagaagatcaatttatagaagaaaaaaaattgctgtcaaaatttttatttttatttttatttatttattgttttgagacagagtctcactctgtcacccaggctggagtgcagtggcacgatcttggctcactgcaacctccagctcccgggttcaagcaattctcctgcctcagcctcctgagcagctggaattataggtgtgcaccaccacacctggctaattttttgtatttttagtagaaacagggttttgccatgttggtcagactggagttcagtcttgaattcctggcctcaagtgatccacccacctcagcctcccaaagtgctggtgttacaggtgtgagccaccatgcctggccaaatgttttactccttgaatttgaaaatatctttttcaaaaatttgttatttagatttattattcttttgtttctaaacatttataatcatttttcatgtttgatggtaagtaaattgtttgtaagatcctagaagtttttcctgtttccttcccaatgttttgtttttgtttgtttgtttgtttgtttttgagacagggtgttgcttgttgcccaggctggagtgcagtggcacaatctcactgcagcctgaaccttctggactcaggtgatcctcctacctcagcctcctgagtagctgggactacaggcacacaccaccgcaccctgctaatttttatttttatttttttatagagatgaggtctcactctattgcccaggctggtctcgaactcctgggctgaagtgatcctcccacctcagcttcccaaagtgctgggattacaggcgtgagccactgtgcctgacccctagtgatttttaagagttgttttgcttaccccaaatcctacaccagtttattgctgctgctattattgcttactattgtattgctattattgtttagccatctcctctttattgagtctttccaaagtaagtaacttaatttttttaataggaatcttttttgcattcatattttatgtttatataatgtctaattatataatcttgacaagtacaactggtaatacaagtctgtaagcaagcgccgctgactcttgggagtcatacaacttctggtgggagcagaaatgtgcaggaagagcagaaatagctcaactcagtggttcagcatgggacaggctcccctccacatgcaggcctggggactgatgttatttcatgatgatgcttggtgtcacagaggagcattatctttgttgctcaggatttctactgaagaaatagatagaatagtacaattttagaaaagatgacctatgtgtccagagtggcttcttccccactggcggcagtgaggcaccagcctgcatctattctgcctgaacagttactgtgtagtctcctggctggtgtcagcctccaggtttacgtcttgagtccatctcccacacggccattacagtgatccttctgacgtgaaagtaagccttcttattatctatgggataaagtccaaacagcatatacgtatatggccttgcgtgatcttaccccagcccacttctcttactttatgctctaccctcttctccttccagctgcaattcccatttgaatcaaattattgttatactttatgcctttgttttgtctgcttcctgtgcctaaaatgctgttcccaaatgatttcccctgggaaacaccagctcattctgtaagatggatcccacatattacttgtattaattgttttccaattcccactgcccttgccttgtacctctactgcacttttgacacactgccgacattgcacccataatactttatttcacagtttttcctcttaaaatttgagggcaggcattgtatgttccacatctctgtatttctagcacctagcacagtgcctcgcataggcaagttgccaggtaatgagcaactgaaggaaatactgcaggcaaaaaggcattgaagcaagaaagcagggaaagcaccaagcaccacagaggagtaagtcccagtggaagctcccattggtcccctgaaagctacctgacaatctccttattacctagagaggaaacctaggagtaagtaaaattcagattaaatgacttgtccaaggtcacatggcaagatggcggcagaaccataactagatggggacttcccaaaacccaggccagtataccttccaagtgataccagctaggttaaagttagaaaagtggtttaggtggactccagtatatagaagctgctgccatgtaatcttttttatttttttctcagcacattctactggcagaaactggcagttactagaggttaaataataataaattttaagtcctcttaacatatgaatgccagaagatgaccaaatttgtataggcttgttgctttctaggttttaaaaatgttgtctttactgaaagtgcatttccctaaatgcttcttcacttatctcacagatgtcattgaaaatttgcatgcagcagcttaccggaatgccttggctaatcccttgtattgtcctgactataggattggaaaagtgacatcagaggaggtaccaataaaacatattttgaaatgtgcttgtttttcacattaaattgaacatctcccatttcaggtttgtttgttaatttttccttttatcttctaactttaagaaattcagcgtgctagctttttcatccacctgctttttaactaaaattttatctgaacaatttttgtgtctcctttaagaaatgttttcatgactaaagggacatgatcattacagaaaaattaaaaagtaaaatcaaacaaaatgaagggaaagaaaacatctcacatacctaaaggcactcagtgttaatacctggtatattttcttctaaaccgttttctgtgtgtatgtatcttttttgtttgtttgttttaaatacggggtcttgctgtgttgcctaggctggtcttgaactcttaagctcaagcagtccttctgcctatgcctctcaaagtgctgggattacaggcatgagccattgcacccagcctgtgtatcttttttaaacagtatttaaatgtttaagtatcataataggggctgggcccagtggctcatgcgtgtaatctcagcactttgggaggccaagacagagggatcacttgaggccaggagttcaagaccagcctgggcaacatagcaagaccctgtctctacaaaaaaaaaatatatatatatgtgtgtgtgtatacatatatataaaataggtcctttgactaaaactctttggtctctctgaatttgtaaataagacttgagcccacttccttagctcctgttccatcctcgctcactcattcacgttcttcagcacaccagcctccgtttgctggctataggggtttgtcacatgccacagccatatgtgcatcttagaactttgtttccaaaacatgaaacattgaatgctaaatctacaagtgtagatatgtgcgtataatcttaatttcctattcctaccacccagacccaaaaacaaattttatcaaaagacattaagagaaaaatttgtaattatcaacaccttcaaagtatatctgactcaaaaattcaaggtttttattctcgttttattcttagttagctgttacagaaaactaaactgtatcccttgctctttttgacttatcaattaacagtttgatgcctttcattcatatggcacttttatttagaaattttaacttacatcatccaacttgaacaggcagccgttttcataagactggactctaatgagttttgaaatttttcagaaatcaaattcaccctcatgaagatgtgtcattaagttagctaaaacttagcaaaagtttatctacaaggatggctattgtaatactagtttataattgtgaaaaattagaaacaagttaatatccagcattagggaactagttaaataacttatagaatggaacagtattcaaccattcaaaaatattagttgatacataaaactccacagcatgttgtcacataaagcaatttatggattaggacataccaaaaggtcccttttttttaataaaaggtatgtatgtatgcattatagacaaatatcaagatgttaactgtgataacttggttatctcaaagttaatagtattttttaaatgtgtccctaggctaaaggaaactctaaagaaattggcgctagaatacttggagcaatggcagcatcaatagaaaaacatcaatagaaaaagagtatgactttccaaggttactccataggtacagacaccattcattttagggcacggattatgataaattgattaaaagttcagtttcattactttagcccagtgattctcaaaacgttatcactttccttcctgaggagcctttctagccatttttttctaaacctcttacttttaataccacagatagagtttatgtgctgtatatttgtactttttacatagaagtcgtaagttttttttttttcttagttaccccaaaccaattttcacccatctggaaaggatagcatttctgttgaaagtacatgttttagccctacttttgtatattaagcctaaggtggtaatataaaccagtgataaccaagtctcaccaatcttcagatcgcctgagtggttgattggatggatgggtagttggtcggttttaaataaggattctaggattccacatttaatattttatatcagtctgtagggtaagtcccaagaatgggggacagtgaccgtttttgtttttcaagctgagtaattgtgatcttacagtttcgacaccctggtatagacaatgacttcatggtcagaaaagctttatagagattggcttcaaagatggacgagaagggtgttgtggtaaaactctgttagccctgttatagaatgttaatagtgcttcattactacttatataaacacaaaagaaacctgacatactacgtaagctacattataataaaaatcatagtccacgttttcaagtttaggccagtgtatgctctaatttctttttattcctttttttttttttttttttgagacagagtcttgctgtgtcgcccaggccagagtgcaatgacacgatctcagctcactgcaacctctgcctcctggattcaaacaattctcgtgcctcagccacccatgtagctgggattacaggcgtgcaccaccatgcctggctaatttttgcatttttagtagagtcaggatttcgctgtgttgcccaggctggtctcaaactcgtggcctcaaatgatccgccagccttggcctcccagagtgctgggattacagacatgagctactgcacccagcctctttttattccttttataaataacagctttgttgagatgtaattcaccatactatacaacctatttaaagtgtacacaattcagtggttttcattatattcacagagttgtgcaaccatgaccacaattaggttctagttcttttaagcaatagtttttataataaaatcccagggtaattcacctcagttagtaccttgtagttcattacagcaacttataaggccttataagtatttattttcttccaaactgtacttttatgtttttacagctttttatatttatgctaatataacctaataagtgtttttaacttcctcagttacattacttcgttcagaaccatttcacaagtgcaagaatggctttgattggacttggtaagtttagagtattgcctgcctgtcagtttgcttccttaagagcagttccttaaactgtaattacgtgaacataggattgaacaaaatttgaaaacttcggccttctatttatgtcagacaggcaatatatcataggattttaattgctagtcatttgttttggaaagcagaatccaacatttaaatttgtaaaccactggctttaaattctttacagtatttgtaaaacctgtgacaaaggtgaatttctcaaagcaaagagcttttacaaacttttttaaaaggaagtacagcttactagaaaaacaggcaaagggcatgaacagacagttcatgggagaaatatgtttgtatatgtgtagccaactatctttgttttaaatgatcagcctcactaataattaagaaaattttaatctgtgatgttggcaaaattaaaagatggactctgcccagaattaaccagggtatggagaaataggcactctcacaaattgttagtaggaatataaactagtacaacattttgggagatctttttgaacatatctgttaaaattctaggctgggcatggtggctcatgcctgtaatcctagcactttgggaggctgaggcgggcggatcacctgaggtcaggagttcaagaccagcctagccaacatggcgaaaccccgtctctactaaaaatacaaaaattagtcgggcatggtgacacatgcctgtaatcccagctatcggggggctgaggaggagaatcgcttgaacccaggaggcagtgattgcagtgagctgagatcgtgccactgcactccagcaagggcgacagagtgagactctgtctcaaaaaaatacaattccaaatgtttacactcatagacccagtgacttttaagaatttgtcttacagaaacattaggtcaagtttacaaagtagttgcatgagaatatcatttgtaatattttttgttttgttttgcaaattacagcttaagatataatttacatgctataaaattcacccttttgaagtgaatagttctgtggtttttaacagattcaactattaccactacctaatttcagggtgtgttcatcatccccccaaaagccccatacccattagcagtcactccccattctcatcttccccctgcctgtggcatccactaatctactttgtttttgtttttttttttaaagagatggaggtctcattctgttgcccaagctggagcacagtggcacaatcatagctcactgccttgaactcctaggctcaggtgatcctcccacctcagcctcctaagtagcaataatctactttgtctctatagatttgactattctggacatttcctataaatggagtcatacgatatgtggccttttgtaactggcttttcttacttagcataatgttttcaaggtccgtccatattgtagcatgtgtcaattcaatgtcttattcccttttatggctcaagaatactccattaccacattttgtttattcattgattggcatttgggttgtttctaccttttggctgtcgtaaatataaacattcacgtgtacatttttcttaggaaacctgtttttagttcttttggttatgtctaagaacagaattgccaggacatatggtaactctgtttaaccatttggggaactgccagactgttttccaaagtagctgcaccattttacattcccaccagcaatgcacaaaggttttgatttctccacatcctcaccaacacttatcgtctgtctttctgattatgaacaacctactgggtgggaagtggtcattgtagttttgatttgtatttccctaatgacaaatgacattgaacatattttcatgtgctttttgtccatttgtataactttttttgtttgtttgtttttttgagacagaggcttgctctgttgcccaggctggagtgcagtggcgcaatctcagctcactgcaacctccacttcccaggttcaagcaattctccggcctcagcctcccgagtagctgggattacaggtgcatgccaccattcctggctaatttttgtaattttaatagagatggggtttcaccatgttggctggactggtctcgaactcctgagctcaggtgatccacttgcctcggcctcccaaactgttgggattacagatgtgagccaccgtgcccagtcaactttggagaaatgtctattcaagtctttgcccatttttaagtttttttttttaattgttgagttgtaaaggttctttatatattttggttactcaagctgttagcagatatattatctgcaaatattttcctgcatttcatgggtcctctttttactttcttgatacagtgttctttgatggacaatgcaatgttgttttaagagctaactattagaaacatgctagcgtccattaggaggggattgatcaaataaatggtggtagagccatagaaagggattctttataaccattaaatatttgatgtagactactcacttagaaatttgtaaattatgaaagataagttagaaacaatatcaatagaatgataccattttagaaataaattgaagataatattaactacacagaaaattctagatgaatagtaatactaagtatatagtaaatagtttagtaatagtaaactgtaattgggtatctctgggagagtggcattatggcaggaagactcttatttattttgtagtgttaggattttacaatcgtatttttaaaacaaggaaaaaatattttacgattgtgttttagtaattgtggttctagctttgtttttgcttctgttgaaacaggtgtgagtcatcctgttctaaagcaagttgctgaacagtttctcaacatgaggggtgggcttggtttatctggtgcaaaggccaactaccgtggaggtaagcatttcattctattagggttaatttatcagaagggcgtttccccactagaatagcatattgaggtggaataggcctgaatatttactactgaacagtctcggcatagaattggatggcttgggtgttgtattttgagcatatgttttgtgtgtgtttggggacaggatggcatggggaaagcaccgagctgcagaaaagactcgtgggttaatactgtgttgtaggaaatactggagaatgaaaccaatggtgaacaagccattttcttcttccctctatccttaatctggccccaggtgaaatccgagaacagaatggagacagtcttgtccatgctgcttttgtagcagaaagtgctgtcgcgggaagtgcagaggcaaatgcatttagtgttcttcagcatgtcctcggtgctgggccacatgtcaagaggggcagcaacaccaccagccatctgcaccaggctgttgccaaggcaactcagcagccatttgatgtgagtctgaacagttggtatctctctttttgctttcaaaggctcagtatttaagatataattctgataatctactcttaaaatgtaagacaaacacacagaaaatctttgtacaattgaagagatagccaggcttgattttagtatctttgaaggcctatcaaaaactcactggcttttccactttgtctattacttgtcattagtaatataaaaagaggaattgaatgcttagaaataaagggaatccacacatccgttccctttagaataaagttgtagatattaaactttcccctagattctaactagtctttttttctagattttcttctgtccgcttctgttcttttggttacttcctgaatctcactatttgttttccaaccaagtggacaagatgaacaccaagaaattgtttacagactcactcattcagcttgagattaaatttgaaaagaaaaatgagaggctgggcacagtggctcacaactaaaatcccagcactctgagaggccgaggtgggcggatcactggaggtcaggagttcgagaccagcctggccaacgtggtgaaacccccatctctcctaatccaatgaagtaatttaatagaaattcctagttcagaactcagccagaaatttagagtataaataggatggcctcagaattataattaaagaaattgaagtccaggccaggcacagtggctcacgcctgtaatcccagcactttgggaggccaagttgggcggatcacaaggtcaggagatcaagaccatcctggctaacacagtgaaaccctgtctctactaaaaatacaaaaattgtctgggcgtggtggcgcacgcctgtagtcccagctacttgggaggctgaggcagaagaatcacttgaacccaggaggcggaggattcagtaagctgagatcgtgccactgcactccagcctgggtgacagagcaagactctgtctcaaaaatatatataaataaataaataaaagaaattgaagtgccttcttatgctttacgtggactgagccaatggttctccaagtttattgtacataagaattacctggaacacttgttaaaaatctgggcttccaggctgcatccacagggacctgagtcagtaggtccattttgggaatctgaaagtttgtatttttaataagaacttagataatttttatgtaaatggtccacataaacactgcaaatcgggttcaccctagagagctaaaagctctgctcaaactagataacaatatccctgttattcagaggttaaactcttgatagcttggacatctggataatgaccactaagcagaaatttttctctaactttctgacatgagtgtataagagaaatgaaagtaaattggtgaaaaagtccctaccaacagcagagagaagaaacctggtctgcctaatgccaaagcctatctatattataataataatgtttgcagattagtgtttgcataaacctttaatcatctaaagcaggttagaaaatacccagcataaaggaaagggagcagtcattttagaaatatttaaatgaaaaaacaaagccgtgatagttctgaaagaggtaacctatttacagaatacttcagttcgtgacagaactggctaagtaaaatattaatctattttgtttataccgtgaaggtccaagttttttctaggcaaacttaaagaaatcgtgccctgttttacttggtagaatatcatacagtaaagtctcattatctttcaggtttctgcatttaatgccagttactcagattctggactctttgggatttatactatctcccaggccacagctgctggagatgtaagttgcaaactcaccaaacttctttcatgaacaagttatttctcccccccgccataaacatgttttcggttaaaatatggaatgtttgaatgcagtgcaatgacttatcagagctctgtatagtatgatgtcattgaagcattatctgctatagggaaatttacacatgtatactaatgcttccaggaaagaggagagaattgcctccttcatgttttggttctggttggacaagttgcattgagttggctctgagacatctaaattgagaacccaggagaggggaagaccaggaggtttatttgcaagtcttcagtgtagagattgtgttgaaatcagggatatgtgtgaatgattgtaggaaaagaaaactaaagctcaatttctgggaaacaacaccatttaaggagcaagtggctaagaaaaatggcccaggtaaacagaaagaaaaagagaagctgatatatttgaaggataggaaagagagtatgtttaacaccattttgacccacagtgaaataacattcattaccactgagaagtctggtagtttcagcaagctaggacatcatgggtgatcttaacagttttgactagagtagtggaaattgggtaaaatgtgtagtgattaaggaatgaatgacaagtaagaaatgagaggttggtgtgggctagtggagcttagacattcaaggagcaagttgttttaggagagtttacactgagagattaggttgaaagagacatactgagcaaaaagatcggagcagatatcggagatagaaaattataaatggctcaagtctgagaaaggaatacttgggatccagcacacaagtggaccttttagccttacagacaggctaatattggaagatattgggaagatggggaagtacctcctcagtgagacaggaggctaagtcatgttttgacagacgtgagaggaaagtttaaagaaagtagtgaagtttgggacagacaaatagtgaggtacacaaaaagtgggtattcgctgtagtgtagatgtatccttgaaatcagcgaccacaaattcatagtacagtcagtcagcactgtcatgtaatttttcttcagttgcattcagaagcctaatagagaaatggaggaggtaggtattagggttaatcccaggttggaatcctgcaaagtgggcaggtgagaagtatgaggagatagcaagggagttgggagcattggcaagagtgattaaaaggatgattcagggatctaggctcaatagagaagtgaagccagagggggcctgataaattgaaagactggacaagtcaaggaactagagatcttgataaagtggaagaataaggatagtgagattaaagactgaggtcggggtcttagaattgagggcttcagaggtatgcaaatttaggctatgatcaggtctggggtgtggctctgaaaatgggcagctaaaatgaaggggaaacagaggtcctagaatttaggtgatcagagggaaaaataagtagcagacccagccagcactgggatggagaaaatcatggtcagatttatttatttattcaacaaatatttaccaagtacccacatccccggaactttattctttctttctttttttaaataccatacaaggattcagattccttcttgaccctggcttacaaagtatggacaagccttacaaattggctgtgtatggattactactctcttcttagtgaatagtaagagatagcagtattaatggcatgacactgcaagagtctggggaagttttaaaggtgcttattctttatgggtgattagaaatccatgtgtttggccgggtgtggtggctcacacctataatcccaacactttgggaggttaaggtgggaggatcacttgagcccacacatctctacaaaaaaagctaaaaaattagccaggcctggtagcatgcacctgtagtcccagcttcttgggaggctggggcaggaggattgtgtataaacagctgctttatgaacataggaagaataaggaacccatagtgatgacagcattccgcatggacactgtgctgtttgtctggaactaaccttccatctgtgtttttgcctcagtaaagaagtgtgtcagtgctgcaggagactctggtactgaccacagatgaccaacttttcttatctgtcctaggttatcaaggctgcctataatcaagtaaaaacaatagctcaaggaaacctttccaacacagatgtccaagctgccaagtaagtctcagtattaactgtgttttatgtttttgttatttgaaagttgtattcttttcagattataacaatattacaatctatgctcataaggactgagaagtacagaaaagcgtaaaaagggaaacatacccatatcctaccacctaaagatataattgttaacattttggccaggcacagtggctcactaatcccagcactttgggaggccaaggcaggtggttcatttgagaccaggagtttgagaccagcttgggcaacatagcaagacctcgtctccaccaaaattagagaataattgttaacatttttcttagtttattgatcatgcatttttaaacataattgttaatattgtatatatagatgctgcttgacttacactggggttacgtcctgagaaatgcgcatatcgaaaatgcatttaataccctaataacccagtcatccagccaaacaaacataagtcaaaccatcataagttaagttagggaccatctgtatacttttttatcttatttaaatagcatccttattatagaagtttgaaaattacaaataaaagacaaaaatgatctctgatttccctagcaatgattctgtttccattgattcaaattactaaaaatttaaacaatattcattggtgtgtcaaaatacacttgtgcattttctgcagttataaagatatctttgggcttaaaatatttttgtgtttcgtattactttcttggtgtagattcccaactaagttaagagttataaacataacgaaagactccatgttagagtgtgtgtatgtgtgtatgtttaaataatacatttgactaggcgcagttgctcatacctgtaatcccaggactttgggaggctggggcaggaggatcacttgaggccaggagttcaaccagcctgggtaatgtggcaagacactgtctttacaaaaagatatttaaaactagccaggtgtggtagtgtgtgcctgtagcctcagctactcaggaggctgaagaggggggattgcttgagcccacgagtttgaggctgcagtgaactaagatcacgccattgcacactagcctgggcaacagagcaagaccctgtctcttaaaaaaaaaaaatgtatttctaagtcacaaatctaaagagattgtaccagtttataatcataccaccagtatataagagtacctattctacaatagtttctttcttcataactaatttatacccaaaaaagatctgattttgttttgttttataagaaagactaaaatacttgtctgctatttggcaatttataaatccccactgtccagattgaaagtgctatcaacactcctaattcattagtagttcgagggtttctctaaaagagacagacttgggacaaagttggaaatcaacctgcattttcatacagccgcttaagacatttaagtttgactccatctacttagaacaattcaaaatgtgaatcttgcaactccagtggtcgttatgatcatttagtattgcccacaggggaagcagaattacaacccaggatggaacaaccttttggtcatttctgttcccattagtattgttagttttgttatgctgagcacactacaaagttgcatctcttgtataagtacaacacaatttattaaatattgtatacatagaaccaagaatcgataggatgcagggctgcttgattgtaccagaaacaaaacatgatgagaatacattgaaacactggatttacttaagaaaaacctaagtttttcaaatctaatttatttaagaaaacgtattttcttaataagtgtaacacagttcttacaaggtatggtaataagcagaaagtagaattttgaatattaatgtcaaagtatgttttctgccattttgatggagttgatactttttcttgtaagttcttcctgtagtgaaagagagaaagtgaggtgtcattgccgaaaggacacactaataacctcttggtagtttattgcaggtaaaatcattttttaattaagctgacaacgtggtaaaactgcagcattaaattgtaattatgtttaaatggaagtctttctgtagagtgttaaaggatgataaacgtttgaggttcaaataactcgactgtcttatcaaacaccatgtctataagtaataagtttctgggagaattgtgaattggattttgttttatttcaagtggatgcttttgtgcccatatttaagctgccgttgcttacaagacctgtactgcccttccccacctgccttttccatcataccctatgctcacagacaaatctcagcaagaggcaggagttgcttcactaatcaaaaccttacattaaaatagttttacctagatctaagttctagtcccaaatcaaaaagcaatctgtggagttttcagtataatttcgtactgacagctttccaaatagtaacgtaaacggttcacgtacttggtgaactgaagaaatagaatggaggccattagcactgtaagttgttagtttgcctgtttaccaaaaatatgttgagtttcggggcacataccttaaaattgccctgtttcactgtgtaagaggaactggcttgactacttcacccttggtgaaaacaaacaggccctaaaagaggcagcaacagctgaagtggatatcacagaaataaacagacagcagaagctcttcagacacccccgaaacctgccaaaactcacaggtaatacaagtgaaacgatagcataagaagaaaataaacatgagaatcttcaaactacaagcattgaacggtatcctccatccaagaagagaacccacttcatacaaggaaaaggcaaaaggaaaaggtcaagactgtgacctttataacactgtgaccccagctgtgggccaggtggagttgtctgtggtgacaccaagtacaggcctgacaccctggtttgacagaaggctcttcaagatccctggtcttcacactgtagcagccaaaaggtaggtttacaatatacactgtccccaacttgccatggatcaattataatttttcaacttgactatggaggaaaaccatcgcaatttcagcttccagtcatgggtcacataacgatggggatacattctgagaaatgtggtgttaggtggtttcatcactgtgtgaacctcagtgttcagacaaatctagatggtatagcctactacacacatgggctctatggtatagtctattgctcttaggctacaaacctgtatagcatgtactatagtactgaatactgtaggcagttataacacaaaggtaagtatttgtgcatctaaacataggaaaggtacagtaaaaatacagcacaaaagataaaaaaatggtatgccatttttatggcatagctcctgctttcgagtgagtcagtgagtgagtggtgagtaaatgggaagggctgggacattactgtgcactgctgtagatactaaacactgtaaacataggctacgctaaatttatttttttaaaattgcactacaacattatgttgtcagtaagtaataggaatctttcagctccctaataatcttaacgggaccaccatcatatatgtggtccatcattgaccaaaaacatcattatgtagtacatgactataccttgaatttcgatcttttcctaggctagtgatatgcagtacatgagataatcaatgcttccttacaaaatgggcttatgttagaagacttttgcccagctgcaggctattgtaagtgttctgagcacatatgagataacctgggccaagctatgatgttcgatacgttaggtgtattaaatgcacttttgactgccatctcagtggatgacagccttctcactgacagcagagagatcttcctcactgtgccagtgggcaggagaaagagcatgctgcgactggccagtgacatgcagaggatccagattgcacaaccggatccagaggccttgggaagcattagggagctctccagctgtctcactcaaatctgtagcagcatatggacccacaaatggaggccaaagtgggccctcaattggacactttggcaaccctgaagagacttcttcccttcagacttactgttttagtatgttccagagaagggagtggcattcttcttggggaattcaggaagagggagacacgctgttactctatccattaaataaagctttgatgttcacagccccccgccaccactcagaaaaaaaaaataattgccttgctctctaaaactgacttctgccttttattggacaggaacaagctgaaagctggatacctaatgtcagtggagtcttctgagtgtttcctggaagaagtcgggtcccaggctctagttgctggttcttacatgccaccatccacagtccttcagcagattgattcagtggctaatgctgatatcataaatgtaagtaaatgaaaacttaacgatttaacaacagagaacttaaccttaatgatccaatttcagaaggatgcataagcgtccttgggcagtgtattattcttatgtttggtgctcatctacttaatgtggaggcaggagggctcattcccataagatccgcaacaagcttccctgtcagctcgagtatatgtatcttcctccttcaaataaactaccattaggttaaactgtgatgtcagtaagagggctgccatccactgagatggcagtcaaaagtgcatttaatacacctaacgtatcaaacgttaggttaaactaatggtagtttataaaatgggcttatgttagatgactagaagtaaagaagagtcaaatattagcagtttcatatgatccaacctaaatagtgaagtttgctatttttcctcttcagtcctagcaatatttcaccatctagcatcttaagattttctttactcttctcagcctaggacattctcttgttcttgctaatttttttttcacatatattattgttccctacaatattgagctgttttgagggcaaggactatgtcatgtacttctttgtgttccctgctgtgcctaacaagcacatgacctacagaattaatccaaagtaagtgggttttccccattttctacattaaacttgccaacttgctttctactgtagatgtctcggccatcttctcaccaacaggtctaccttgtatagggacagtggggataagaaaaaataaaaaactaagctgggtgcagtggctcattcctgtaatcccagcactttggaaggctgaggtgggcagattgcttgagcccaggagttcaataccagactgggcaatgtagcaaaaccccatctctacaaaaaagtacaaaaattagctaggcttggtggcatgcgcctgtagtcccagctactcaggagctcatggggctgaggtgggaaggtggcttgagcctgggaggcagaggttgcagcgagccgagatcatgccactgtactccaggctgggcaacagagtgagaccctgtctcaaataaaaaagagacaaggctattttaagatagtaaccctgacttgatttcacttcgccccaatcgtcatttcatactcttcttttttttttttttgagacggagtcttgctctgttgcccaggctggagtgcagtggcgcgatctcggctcagtacaacctccgcctcccgggttcacgccattttcctgcctcagccttcctagtaactgggactacaggtgcccaccaccacggccggctaattttttgtatttttagtagagacggggttttaccatgttagccaggatggtctcgatctcctgacctcgtgatccacccgcctcagccttccaaagtgctgggattacaggtgtgaatcaacgcgcccagcccatttggtactcttttaaatggctgtcttcatcttatatcctatcattatgtgcgtcccaacccgactgcttccaccaccacctctccttcatagtaataagataagctggcctgacagaatatgggggctgctgctccacctacacctgactcatgatactacacttaaccagcctttgaacttggaagtagtggcataaagaatcctctagggtatcaagttttacttttaagttaacaatcaatgtatttttattgacccagactatttgccattgtaataccgaaacaggaaagtatatccctgcctgaagccacactactctatttgacagtgtcagtgttgttttccttatctctctttgaacagctaccctcttaccagtgttgctcttgcttggttcattacacatacaatgggactttcagagaaacagctaagcttttcctcccacactgtcccaaattaaagcaccagccatctcctagttaattttcacaacagctattatagtaattgctggcttagaatgtcctatcgaaggccaggttggtggctcacgcctgtaatcccagcactttgggaggttaaggtgagtggatcacttgaggctaggagtttgagaccagcctggccaacatggcgaaatcccgtctctactaaaaatacaaaaattagctgggcatagtgatacatgcctgtaatcccagctccttgggagggtgaggcagagaattgcttgaacctgggaggcggaggctgcagtgagccaagatcgcagcactgcactccacactgggtgacagagcgagactccacctcaaaaaaaaaaaaaaaaaaaagaatgtcctatccataaattcttgaaatgacaaaataagttcgcctgcttgatgatatatatttttatttttgttaattttgtcttttgtttgtttctttaaaggcggcaaagaagtttgtttctggccagaagtcaatggcagcaagtggaaatttgggacatacaccttttgttgatgagttgtaatactgatgcacacattacaggagagagctgaacgttctctcagcccagagcagcaaacacatgaaagtcagaagtctctaatatatcatttgtcttttttccagtgaggtaaaataaggcataaatgcaggtaattattcccagctgacctaaagtcaataaaacattctgtttaagtgtttttcttacgtttttctcaatgagttaatcaacaagtatttattatgtgctgatatctttgttttagatgctttaaaggagacaggaatataattattgagtatagaagcatcagaaactattaaaattaaggctaagtggctatcggggtaaatagtgccagattactattggtggcgtttaagatgaaagcaagttcaaaatttgtcattttgggtgtcaacagctaaatggtctggtttttacccctgttttgccttttttgcaataaaattatttccaaaaaacatacatttcctatcaatcatatcctatattcccattcattcatttttttatgtctgatttatcttcattgacagagttttgtttttctctcatctcctgtctctcccttatctgttactatcctgtctcttccaaataattaactctcaattcaacatttacagtaaaagaagggctaaaaaggggaaaaaaaaagaattctaatgtgaataactagccaaagaattatgtctcttagttattttaattatagtacttgaagtttaccaaaaaaaagagagaaactaaatatttaaagaaaaatgtagtgtttacataaagtgacattctctactatgttcagacattctgatattggatttctctacggcattttctaaaagaaagaaattcttctcaaaaaggagggtcttattctgaaaataagatttgtgaggcctgcaagaacccaaggaagtctttagataatcctgttgaagaacatctctaaaggctttataacgcagtcataagagaagagaattggtgagtctacagacagtccttgataagtacagcaaacttgtgcctggtgaggcacaaaacttgggtgtctgcaagataaatgctcatatgaccacagatttgctaaccaacctttgataccagttgggctttaccctcttcaacttgggcacaatcttccagccaaaatgcatctgaggtagaggaggtagaggaggaagagctttcattgtcttgcttcaccattatccagtatggagaaggggccctcacttctttcttgtcgtctctgtgaatcatcacgtcacaattaatgtcttttcctacactaatagtatggttcttcttcttatatccatgccagtctctggagatggatattggtctccttgcagggtgatgcacagttgaccacggatatctataatattgaagtcttttatctaaatctacattttcattatcatcactgcttgtgaaagattcatcttttgccagctcaattttctttggtgtgctgaaatgaaaagaatagtgaataaaatagattcttcatgtctaaacatttatggtcccctaacaagatgccttataacttgctttgactcataaaagatacaatttagctttagcattacctttctgtgtcattgaaatgtttctcttttttaaatcgtcttgaaatctttttccatttctaaatggaaatcaaattctgccttaaattacttcaccataccttaaaaagttttgcacagacttatactagactactgaccagaatattaggaggtgttaaagggtaggttaatttcactgcagctaaagtgacggattcaacctggccatctcctgagaactctattcttgtggctcacgtggcattaacacaacattactgatttccagaggagtcaggaagtcaggaaatagtgggccttaaggatcttcaacatcctagtcattagtaagtcttagagtcttttttttagagagggtcttgctctgtcacccttgctggagtgcagtggtacaatcatagctcactgcaaccttgaattcctgggctcaagtgaccctctggcctctgcttccaaagtagttgagactacaggtgtgtatgctgtatgccaccgcacctggctaatttttatttatttttatttatttatttatttttaaaacaggatctccctatgttgcccatgcctgtctcaaactcctggcctcaagcaatctttactttggcctccaaagtgctaggattacaggcatgagccactgtgcccagccaggtttttgttgttgttgttgttgttgtttttaactttctccaattattgactttcttgattgttgaaactaggtggtgcttgcctgctagcacctccaggtctctgaactttcctaatgcctacagtacctgtgcttgctttaactttccagaatgaatgctctgtcacctgctttccctcatcctggtgctattgcccagcagaaccaaaactagatctttgtgattacaaatctctggtacattctgccctgctaaaaggaaataggtttcttccctgccaacctgttaagacttctggtgttatcactaataaccttggcagtctgcctgttgtatttgcttccaataatttgaatggcttttccaaaagtttatctcttccagtaataaacagttgataatgagtaatttttactgagagccactagtcttaaatactgattttctttgtctgatttgccttcagacacacctaggtcttcctgaacagcacatgaattttttttttaaatccaagtattagtaacttttttttttcagactgcagggggaatccttggcaactctgatggttaggtaaccataaaggacaggtaaattgtcattaggtaataaagccacaaccctgcagaggtcaggattggctagaaacaaactttctataccacttggcctacccagagcgttacatggagaatttctccagtgtgtatacccagtgccattttctcctggaaaagtttatactagctttgtgaaagcatctttttccttcttctttccctgccgcgttatacataagttactaaaatgcctcagatatgggtactttgcctaattaagaaagggaatcagcaggtgcttggtattgtttgtgggttttcgcctcttacttaagttgtactgttctatcttttctttgcttttgaatggtcagtctaccatccttagaatttaatattctggatctcaaaactcctccatgtaatgaaaatgcttagaacatagttgttatgtaatcacatgagcccaggcttttagagtcgtgccctccagtgtaggagtcgctgagtaggatttgattgtgagttgtgatcgtgctactacactccagcctgagtgacagagtgagaccctgtctcaaaaataagacttttaaaattaaaaattaaaaacaagtgaaccactgaccacatgaaagtcctagggcaattttagcaaaacaagacagactcagtccctgccttgatggagttcacattctcccagggaaacacagtgaacaactgattacacagattatttcattaaaattgggataaatgtgaaggagcgagctgtgagagcatatgtcaggtggacctgtttctaggaagaccccttggagaagttacactggagccttcaagggtgactactgaagagcaaagttacaaacatgttgcacacagagaagagcaagtgcaaagaccctgaggcaaaacaaaaggcagagagctggaagctaaagggggctagagaaggatggggaaagcagtatgagttgaagttggaatggtttgcagaggccagctgaaccccatagagcatcattggccaatgtgaggattttgacatttatccaaagaacaaaaagtcttaagagattttttgcaggaacatgccaggatcagatttgcattacaaaaagatcattctggccaggcttggtggctcatgcctgtaatccaacactttgagaggccgaggcaggcagatcacctgaggtcaggagttcgaaaccagcctggccaacgtggtgaaacttcgtctctattaaaaatacaaaaattagctgggtgtgttggcatgcgcctgtaatcccagctaccctggaggctgaggcaggagaatcacttgaacccgagaggcagaggttgcagtgagccaaggtcacgccactacactccagcctgggtgacaagagcaaaacctcgtctccaagaaaaaaaaaatacagttttggtgataatacagtttgaaagtaattagcatgtggatagtcatagaaaccacaggcatcaatgaaactggctaggagaaaggacaccaagaggaaatggccagaggtaacaggaaaatcaggggagtgtggtgtcacagaagcctgggaagtgctatttcaagaagagagtgggtggaaattgttaagtgtctaatgctgctcagaagccaagcaagataaagacagaagaatctagtgggatcagaagtgtgaaggctatgggtggccctgggaaaaggactcagccaagggatgaaagcaaagcctagattgaagtgggtggaggagtgtctgggaagtggcgtctttcgaggaaacagaggtgtctaatacagcttttagcaagttgggagtggatgcaaaagactccagtggctaaagagggtagggagaggagagtggactgaagataggatttgccaagatgggagaagtttaaaaaggcttagatgttattgggaaggacccagagaacaaaaagttgaatacggaaaagaaaataggatttgcaagaagcactttttttttttttttttttttttgagacaaagtctcgctctatctccaggctggagtgcagtggtgcgatctcggctcactgcaacctccgactccctgattcgagcgattctcctgcctcagcctcccgaatagctggaattacaggcacgcgccaccacatccagctaatttttgtaatttactagtagagacggggtttcaccatgttggccaggatggtctcgatttcgtgacctcatgatccacccgcctcagcctcccaaagtgctgggattacaggcatgattcaccacacctggcccacaagaagcatttttaagggctgactcgggaaagaggggcaccatacaggtaggcatggggacaaaattcccaaccgatgacttgttttttaactccaggttgacttcatcgtgctttctcatattagatcctacagatctaataccagaaacccaggaaattactctgacagtgtcaccagtcctcctgtcatgatccttatcatttgataattgtcacattaaaccatctatgcctcacaggccctgggattctgtattataacaaagagttcctaaaatgaactatttaccttgttactgggaatttggcctcagggattaaatcatatatttcttgccattcttcaggaatgttaataaaatctcggtaaaccttgatttgtagcactgttccaatagtgatatgttgcaaaagctgtaaaaattctcgaagagtatatcctaacacattggcatggccaacactaatcagaacatcacctgaagagggaaaaaattatgtatcagtaaaactagaggtttaaagggactatattgatttctggctttattgtgaggtatttcattttatgggttcatattgttgattctttttgaaccaaaaccaggcttcagccttttttttttttttttttttgagatgaagtctaactgtcacccatgctggagtgcagtggcatgatctcagctcactgcaagctccgcctcccaggttcaagtggttctcctgcctcagcctcccaagtagctaggattatgggcatgtgccatcaagcctggctaattttgttttttttttttagtagagatggggtttcaccatgttggccaggctggtctcaaactcctgacctcaggtgatctgtccacctcggcctgccaaagtgctaggattacaggcatgagccaccgtacccggcccagcctttatttaataaagatgttcatgtccatgatatgaatgtcctttgcatactgaagaatgtatgcaagatgtttcttaatagcagtatattggtagacattatatgatgtttttgagacgtttctgaagttcttggtgtgacagaggctaaaaaacatttataatcggaaccagctgttaggattctaaaaatagattagtttcagataaaatgaatggctattactagaaaagaaaaaaccacttacactaagtggtgaataaatgacctactttctattatacctgcctggcaatttccagtgccctccacagttaatagaccatattaaacataaagcctttcattttaattctctacccttgtgcagtattagttgagcaaataattctgtataaaacattgggcaattaggcatgctttaactgtaagatgtgtatgcagtgagtatgttggtttaaagggatttgacagctaggtttccctaccttagggcaacgcaggataaggaaagaaacaagatgggcaaccatgcagcttccgagtccctggcaggtgggaagaggactacatcttgagcactaacccccgaaacccccaaattgaaggaagctaaaaagaccaatttttcacttgctccaacctcccccatgtccccacctccagcagctaggtcatggacctgtgagtgagatccagctacttgacactcccacctgggtcactgaacctggaggaggagatgcaaaagagtgacaggagcttctagttgctaggggtagttacacacagctcttggttctctcaccattttccaagcctgcttctccagccttttgggagattctgtcagactcagtatcccaaattcagtgcattaacagaagtgttttctgttttttgcaatgaggaaccctggctgctacaacggcattcagcaagacttcagaaaggaatacaaaggatttgctttttaaggaccagctcacattgggcaaaatcttaagtcttcagatcttactagtactgaccttctggagaccctcaatcagcctcattctaagacagctgaagcctaacctcaaagaagaaaagggtcaagaagtgccttctctgatgcatgcactgggcttcaatcaggaattacactgatcccaaaagaagcctctaaggatgccaaggacaaatgtccatagctctagatcctatcagaaacaaaagttcccagaattccagaaaacaaatacttacaagggtggagaaaaaccttctactttggtcttaagcagtagctgggggtaatacaatcaaccatgtatctgaagctcacttcagaatgaaacaaggctacctgcagcttgagcaatatgaaacagctgctcatcctactgaggttaattacaatggcaaaacaaaacaaaacaaaacaaaaacaaaaccctccccggatgagcttacttacctaatgttaaaagcagtgtttatagctgaaagctatggcttggcattctgcttaattatgttgtaaaagtgtgacttttatcaagagggcagaaaataaacagcttaatttcctgaccgttctggctgtaaaccaaacatgtcagcatgtgaatgtgattactctagcaatagatattaacattgcccttcatacagaaacaccaatttcgtacttatgaacaccaacctcattacacctttttttttctgttttaatgggctataggatgacattatataaactttgtctcgattacctacagtaaatcaactttgcagcagccaagccactactgaaaaatattttatctttttcatctctcccaactaggctggaagttccttaagttcctcaaggctaaggaccatgtctgtgccgttcaccactacacccccagtgcctagctgggtgtctgcacacaccaggcctttaggaactgcttaggcagtagccagtccatgacttgtatttactgttgaagctacattaatttctttttttttttttctcctgagacagggtctcactttgtcacccaggctggaatgcagggatacaaatacagctcactgcagcctcgacctccagggctcaagcaaccctcctgcctcagcccctggaggagctgggactgcaagcgcatatgcccaccatgttgggctagtttttgtattttttattgaaatggggttttgtcatgttgccccagctggtctcgaactcctgagctcaatttgcccgcctcagcttctcaaagtgctgagattccaggtgtgtgctatcgcacccggcctacattaatttctcaagacttagaatgtcagaatctgttaaggccatactgcccaaaaggaactaaaagtttagccagaataaactaacactaaactaaattaggaaatcaaggtgaaaccctatcctgaaacaccaaaggagagaaatttcagcacatagataaaagataatggggctgggaggaaacggggtcaaagaaatagcatgtttctacaattatcatctctcgagatcttatcatcattgtctaaaaccactgagttacagattttaaagcctagaatgatgccgaggagaactggcaggcttgtcacgaagagatttggggctctggacttcctctgtattcaaatctcatttctagttgttaggcaattgactagaaaggtatgggctttctaggcacacatcggttcaaatcccagctctgaacacagactcagttgtgtaactaagatgaacaagttatttcatctctctacgcctctgtatttcattatctacatttcaggagtgttgcaaactttaaattagataacacgtggggccaggtgaagtggctcatgcctgtaatcccagcactttgggagactgaggcaggaggattgcttgagcccaggggttcgaggctgcagtgagctatgattgcgccactgcactcctgcactccagcctgtgtgacagtgagaccatgtctcttattcaaataaaattaaaaattggagttaaaaaaagataatagatggggaaatatctcccacaatgcctaggacaaatatttattatttatttattaagcaaagacataacaaatgagccactactttaggtgtgacggttaatattgtcaacttgatcggttcaaaggatgcaaagtattgtttctgggtgtgtctgtgaaggtgttgccagaaaagattaacatttgagtcaatggacttggagaggcagacccaaccctcaatctgggtaggcaccatccaatcagctaccagcaaggctagaaaaagcaggtggaaaaaggtggaatgagcagacttgctgagtcttccagccttcatctttctcctgtgctggatgcttcctgccctcgaacatcagactcaagttctttggcttttggactcttggacttacaccagtgttttgccagggtttctcaggccttcagccacagactggaggctacactgtcggcttcccaacttttgaggttttgggactcggactgagccactattggcttccctgctcttcagcttgcagatggaggggcagaacaatatggtttggttctgtgtccccatccaaatgtcattgccgattgtaatccccacctgtggagggagggaggtgattggatcacgggggtggtttcccccatgctgtcatgatagtgagtgagttctcatgagatctgatggttttatgagtgtttgacagctcctccttcacacactcacactccctcctgccgccttgtgaagaaaatgcctgattcctcttccactatgattgtaagtttcctgaggccaccccagccgtacggaactgtgagtcaattaaacctccttcatttataaattatccagtctcaggcagtatctttacagcagtgtaagaatgcactaatacagtaggtgagtcctggatttaaaagatgaaattcaagactgcttctaacctcaaagagcccactaactatagccgtgccatgagattctctgttgcccacctaaaagcatactcctgtcccactctagcaccctggagtatgcacccggatcatcacccagcatctgtcacctgaccttgaagaagctgagaagcagcagcttccccatgggacctgtcctggagttcttttgttctggtaagtccagaactctccaccggccgccgtttattctccaccaccaagtagtgatgtgtggggaaaatgctttggattttaaggtatagcaaactgtttcataaaaccattatgtatctgctttcttctttaatccattgcttggaacccttagctgcaaattagaatcacctgaggagcttttaaaacataaactgccctgtcccagtccaagaacgattgaatcaaaaacctgtagggagatagggaccaggcatcttggttttaaaaacttcccagatgattctaacaggtaaccagagttgcaaaccagtggcttaatccactgggacccccatacagccatcattttttattaaaacacacacatgcaaaagtctagagaatctgtaagaacagcctaagagatgattgccaatatttctgtagcacttcagttttaaaagcactttcataaaaattatttcatcaggttgggctcaatggctcacacctgtaatcccagtacttttggaggccacatgggaggattgcttgaggccaggagtttgagaccagcctggacaacatagtgagacaccacccacccaccacctccattgcccatgtctacaaaaaaataaaaaataaaataaaaattagctgggcatggtggtgcacgcctgagtcccagctactgaggaggctgaagcaggaggatcacttgagccaaggagtttaaggctgcagtgagccatgatcaagccactgcactccagcatgggtgacagagtgataccccatctatcaaacaaacatgcattatttcatcaaatctgcgcaacctctgacaaacacaggaatatcccaattcaaagatgaggtgactaaggcctgaaaggttaagtggctttgcccagggtcacagaactaaaaagtgtcagaccctgagcctgaatcaggacagctaacacaatgttttttctttctcaccatggcgccagcccattctgcctccccaactcctgggcacagtactaggcccaggccaggcactgagaaaacacctcttgaactgcatggaaaattcattcacccaaagacacgaggagcagggcagtattggtaaagcccttaggctctgaagtctgacagagaaggttcaaatcccagctcctcagagtgaccatgggagagttactaaacatctgattccttgtctgcaaggtggtttcatgcagaatctagctcagggattgtgagagtgaaatgagatcgtgcagctaagtgttagcaatgcttaatactgcctacgaaagaaaatatctttacgcactgagagccatagctctggagtaacatggtccctgaatccccacttaggagaaacaggtgacctggacaaggaactcaatctcactgaccctcattaagtaaatttaattttttttttttttttagaggtagggtctcactctgttacccaggttggcatgcagtggcacaatcatagctcactacagcctcggcctcctgcactcaagtgatcctcccacctcagcctcctgagtagctaggattacgggcacgcaccatgccgggctgctttcgttttgttgtagaaatggtgatatggtttggatttgtgtccccgcccacatctcatgttcaactgtagtccccggtgttggaggaggggcctggggggaggtgactggatcacaagggcagatttcccccttcctgttctcgtgatagcgagtgagttcttatgagatctggttgtttaaacgtgtgtagcacctccccctactctctcttcctcccgctccaaccatgtaagacatacctccttcctcttcaccttctgccatgattgtaagtttcctgaggcctccccagccatgcttcctgtacagcctgcagaaccatgagccaattaaacctcttttcttataaatgacccagtttcaggtatttctttatagcagtgcaagaacggactaatatagacagcatctcactgtgttgctcaggctggccttgaattcctggcatcaacggatcctcccaccttggcttcccaaagtgctggaattacaggtgtaagccactgtacccagccagaattaaatgaattaatatgcccaacagtgatagttatataagtgatagccattggctggcccatagaaagttctcaactaatgtcatatcctttttttttgagacagagtctcactctgtcacccaggctggagtacagtgctgccatctcagctcactgcaacctccgcctcccgggttcaagagattctcctgcctgagcctcctgagtagctgggactacaggcgcccgccactaggcccagctaatttttgtatttgtatttattttatttatttatttatttaattattttttgagacggagtctctgtcactcaggctggagtgcagtggcgcgatctcagctcactgcaacctccacttcctgggtacaagcgattctcctgcctcagcctctcaagtagctggcattacaggcatgtgccaccacgcctggctaatttttgtatttttaatagagacagggtttcaccatgttggccaggctggtctcgaactccctacctcaggatccacccacctcagcctcccaaagtgctgggattacaggcatgagccactgctcccagccagtttttgtatttttagtagagacaaagttttaccatgttggccaggctggtctcaaactcctgaccttaagtgatccaccccgccttggcctcccaaagtgctgggattacaggcatgagccagcatgcccgtcatatccttatagttacactgaaacccggtgacccgagtcaccctgcaggcagatgggcaggatgggtggttgggaagcatggcgaaagggcaatcacctggctggagtttcccgtcgttggctgcagcccccttcctgatgaggtgggtgatctggaggtagggtccatgctggatgatgatgaggcctaatcccaggctacccacagtgagtttggtctgctgtgttttgctcaagttgtgtacagatgttttgaccttgttgctgactcctctttctaaccaaaagaggggaacttatttcagtccttcaccaagacagaagcatggccatacctactggggttctgaagccagatccctgggacagttatttaatccctgttcctcagattccttgtcagtaaaatgaggataaaaatgttcaccttggagagctcttctgaaaattaaatgggtgcattaaagggcttttgcagagtctggcatattgtgagtgcttaatcaatattagttagtattatctgttcacttaacaaatatttattgatacagtgtgctaggccctgggtttaccatggtgagcaaaacagatgtgttgggttttttggttttaacagacaatgtctcactctgttgcccaggctggagtgcagcagcattatcagggctcactgcagcctcgatctcctgggctcaagggctcctcccacctcagcctcctaagtagctgggactactggcatgtgctactatacacggctaatttttattgtttttgtagagacagggtctcactatattggccaggctagtcttgaactcctggactcaagcaatcctcccacctcagcctcccaaagtgctggcattacaggtgtgagccaccgtgcctggcccacatgtgtttcttgtcctcatgaattttacagcctagtggaggggacagatatcaatcagtcatgtaaatatatgttggataacaaactgtaactcatgctatgaaagaaaaggacggagggctctgagaatgagtaacagagggccaaagtctcatctggggatggcgggtcaagcttccagcagggctaaaatttgaattaaggccaaaaggaccaataggaaatatttaggcaaagaaaggtggatccggagcaaattgtgttaaggtctgagaaaggaaggaacagtccctgtcagaggagggggaggcaggaggagcgaggaccaaccagacagaggctgcttctcagacttccttagtgaaaaggctccgaagtgagtaaagctggacatggttagatgaaatgaaatgacatgaaaatgacagggtcctggcacatgtcatggcagtgacagcggaaatgagcagtggatggatccaaaaagcacatgggggaaaatccgaaggccttggagacaaggggtagtgggagaggttgaaatatgttttctacagaaccaaatctcacaagaaaaatttcagggactaaaaggacattcaaaacaacaagttaatttcccaagaggaagttgctaggaaactccttttcggtacacaggaagctcctggggagatctgttttcagcacacttttccagcatttcacacacaactcctttccataaggacaggtgacacacaagcttgccaagtccatgtgactgtggtgttttcagggccactgctgagggagaggctcccccagctccctacctctggctgtggggagctggaggggttcatggccctttcctctaaagcaaatgtccttgcccatctccaacctcaccttcccccaaaccacagatgctctctgtttgggaaaataaaatagcataatataaacaagataccatcttcagagacctttcagggttctgggagcaactgggggcaggatacgccctgcctgagcctctggttcctgagcaaacagagaagtcacatcttgggcaaggtccagtggttcctatctcagtttgtaaattcaatatgcttataaggtaagctaccaggagcccacttttaaaagtcagcagggttaagtaaaagaagccagactcaaaaggctccttacagaagaaggacatgtctcaggagtttgatccagacctctataagcaaatgcagaagttcgggaaggcaagaaacacaagtacatcttgaaaaaaaaacaaaaaaaactttgtgcaaggcacggtagctcacgcctgtaatcccagcactttaggaggccaaggcgggtagatcacgagatcaggagttcgagaccagcctggccaacatggcgaaacctgtctctaagttacaaaaaattagctgggcatggtggcgcgggcctgtaatcccagctacttgggaggctgaggcacgagaatcgcttgaacccaggaggcagaggttgcagtgagctgagatggcgccattgtactccagcctgggtgacagggcgagactctgtctcaaaaacaaaaaaaaattatctgggcatgttggtgcatgcctgtaatcccagctacaagcctgggtgacagagcaagactccatctcaaaaaaaaaaaaaaaaaaaaaaaaagagagagaaaaaaaccttgacaaagtgaagttggatgtagattttcttggagcaagtaaatacatgcaatctcctgtctcaaatgctagcaacataccagaccactctgcttcattttggagagaagacttctcacactatggcagccatccatgagagcttcacaggttatcagccatatgaagtcactactttaaagcacttacaaaaccctctgaaaaaactagttgagaaagaagaaaagaagctcacccagcaggaaagcacagatgtaacagtgcaggagctgagtcaattaatttcattagaggatgaaaaccacgacaaggaaaacactgaagatggaaaaggtattttatgtgttttaggcaaaggctcttcacacagtgcatgctcaggatgaactattagacatgaaacctgaggaaagtgctcgctagggcccagtggcagggaccctggaacccgaaggtactgacaaagatgatcctactgctgttgaaagtgagatcttcaatgcttcctccctggaaaagggtgagctcagaaaagagtgagctgctgtgtttggggacaaccaggtggaggaggcagcactatggtcctcggagagccagaccccaagcaccagactaaaatatgaaagacttacaggttttgctacaaggctagtcagacagcaatgtcaaccttcccaaggacaagcagtccaaatgacaacagccctgcagtgaaaaagcctaaggctgtctggcacctgcctgcctagttcagcctctttgccaacctcaagtcttatcaaatcctgatgctgtgcggaaaaaagccataaagaacaagaattgctcagtgcaggagtctgcatccttcagtaagcccacctgggggctagcagaagtataaagtgattagagcctgggcaacatagtgacacctcatctcttctatttaggctgggcatggtggctcacacctgtaatcccagcactttgggaggccgagggtgggcggatcacttggggtcaggagttcgagaccagcctggccagcatggtgaaacaccgttgctactgaaaacacaaaaatcagccaggcgtggtggttcacgcctgtaatccaagctactctggaggctgaggggcaagaatcgcttgaacccgcctggaaggcgggggttgcagtaagccaagatcatgccgctgcactctagcctgggtcacagagcaagactctgtctcaaaaaaaaaaaaaaaattagctgaatgtggtggtgcatgcctacagtcccagctatgggaggctgatgcaggaggattgcttgagcccaagaattggaggctgcagtgagccaggagcataccactgcactccagcctgagcgacagaacaagactctgtctctaaaaataaaatacagtgacccatatgctattttaagatttatgtgcccttttaataaaaatgaaagggccaaagtccctatttacattggtataattttttaaaggctccttactatgtgatttcatttttatgatgttctccatggaaaaggcaaaaaaaaaaaaacgctgtaaaaaacagatgggggtgtgaggagctgcagtggggtggggtttggctgcaactgggcattgcaaagtaattttagggagtggtggaactgttccctatcttgatggagggggtggttcaacgtgggtatagcttgtcaaaacggtagctgtacttttaaaaggggggatcttactgcatggaaattataccttgataaaaataacgatggccaaggcgggcggatcacttgaggtcaggagtttgagaccagcctggccaacatggtgaaatcccatctctactaaaaataaaaaattagctgggcatggtggcaggcacctgtaatcccagctactcgggaggctaaggcagaggaatcacttgagcctgggaggcagaggttgcagtgagctgagatcgcgccactgcactccagcctgggggacaaagcaagactccttctcaaatgatgatgatgatgatgatgatgatgatgatgatgatgatgatgatgataatgatgatgatgataacaacaacgatggagagaggttatctcccaggccaagagtgcaccgttgccattttacagaggaggaacattgacgaaggcttggtccccagggcttcttcacccgcttccttctccccagttaccttttttgtttttgtgggaggccttctgcatggtcccgggaggtcaggcagcccgggagggcctcccggagcagaggctggagtcagtcccaatgccaacagtttcgaaccttgcccgcgggcactgccctcgggatggccgccagggggcgctgcgccgccactgcccagaaattgggcggcagtgaggtcgccgcaaggcttcccgtggaccctgcaaaacgtggcgtgggcattgcacaccattgtactgtatggaaacttctgcagaggttagcaccgtgcctgacccacggtggtttcttcattccttcttttctttttctttttttaagagacgggcagggggtgggggtctcactatgttgctcaggctcaacacaactgttgcactatgggctcaagcgatctgcccgcctcagcctcccaaagtgctgggattacaggcatgagccaccgcgcttggcttcttcattcattcttggtgaacctaagaaatagggagggggagaaggcacagaggagggtgtctcaaagatgtgaggtggtctgcagaggaagatcacagccagaagatcacaggagatcacagaatacctagaagatcagagaatcccccgctgcacttctaataatggtattttaaaaaaattgttacatcagtagctccaatgctttggaactgcactttttttcatgaatgttttgaataagaaaaggccccagggtggcctaaaaaaaaatgagtcactattaggagaggcactattaatgcttccttcttttttccaagataattcttcctcccacacacattcactcatacaacaagtatttacagggagctgttctgtcatttactgatactggggacacaacagtaagcaagacaaacacagaaacacaggctctatcctcttgaaacctgtacttaaaaaacagatgaagtggacaattttaggaaaatataaattattaaaaataaattctaggccaggtgtggtgtctaacacctgtaatcctaggtactcaggagactgaggcaggaggactgcttgagcccaggagtttgagatcagcctgggcaacatagtgagaccctttctctataaaaaaaatttaaaaattagctgggcatggtggtgcacatctgtagtcctagctactcaggaggctgagatgggaggatcacttgagcccaggattcaaggctgcagtgagctatgattgagtcaccaccttccagcctgggtgatggagcaagatcctgtctcaaaaaataaaaatgaataaatgagttagtaaattctagaagaaagagaaaacctaatgaggtaggccctggtgttatccccggtctgatgaaactgagaggctaagcaccttgccccatcccttcaacaaacagtcattaaccacctattaggtgtcaggcactgtgcaaagatttccatggtagatctggttatgtccaagcttattctgttgtttctgtggctctacacagacaataagccagggcagattcctctttaggttccttttttttttttttttttttgagatggggtctcattctgtcacccaggctggagtgcagtgacaaaatctcagctcactgcaacctccgccttccaggcccaagcgatccttccacctcagccaccagagtagctgggaccacaagcctgtgtcaccacgcccagctaatttttgtatttttagtagagacagggttttgccatgttggccagactggtctccaactcctgagctcagggtgatccacccgccttggcctcccaaagtgctgggattacaggcgtgagcgccaggacagatttctcattagataaaacctgtgtcgtagagaccagtacaaagggctattctccacctcaagtctcctgtgggtgacttcttgtgacaggtcacctttcctcttccaaacagtctggcaggggtctacatagataccaacttaattctatcataaaatacatctttttcctccatcttcctaccagcaggggaagggtaagagtttgtgggaatagagcccatcagcatatatggttctgtgatggagcatatcagtgcctggcctccccttagtcttccctccaccccaggctaaaaagtgtctttaaagcggaggtctctacactccaccaagccaagtaagccaaggtcacactgattggtggaactgcaggatacaaactgtcctgggtgctgtgctgcccagatcccccttcagggctgaaagacttacacttcccaccctcactactactactggctggaaagaacgccttgcccaagatctcaccttcctagattaactagcatctggtgactggtcaatgcagggccatcccaggttcagaactccccacgtggtccactgcagccttacttttccctctgccctgtcctgcttcattccttttttttttttttttttttcagagagagtctcactctgttgcctaggatggagtgcagtggagtgatctcggcttactgcaacctccactgcccaggttcaagcaattctcgtgcctcagcctcctgagtagctgggattacaggcacccaccaccatgcccagctaatttttgtatttttagtacagacaggggtttcaccatgttgaccaggctggtctcaaactcctgacctcaggtaatctgcccgcctcagcctcccaaagtgctgggattacaggcatgagccaccacgcccggaccctgctttattccttcttccaaagagtagatgctaggatggatcacctaatacccaggtaataatgaggtgcccatccctggtacaggaggagcatagctagcctctggcagagggaaactctaagatggctaattttttacaggcagtaaatgggatggtataccagggggagaaagcagacaagagtattcaattaccgggaaggaatcaggctgagacttcacatcagggcagggaggaacattgggcacccacgtgatctatttaggtgtctcttagtactcctttgccctatttggacagtaaatggacaaatgcagcaaccactgcctgagaagtgcacagcaactaggtgctcaggctctctaaggatggaggtctagaccaccccatcacgcaggccacctagatcatctgaggtgctggcagaagggaagaggtttctaggatggatagaagaggggactgaagggtatgttcgttatgcctctagatgagctgtagcggcggcaggagctgtagttcccactaaccctcctctatatgtttcccacaggaaaagattccccagggtcctgaaagtgctgctctccaaacttaagtagcaaatgagaggcacagcaccatgtgggcactattgcaaatgctgcactacactgcctcggtcaggactgaaggactattccccgcctaccgggtgggtggtaggttgacagatctcagctgtcagccctcttgaggaattgtctttgtctaaagagagctgccctccaagctccatggcaggtcagtgcagggatgaaaagacttggcccatttactccaactcaggccaactcagcagctatcctagtttcagaactcccctgggggtctgccaaagcctcccatgactgcagcacagactgacttctccctcttcccacccctgcttccctttccccataggacttgattctcaaaggctctctaataaactttctgcactaatcaataatcgcatttctgagtcagctcaaagggaaccaatccatgaaacaaactgagatttgagcccgggcgcaagctgctaactctggatttagtttcttgtgtcttctctaaccccagaaaccccaggtacatgtgtggtgcgtccaccatgctcttggcccacgaaacctaacccctagggagacagtgtgtttattgtcaggctgaagatactccttaaagagaagagtgatcacacagtcccttccacagctttgcccgtggtcccatctggattcagcctcttctggccaaggcctgccatccatcacaatagagcatgccatgttcatggccctttaacagctgcagaatggctgtttatgacttcaggctgcacagcatatctccctcctggaagccttctatgttcttctgggtccccaaggctttctgccataaggagtcttgtggctcatttctgaaaagtcccagctgctctgcttaggggtgggtgagaggatgggacgcttctgtcaccgaggccaggagtcttgttaggccagatgggggtaaaaggcccagagaggtgacatggctttcccaaggtcaagtcaggagcagggcaggaactagaacatagttctgtattctctctgcttcactccatcacctctcccaaacccttagggtttgcctctgctaaaatctagactgagatacagagagaaggggactgatctgtcctgcagacctcagagactggggactctgaaacaccagccaggcacagtggtgtgggcctgtagtcccagctacttgggaggctgaggtgggaggatcacttaaggccagaagttgaaatccagcgtggacaacatagtgagaccctatctctgacaaaaaaaaaaaaaaaaggaaagaaagaaaagaaaagagctatagggataaaaagagggattaatgggaaatctgtaaacagtttggcccctgccaaccccacctcccattctggatggtaggaaggtttgggataggtgactattctctgtactgatgtgcagccattagtatgataaaaatgttttaaattcttttaactcaatactggttgttcttgtgctttaatcttagacccagaaccatttgtaaagggtaaaaggaagaactgtattatttatttattttatttattagagacaggggtctcactgtgttgtccaggctggtcttgaactgctggactcaagtgatcctcccacctcagcttctggagtagctgggattataggtgcaaaccaccacgcttggctacttgtatttattgtaaacacaagaacccaatcatcatcattctattcagctggagttagaatatgtgcaaactgttcaaacattcagccctaggattcttctaagctggccagtagagaacatcagtggatattatctgggaatttagtcctgtatagttacagtttcttctatcactgggcaatagaaaaccccaacaagaagccaaatatgactcaattaaatttctccagtacttatttaaaaaaagaagaaaagaaaaaagaaactgaagactattgcagtaatgtgatatgcattatatctggatccttggagtatatgaattatcttgtgtcaatttctgtggcagaggaaaaataaattgtataataacaaaaaaaaaaaacctttcccccaagagaccaatgtttggacagaaaagtcaatatagaccagcaatcaaacccttccttctcccagctatgtagtgacactgatactctgttgcacatttctgcaaggctgttggatttggtggaatttgaaacctcctgaattttgtggacatgtaagcattccaaaaatagagacagatgtcactcttctaggtccttctagagacgacctatgtggcatttaaggagaaaatgagtgtttcatctccatctgctgcacggagtaccattagggagagctggatcaaacgtcagggttagtggtgattcggcccatgagctgtggaagaaaagaaaacctccaccatagcatatgctgacaaattatgcaaatgccttattttcctgtttattcatccaacttaagacgctgcacacacaactcagtaaacgggatcataacacctggttgctcaggtcaaaaacttattcttgagttctctttcaactccttccccattatcagcaggtccttccctctatctacaaaacatccaaatctgtccattcctctccatcttcactactctcaccctagccaaagctacacttctctctcgtggactacttggcctcttaactggcgtccctgttgtcatctttgcctttcccccatacaagctacactatggatcttcacagattaagtaagatcatgggattctgcaaacaccctccattgccttctcattgcactcagaacaaaatccaaggcccccaaagccctacacctagcctctgcctacctcttgtcatactactctcctgccacacaggccattttgcaattccttggacacgctgatctctttctgcccccctcccctaatgatctttgcattggctgttccctctgtctggtcttgcgccaggtcttcaaagtgcagatctttacgatcgtgatggtctcagcggaaatgcatccttccctatcgcaggtatcgctccgactcccatcacactgacctccattgaattcagggatctgcacctgaaattatctttattttacagataggttcttaatgtgtttctgtctcttcccaccagaacgtgagctccccaagagcgggcgccttgcctctgtccactccagcacctctgcacctacaacgtctgacgaagaggggttgtcgaaagctatttgctaaatggggcaatcctgggagctgacggccgcggaacgggcaatgagaatacaaggtgacagggaccgcgcggggcccggagtcgctcggcgggagtcggggcccgcctcctgctggaagacgggcagctccccactctcattccagttttgcttctgaggggctcaggaggggccgcagcctgtgcccagtcatcaacatcaacaatcttattagtgggcagaaagccaagaggtggcgtggcctgccagaagagaccgggacccgggcagggaccggagccgggccggtcgggtccgggtccagaacgtagaggcgggcggtgcggggaggggcccagggcggccggccgagccgggaggacggagctggggcgcggcggctggggagccgggaccggcctcgccaacgccgcggcttcgcttccgggtgaggggcgggcgggccgagcagttccggggcgggcggcggttccgtctgtgcgggccgcgccgcggctgctggtcccgggcgcgcggagggcgcgagcggcgcgcgggggccgagggggcgcgaggcagcggcgcggggactccgggccccggcggcggcccatggggcgggaggcgtgaggccgctgcctgtccggggctcggggggtggggggagcggggcggggagatggataaactgaccatcatctcaggatgtctctttctggccgccgatatcttcgccatcgccagcatcgccaacccggactggatcaacaccggggagtctgcgggtgagccgctggcgcgccgggccgggcgggggattggctgagggcgacgcgagagaggggagacccggactgaggagaggacggggtggagggtcccggccggaggctagcctgaggagaccgggggcggaggggagacccgggccgcggaggaaagggatggaggagaggaagccgccgggcgccagcgggacccccgggctgaggggagaggcgccccaggccgggtgaaaagtggccgaggagacctgggctgggctggcaagtcccggaccggggaggaggggagcagccctccgatgtgagggatcgcagaggaatgagcttcgttctggattaaaaaaaaaaaaaaaaaagtcaaggtgggagacgggaggaaactgaggctcctgcaagggaattagaaaccaggcggagaggctagggctgagagtgaggcagcctgcggggcagtgcgggagccactagagagctggtgggcgaggggaggccgagagggatcaggtccgaccccagaccctccaccaccagaggaagctgcggccgggggcgagcccgggctgcgggcgctgaccccaccaggcagggtgaatggtgggtgctgggagagctggtggggttggtgggagtggggggcgccggattggagcccctctgcaccgccgcccccgcccatcccctgcccgcttggcaatgtttgagaagcttgtggcttcggattttccctttgaagtgtgtatgtggttataattctgctttattttaggcccgggagctataatactactaataataaacctcattttatggagcgtctttcattccagcgcatcacaaaaacgctggagagctcttaatagtagttacaaaattaaataacacattacagttgcaggcagcccggcagcgggagcagtgcttgctgtaccaccacggagctgtgggcgggagaggcaaggtggtgccctcgggaaagaggcgggcatctttctgaagggtaccccaggtgaatgcgcttccaagatttttctcagcttgggccacttctttccctgttacctcttctccctcccctcttcccccgcctctctttctccctctctcccagacctgtgagaccaaaccttaattaatgtaaacagctgtcaggagagctgctccgatttaaggaatggtcttgttttttaactgcttgttcagtgcaggtgaaggaacttttggagggttgggaatgtcaagctccctccatggataatttcttataaaaatgcggccgggcgcggtggctcacgcctgtaatcccagcactttgggaggccgaggcgggcggatcaggaggtcaggatttcgaaactagcctgaccaacatggcgaaaccccgtctctactaaaaatacaaaaaaaaaaaaaaaaaaaaaaaaaaaaaaaaagagaattagccgggcatggtggcgtgcacctgtaatcccagctactcaggaggtgaggcaggagaatcgcttgaacccgggaggcagaggttgcagtgagctgagattgcgctactgcactccagcctgggcgacagagcgagactctgtctcaaaaaaaagaaaaagaaaagcatcactgtgctgtcaaaacttaatttttaagtattacttatggttctgtatttatcctgcaatatttttagctcttagaaaaaaagtggtagctgggacatttgttgcttcctcctccctcccttctctcccccaatctagacctagtaacacaaaatcatgctgtcatattcactggttattaaaataacactctaaaaattctgctacttttcttgcccatagagttttagcagaactcttaattgtaaaagatatgaagaatcaggatggtttcgaatttggtggtactatgggctttgtttatgaaaatattgttgctgcccgacaacttaacacggttacatgtatgacatccagttcgtgacctgttgatgtttttatcctacttacatgtgtattgactccttttatgagactttcaggcttcacgtacttaggggaaaaggggtttcggtgctgtagcagaaggaatctttttacaaagaagttttagatagaatcccaatagataaaatagactaaatgaccatgcaaaagatatagttgaaagagaagaattgttacatataaaagagaagaaagataagtgatagcataacgttcctaagatggaaaagggcatagccgggcgtggtggctcatgcctgtaatcccagcactttgggaggccaaggcggacggatcacctgaggacaggagtttgagaccatcctggccaacatgatgaaaccctgtctctactaaaaatacaaagaagttagccgggcgcggtggtgcatgcctgtcatcccagctactcgggaggctgaggcaagagaattgcttgaacttgggaggcggaggttgcagtgagccaagatcacgctactgcactctggcctgggcgacagaatggtactccgtcttaaaaagaaaacagaaaaaaaaaaaaaaagggcaagctcctcttgtattcagaagaaagcaaggatagaatgagtataactctttaaaatttggaggcaaaattggctgtgagttgccatggagataggagcaatggatgtccaaggtctgaggaaatagaaactgttcgaaataattgcagagaaagcttgccaacggtgataagtaggtttgtctagcagcactgatgcgtcgtggaagttgatggtcatgaacatacagtgtgataacctatctgccctcttgaccttttctagtagtgctatgtcattttggtactaaggtaggtgaattttccaagtgttcttggaaataaggaaacatcaagaataatgtaaaagcctcatatacaataatgaataataaagaataatgtgaaggcttcattcaaggttggggtttgccagatacattgcaacaaaatgacagagcagccaaggtatttaggatagtggccaaagtattgtaatgatggcttatggagtgtcagctggataaagagtgaaaatgaataaaaactaatggattgttcagtcgaatagcagatggtacaatggtacatggccagtagaataggggacccaataaaattgaagaccagtcagagtgggagtgatcaatccagcaaagtggaatggcaggggatcgtaggcacaaggtccagagtgtaacagtgacaatgtgtggctgatgtgggatcgaggaagtgattgttttttttctaaaagttttccttgccatctcaggataccactccgttaaatattatggctagaaagaggaataagagatactaggaacataggaaatttttaaaattcttatctagcatgtatttcttaccttacatatgtcaggcagtaaaccccccaaaacataaaacgaatgggacagtatgttccttggtttaccgttgtgcttgagcttgtatgctgtacagtctcacctgagcaggcagatgtagtcctgagttaaaaaaaaaaaaaaaaaaagtgcagagttacaccttccaaatcaatgaaacatttacaagaagttcaagtaagatctcagtggtgacaggtctagcttatttcaagagctgcacaaaagccacttaacctggcaacaaaaagttaatgtgttggttccctttggtgtattatattcagtctattaaagttttgattgtgatgttttcattgcagtttttataccggataaaatgtattttagaagtagaacttttggagctgaaatagtctgcagaatgtagcttgaaaaccacggcagtgaactactaagggaaagtttcagaattcaagtctagacttcatcacttcgtagctctgtagctttagggcaggttctttagcctctctttgtctccgtttcctcctgtgtaaagtagggataataaaagtatccatctcactgggatattttgataattaactgagttaacccatgtcaaacatttagaacagtacctgacacacagtaaatgctcaataaaaattacatattgttatattgctgttctagtttataagaacaggtgtcagaatccagttttgaaatgaaagcccagaactgtgagaaatgatgtttttctctattagatgttctaggaaataaggaaacatcaagaataatacagccatgcttagaacaagttaaatatatgtccctcttggctttggactttctctgtcacttccgtgctgttcttcctcttccagtctctccatactctaatctctgttctcagcttctacttgaactaccatagaaggaatagaaaaaaaaaaaaaaaaaagagtaacttcctgaagtccctattgataaactgttactataagattatggaccatactttggacagcagagtttttcatgtttttattgtcttggtctagatacagagaaagtacatcccttttattttcacctgtgtgattaacatttcatctacttcttgtaatggcttgtggattatgcacaaacttttgaagatctgaaacatattgtatgtatgggggaaggcactctaatgaagactgtttgtgttagtgtaaccagaaatattaaatgtagatgaatacagtggcaaaattacataattctgctatgctaaggtcaaatttctgctggttactggaactcaacaccaataggaatatctttgattttatataatgcttcatagtttttgaagcactttgacatccattacttgatctgattccttaggatgtttatatttggccaatgtaaaatagtcattttcacattttcccccacatggtagtgctttgcatgtgagatttgagtttcagtgctgcaaagattccattgaagaaaattcttcactgaagtattacctatatgttatttatgcacaccttttacttatcttaaatgaaattaaaattcttcagtggctggaggttttcccagattacagaagagggaaagaaggagacttgggggtctttgctttgtacaagcttcttaatttcactgtcactctcttctcacccctgaagagactttttgtcagggggaaaaattagtgttagttaattttaacaagataaacagttaagtaaagctgcgtctctgataaatataaatggtctgcagatccctttagtgaggaaggcattatcccctcacagcaaggatttcagtgaccgtaatcctaatcatcctagatagatttgccttatgttctttatgaagatttccagatgttccccaaaagtctctttcaagtagctgaaagaacttctcccttatgtctcgtcaaaatttccctaaagtggttatcatattcatgttatagtttgtcataacgaagttaaggttagtgtattcatttctgaagatattttcattcttgttgtttttaaaattgtctagatgggatgttactgtttggggggggggaatctcaaaaactgacatgtttttccctgcttgtattctgaactagttgaggggcaaaaaagaaataaggtatttaggggctaaaatattattttattactaagaaagaggatattggagaatgtcacttacatttgggggcacgtgacgtcctactcctggaccttaaaattgagcagacttaacaatccagtcccagacagaactgggggaactgcccctataacacttccagcatgacagaggagagatgagtgcttccaaagacaaaatgttggatcacatatgcccattttctcctaaactaccagtcagatgaagtcagtccttgtgacctgacaaggattgagtgaggagacacaaatgagctaaaagtattatgccaacaggattctgtcctctcccccggtctccattgctcatggataataaaatcgggaataaggagaaagccttatgtgtttaaaacccactatatgtctagcattttgtgaggaagagttttcattttcttcaggtctaaagattggcaggtgttcagggaagtgaaagccttggtgaggggtatcatttcctattctgctacctcctacctacttcataggaaaatctggtaaacctcagataagggactgtggtgcttgacatctatctcataagggttcaagatctacaggtagatcccagcctatgcactggggatcctcagtttaaaacactaaaattacaagttgctcaagcagacctgtttattaagtaatagaaaatgattaaatcattagtcctttccctggaactgtaacaacttcaaagatcacaaaggtactttgacatgaaagaactctgtaacatcagttgttaaacaaacctatctcaaactttattttattaatcactttggacatgatttatagaggacaggatttggttacctaaaagggcaaacattttgagattgtgttgtccttgaatttaaaaagcattaataatatttcttcattggccttttgagcctatttccagtaaattttttttaaagagctttattgagatgtaattcacataatactaaaattcatccatttaaagtatacaaataaagtatttaaagtatacaaatcagtggcttttagtatcttcataaagttgtgtgctaccatcaccatagtccatttcagaacattttcattactccaagaccaggctaagaggtgcctcttagcctcctaggcaacccctaatatgctttctgtctgttgatttgcctattctggacatttccaatcatagaatctatgtgatcctttgtgacaggcttcttaaacttagcataatgttctcaaagttcatacatgttatgacttttttttttctttaagagacaggctcttgctgtgtttcccaggctcaaactcctgggatcaagcaatcctccagcctcagcctcccaagtagctgggactatagatgcacgctgccacacctagctatgtatttcttttttattgccaagtattccattatatggatagaccacatttatttagccattcatcagttggtggacatttggaccactcagttttttacttccaagcataaaagtctatgaagataaagtgattaaagatgttttttaaatgtgattttttaaaaagtgacattatcagtataatctatttcagcatatcaagtaataattatcaataaaaattcaaaaaccggtctttttacagtactcacaggacatgcttaaagcttgagatcatttatgatactgtgaattcccagagtggactagattttccaataggaaattagatctcctgaacaaagcattaatatttcctttacaaccttagttccaaacatcatctcttttatcattaccaacagagatggagccacttcagaattaagactataaataagcctaaatgtttttggagaaggggaatttaggatgaagaacatgaacagcaggcatgagtaaatggaaatcactaaaagaaggaaattcagaagaaaaaaaattagagtaaagactgctgatgcatttgttagattggccatacttattgagtccttccttatttggctgccagaacccctttcaaattttgcatagtaatagttacatatatcagttctccactgttctgcttagtgtgaccaaaaacatcattgtttaatccctttcctggtaaatactgagtttgtattggagttgcagtatagtaaaatggttctgtaggatttggagtcaggcatatctctatttgattcttggattccttttttattagctttatgatttggggcatgtaatttgatttttcagctataaaatggagacaatacatttacctcaaaggatagttgtgaggagataaaatgtggcatataagagattagcacattgtccgatacttagtaaatgctcaaatgttagtcatttattacataaaagctcaaaacatctggatttttagtgtttcccttttgtactgtctgtcttatttatttacttatacctgccttgttccagaaagagatttaaggcaacataatgtgtctgtatttgaatgttcgtgaacccagctgggtccaatctgggaagagagactgcatagtcagttgttgtggtaatacacacttatgggacacatgtaactaccaaaaccaaggagtacttgggtttttatgtttctggaacagattgaagaggttttctaagtgaaagacagcctagcatagtggaaatggcacacgggctttggggcaaaccaacatgtagccaagtccctgtcctactatttacgagccgtgtaattgatcttagacaagttgcagttgagggtttttattaatgaaaattatatcattcagacctgattaatacctctttcagcacttccaatagttatgcaggtttagactccaactttgttctcctgtgggttaaagaatattaaccacagtgtattgttaagatcatttagttcagaggttagttttaaaggaatttaagagctggtagtacagttggagtatcaagtcaatttttctcacctcaaagtgtgaaaataagtttgaaatatatgagatagttggttctttatagaaacctggcaagcgatatagctgaagatttagtttatggaataaatttttttctagttactagcttctgtaatgcaactgtgagttcattttttccataacccatttcaatgcatacttaggtggtgggccatattgcataatcttataggggaaatttagacatgtaatgaagtgttcctgtttatgaaattgtcaccattgaattataaataagaacttgttcgtgcaacctgaatgcataattatttacatagtgaccgtgtttgatatgcttctctaagagacccaggaaattaggttgtacggtgacagcagtgacaagtatataggtataaatttcatatttacagctttacctttgtgatggtttatataacatgacattcatgtctttttggttgtcagaatgttgtattttcaagttctgaagctacacctttttttccaagtactttctagaattccccgcccaactaagcagctagcagctttataattagaaaacctgatccgattgataacaacagattgaaagtagcagttatttcatcctttatcaactacaaactgatgaaaaagtaatgttgggaaagctgttgtagaaatcctaaagaggcttagataagagccatgaggaaacctgaagatctttgaatatcaggatacctaaaaataggtacctggattaaaaccatttttcaataatatacccttactgtgtatttcacctaaatttactgtgtttgtaaactttactgtgcattctcttgttaactgcaaattacacggaggagaattcttgccaaatatgcaatgagcaagtagaatgtgacgttcctttggggtttattgctttagagttgacaaaaaaaaagagcatttgggtttgggtgttgctatcaatggtacttacatgtatttgtgaatatgtaccaactaacatgtatagtttgcttaagggaagtttcagtgtgtgactccagttcacttttgaagcaaactgacaaatctttgaatcactgcttttttttttaattagcaaaaggctgcactttgtgtgtctcattatactagctttgctataaataaaatatcacatttggcattttgacacttgccgttgtatatattgagcaaaaaggcagctgttgacttttaatatagatctgttcaactagggaccatattctactatagttagagattaaacaggagtagaaaaaaatgcagttgggtgggtcaagtaagaaaaaggaagaacaaaatttcattattgcaatatattcacagtaagttgtttacctggaacatggttgggtccaatttcagccataataatagaagttcttttcaaaaataggccatgttcagatcagttctgctgaccaggccactgacctccaaagacaaaaatctttaaggccacttagactgtcaaagagatatgaccatttgatttataaggtaccatcattttgataaaagaaatctttaatttactatgaatattttaaaaatcttcccatagatattccctatgcgattggacttcattccagaccatcttgcaacaaatgctattgacgtatttgtggtctgtaaggaatctgtactgaaataatcagagagattatgtttaagcaaatgaaaaaagtccttgaggtaccctataccctgggaagataaaattgtatcttgcatgtcttacatcttgtgagtatgtaccaacatatgcataggatcaggcaatcagagaggaggtggaatttgagcttaacagatgatacatttaataatgagtaataaggaagacttgggtggttcttgttcttgaaaagggaatggcatgagtaaaggtagagaggaggcagtgaaatttctattccagtccatttctctgtattgcaacttactttatctttctaaagaacaaatagaataataaatacttgtatagcatttactttgtgacagattcttttctagacactttacatgtgttaattgatccccacaatgcccctgtgtaagtgctgttatttagacagcctcatgaaaatacagagaagtcacttgcctaatgtcacacagtggatcctggctcttaactattgcatgtgcttgtaccagaaaccttcagtgacttcatcttccacaggacaaaagacactcaaggattttcacaatctggctccaacttataatactttctggccttagatcctgcttttttccccgcatgaatgtacattctagcccctctgtattactttctgtttcctgtgtgtaatctgtattctcatctgtaattctttggtcctctcactctctccagtccctgttttatcagtatcctacccatcttccgagcatatcagttgctatcttcataaaaccttttttgatcccttacctaaagtgattttccaaccccttggtaacactttgcacattttttatggtagcatatctgtgtcatggttatttgtgtggtacttgccctattttctagtataatttttttgtagtatagatttttttaaagttctttgagagcagggaatatgatttgttgatctttgtatcttaggcagcattcagtctaagcttgcacagggcaggaaagaggaaatgttatggttaacactaagattttgaacctgggctagggaataaaattgggaatttagagagtgaggtgattgtaaaaagtgaggagttgatttagacatgttctgtttgaggtgatagtaggatatgcaagaagaaagggactagagctcagaagacaggaatatttggcactcccagtcttatctcattttcacaagtatgatacttaaattgctacatatcaaattagctgcatatccatagaattcaggcttcttttttttaaaaaatgtatcagttggggccaggtgcggtggctcacgcctgtaatctcagcactttgggaggccgaggcgggcagatcagctgaggtcgggagttcaagaccagcctgaccaacatagagaaaccccatctctactaaaaatacaaaattagccaggcgtggtggcacatgcctgtaatcccagctactcaggaggctgaggcaggagaatcgcttgaacccaggaggcggaggttgcagtgagccaagatcgtgtcattgcactccagcctgggcaacaagagcgaaaactccatctccaaaaaaaaaaaaagtatcagttggtttttatttagaaaatgaagtccagctactatataatcattcctgactttaattttttttttttttttttttgagatggagttttgctcttgttgcccaggctggagtgcaatggcttgatctcggatcactgcaacctccgcctcccgggttcaagtga

SEQ ID NO: 38234 - DNA, 44923 bp, Homo sapiens
ctccctcagcgtccggccgaggcgcggtgtatgctgagccgctgccgcagcgggctgctccacgtcctgggccttagcttcctgctgcagacccgccggccgattctcctctgctctccacgtctcatgaagccgctggtcgtgttcgtcctcggcggccccggcgccggcaaggggacccagtgcgcccgcatcgtcgaggtgaggcccgggcagcaggcgggctccttggggcttgacgggatgcgggccggcctgtcccgccgcccctagtccgcgccccgcggagtcgccgagccgcagactacgagtcccggcggccaccgcgccgcccgcgtggcagtggccgagggccgccggcgcgcggcgtgccgggacttgtagtccgcgcccgcccgccttgggggccaccgcttgaggtcgctttgttcctgcgccccttcttttcttacattttggggaccagattcgtctctagagtgggctgggagagggatcccggaggccaacctttgggggtcccccagcgcgcagaggttagcgtgtcgctgatcgtgtggcaggtgaaggcagcaggagcgcggatttgggttagaggccgtgtgcgcccacagttgtctgaaggagagacctatttttcttctccgcgccttccctctggttccctaaactccgcactgtcaccgaacgtgtctttactctagaaaggaggcccgtggggcggggtgttattttaggcgtgctgtgggctgccgctggcactctcgagccccgtccccgcaagctttagggcggagccagccctgaggctcggcccgggtcggggatggggaaagccgggagtgctgttctgagatcaagcttcaacctttggccctgctgccaactcacgctcggccctcggtcacttcctgtctcccagcctcagttagcccttgtaatacagtaaaaagagtctctgaacccagattttctcaggatataaaacacctcccaaatgtaaaatgctgttacttttttttcttttgctttgagacaggttaccagttcaattcttttaacaatttttgagctagatgtatggttggttagctgcattgacactgtgggaaaaaaaggcttcatggacaatctggggaatgcttgggaaagaaggaaaacaggatatctagaaacagaagaggcgaccattggtggcctctagtgaaatcactctgaaaccctgtaaccaacaaaagtttttttgacctagaacttataatttcctcctcttctaggatatggccaatattagcatggggcttttgcttctctccttatatgttcataacaatcaactcctgtcctgtattttattccctaaatagcatccagagaaagttagatgagttcaacaagtcattatgtgttggacagatgtatttataaatattgatcattttgccaggcgctgtggctcactcctgtaatcccagcactttgggaggccgaggctggcggatcacgaggtcaggagttcgagaccagcctggctaacatggcgaaacgttgtctttactaaaaatacaaaaattagcctggcgtggtggcgggcgcctgtaatcccagctactccgaaggctgaggcaggagaatcgcttgaaaccggaaggcggaggttgcggtgagcccatatcgcgccactgcacactagcctgggcgaaagagtgaaactccgtctcaaaaaaaaaaaaaaaaaaaaaatcattttaggtgtcaaagtggaactagtccaactaaaaaaatacataacatttacatcctcttaaaaaaatttttttttgttggttctctttcttttgttgtttttttgtttttgtttttgtttttgtgacagtctcactccgtcaccaggctggagtgcggtggtgcgatctcagcacactgcaacctccgcctcccaggttcaagcgattttcctgcctcagcctctgcatagctgggattacaggcgtgcgccaccacgcctggctaatttttgtatttttggtagagacagggtttcaccatgttggccaggctgatctcgaactcttgacctcgtgatctgcccgcctcagcctcccaaagtgctgggattataggcatgagccaccgtgcctggccttgtcacttgtcttttaaaaagtaaagagactggctgctgcactccagcctgggcgacagagcgagactccgtctcagaaataaataaataaataaataaatggcaagtgaaaagtgggagtgatttcaaatttttgtttagtatatgtgatctttcttaaatagcatgatgggggaaggggcaaagactttagagtcaaagagatataggttcaaaccctgactctgccatttactgtttctctaggcccagagatgttgttgcctttagttccctgtgaaaagggaaaacatagaaatggctgttttgtatggtatttgtgaatattaaatgaggtaaaatatctggcacacagagacagatgcagatagtttttttctccactttaaacttctgatcttattacctctactttaaacttcctgatcttattatattggttatttttattggtgggttttgttgttgttgtttgttttgagatcgagtctctctgtgtcacccaggctggagtgctgtggtaccatcttggcccactccaacctctgcctcctgggctcaagccatcctctcacctcagtctcccaagtagctgggatgacaggtgtgcactgccactctctgctaactttttttcaggtttttgtagaaaccagggctcactatattgcccaggctggtctcgaactcccagactcaagggatcttactgccttggcttctcaaagtgttggcattacaggcatgagccgccatgcctggcctggttatttttattgcaaaatagtatttttcttttaaattactttatgcgtgttatatttgaatgcatttaaatacagtatgctgtttctgaatcataatatgcctttaaaatatctgtacctaaattaataatacccatactactacactggttaaaaaataatctacacattcagggctgggcgcagtagctcacgcctgtaatcccagcagtttgggaggcccaggcgggtggatcacgaggtcaggagattgagaccatcctggctaacaaggtgaaaccccatctctactaaaaatacaaaaattagccgggcgtggtggcaggcgcctgtagtcccagctacttgggaggctgaggcaggagaatggcatgaaccggggaggcggagcttgcagtgagccaagatcacgccactgcagtgcagcctgggtgacatagcgagattccatctcaaaaaaataaaataaataaataaataaatacataaatgaaataatctacacattctgcaattattctttattctgttcagtaatggcaaataatattttaaacttgttaattatcagttacaagattccatgatgagatatgttctgtaatgtattatattattaagatttcaacaattatttgaccttaaactgttatcttctttaatgaaaagtattctcttgagtctagttgccataaactttattaagctgtcaatcaactaattccaaatagtttataatttagcaattgctattccctagctggctagacagacactggaatatctattttttttttttttttgagacgaagtgtcacgctgtcggccaggctggtgtgcagtggggcaatcttggctcgctgcagcctccatcttctggattcaagcgattctctgcctcagcctcccgagtagcttggactacaggtgcgcgccaccatgcccggctaatttttgtatttttagtagagacggggtttcactatgttggccaggctggtctcgaactcctgacctcgtgatccacccaccttggcctcccaaagtgctgggattacaggtgtgagccactgtgcccggcctggaatatctattgttagtgaagtcagcggtatgttgtttttttcctttgtgaatctctttattttgactcaatatttttttatacaggcaattataaactaaattccaaaataatgtaagttttggaggtttttttcctgtaggaaaaaaattacataaatccacggtaaattctccaattaatctggctgaagctaatgcagctcacagggcacctgaaattgttactttagtatgttgatttccaactcaggctgccagaagtacatatttgagtcctagctacagaatcttcagttgacaggaagagaagaaaaagagaaaaccaaaaacccttagggatatcttgctctctaaggcactgaaattagtgaagtgggtattgttagagggaagctggtattttttctctggaggtgaattctgctctgcaaattgctcctggagacctagagaaggtaaaggcaaatctgatacagtgtcttctgagagtgttctgtactgggaaggaaagattggagggaggttttgggattgattttgcacatttatttgtactgatgtttttcagttttgtttgcttttctccttccttccttccttccctccctccctccctctctccttccctccctccctctctccttccctccctccctctctccttccctccctccctccttcctgttctttctttttcttcttttcttttttttttaccaaatacccagacttggagaatttgttttattttctaattgtttgtaaatctgtatcctctaatactgaatttgtttttgaaaatgagctattttctaaatcagtgtgatacttagagttaagtttccagaatggaattattgtgcaataatttagttataaaatcatgatgggaatactgtgtcattcttgaatttttaaaattaagctttatttatatttgttgttttggcccaaatgaaattatgtcaatgtaacctaaatttatatttgaaaataaccaccattttacatgcattagttggaagaaatatttaaacctctcttttaaagattgtgaacattttgcttacataaacaaattatgactaaagcttataaccatgccaaattgctttctgtagcacccagaaaacttttttttttttttttgagagagggtctcactctgttgcccaggctgaagtacagtggtgtgacctcagctcactgcaacctccgcctcctgggttcaagagattctcctgcctcagcctcccaagtagctgggactacagacacatgccaccatgaatgccatgttggccaggctggtctcgaacttctgacctcaggtgatccacctgcctcagcttcctaaagtactgagattacaggcatgagcctttgcgcctggcctcacccaagaagcattttatcatctgtgtcaacttcctccagggcctgtgtgggtaactcttactttgcctggccatcctacttactgcacttagaaaaagttttggatgataattgactttaagcatatataaatcagaaacttgatttcatttatctttgtgtccccagtgttgaacattgtgcctgacacatagtaactgcttattaagcacttattgaattataagttgaatacgttggattcatagagtttattgtttgtcctgaagatgtaaaatttttaaaaattcgatccccagagggcgctccagtggcagttggctctcccattttaaggaccagaagtgtttgaatgtcttcctctgatttctttttctttcttcctttccttttttttttttttttttttttttaagacagagccttactctgtcgcccagacgggagtgcagtggcatgatctcggctcaccgcagcctccgcttcccgggttcaagcgattctcctccctcagcctcctgagtagctgcaattacaggcacccaccacaacgcgtggctaatttttgtatttttagtagagatggggtttcaccataatggccaggctggtctcaaactcctgacttcaggtgatccgcctgcctcagcctcccaaagtgctggaattacaagcgtgagccaccgcatccggctgccctcttccctcccctccccttcccttccctcccctcccctcccctcccctcccctttccctttctttcctatttatttatttatttatttgagatgagctctccctctgttgcccaggctgcagtgcagtggcacaatcgtggctcattctcactgcagcctccacctcccaggctcaactgatctttccacctcagcctcccaagttgctaggtctacaggtgcatgccaccatgcccagctaattttttttattttgtagaaatggggtctccccagagcaagactccgtctcaaaaaaaaaaaaaagagaaatggggtctccctatgttgcacaggctagtctcaaactcctggattcaaacgatcctcccacctcagtctccaaagtgctgggattgcatcgtaagccagcgtacccagcctgtcttcctcagatttctcatgtaacacttttgtttactctcaatgaatgaatcaatgatatggttgtgaaaatctgctgagcagatttccaagctcctcattacaaattctcaaacagagcagcattcagaagaaactagataggaaaatccactggatattaaggtccagtgtttaagaatatgcttctttccttctggtggaataataattttttttttttcgaggcagagtttgagttgcccaggctagagtgcagtggcacgatcttggctcaccacaacctctgcctcctgggttcaagcgattctcctgcctcagcctcctgagtagttgggattacaggcatgcgccaccatgcccggctaattttgtatttttagtagagacggggtttctccatgttggtcaggctggtctcggactcctgacctcaggtgatccgcccgcctcagcctcccaaagtgttgggattacaggtatgatctaccatgcctggcaaattttttcttttttaagaaagtttacattatctggtccacaggatacttgactcttcagaagcaccactgtttgattaagggtgcttatgacatgggatttttgttaagaacttggaggaggggagatcttcagattatttactgcccttaattttgaaaactttcattttttgcctttccattttaagttataagagtaacacatgcccatagggaaaatgttacatcttttctaatcctgagatcaccagtagtaactgcttgttatgaactgctttcccatctctttctcaatgttcttgtgaacaaaaatgcaaatatttatattttttaccttcaagtgagattagtgtattttttgctgactgtatcatagatatcctttcagttctttacctatagatttaattcatttgtgtttttttgtttgtttgtttgttttgagacagagactcactcagtctgtcacccccaggctagagaaccttggcactctcttgtctcactgcagcctctgccttccaggttcaagagattctcctgcctcagcctcccaagtagctgagattacaggtgtgtgctaccacgcctggctaatttttgtgtttttagcagagacagtgtttcattaggtatttctttatagcagtgtgagaatggactaatagagtctactttaagatttttatttttattttttattatttatttatttatttggacagagtcttgctctgtcgcccaggttggagtgcaatggtgtgatctcggctcactgcaacctttgcctcccaggttcaagcgattctcatgtctcagcctcccgagtagctgggattacgcccagctaattttttagtatttttagtagagacagtttcaccgtgttagccaggatggtctcgctctcctgacctcatgatccacccacctcagtctcccaaagtgctgggattacaggtgtgaaccactgatcctggccaatttttattttttggggacagggtcttgctcagtcccccaggctggagtatagtggctctatcactgctcactgcagccacttggctcaagcgatcctcctgccttatccttcagagtagctgggactacaggctcacaccaccaggcctggctaattattttttattttatttttttgagatggagtcttgctctgccacccaggctagagtgcagtggggtgatctcggctcactgcaacctccgcctcctgggttcaggcaattctcttgcctcagcctcccgagtagctgggattacaggtgcctgccaccacacctggctaatttttgtatttttagtagagacagggtttcaccatgttggccaggctggtcttgaattcttgacctcaggtgatctgcccgcctcggcctcccaattagccaggcctggctaattattttttgtaaagacaaggtctcactgtgttgcccaggctggtactcactcgactgcttcaaatgctaatctcttccggaaataccctcacagatgataatgtttaccagctatctgggtatcccttaatccagtcaagttgacaccaaaaattaaccatcacaaacattattatatttctatcaaaagtatatgaatatcatcttggaagattattttaatttttacaaatttgttaatctattttctgagatttttgagaatcttttcctttttctcttttttcttttttttttttttttttgagacagggtctcactctgttgcccagcctggagtgcaatggtgccatctcagctcactgcagcttctgcctcccgggttcaagaaattctcctgcctcagcctcccaagtagctgggattacaggcacttgccaccatgcccagctaatttttgtatttttagtagagatggggtttcaccatgttggccaggttggtctcaaactcctggctttgtgattcacccgcctcagcctcccaaagtgctaggattacaggcataagccactgcgcccggcaattctttttttaaagtgaaatggcataattaaccatttgtattttttttttttttttgaaacggaatcttgctctgtcgcccaggctagagtgcaatggcgtgatctctgctcactgcaacctccgcctcccggattcaagcaattcttgtgcctccacttcccgagtagctgagaatacaggcacatgccaccacacccagttaatttttgtatttttagtagagatgaggtttcaccatgttggtcaggctggtcttgaactccagacctcaagtgatccacctgccttggcctcccaaagtgctgggattacaggcatgagccacaatgcccggccctctgtgtatttttaaaaaatattttcctggccgggcgcagtggctcacacctgtaatcccagcattttgggagccaaggcgggtggatcaggaggctgtaatcccagctactccggaggctgaggtaggagaatcgcttgaacctgggaggaggacgtcgtagtgagccaagaccacaccattgcactccagcctgggcaacagagtgagactccgtctcaaaaaaaaaaaagtctcaaaaaaacccacaaaacttccctgtacttgtcatttattcagaaaacattttttgagagccaggcactgtgatattggttgttgagttgagtcagaagacgcagattggccagttgcagtggctcatgcctgtaatcccagcactttgggaagccagggtgcaagaattacttgagccaaggagttcaagaccagcctgggaaacatcaaaagcccatccctgcatggtggcgggcgcctgtagtccagctactcaggaggctgaggcaggagcatggcgtgaacccaggaggcggagcttgcggtgagccgagatcgcgccactgcactccagcctggatgacagagagagactccgtctcaaaaaaaaaaaaaagcccatctctacaaaaaattagctgggcctggtggtgcgtgcctgtggtcccagttacttgagaggctgaggtgagagaatcacctgagaaagagaattcaaggctgcaataagacatgatcacgccactgcgcttcagcctgtgcaacagagcaagaccatgtcttaaaaaaaaaaaaaagacgacagaccctgctgccaaaagtttacaatgtagtgaggaaacaaggaaattaattggtgatgactacaggatagaatgataaatcctatgatataaatataccaaatatcccatttagggacgtttagggaagggacatctaaatgtcaatttaatgagtcagggagggcttcccagaggaggtgatgtgtatgagctcaattttgaaggacagtgggaaagaagcagttgggagatggaaaaacgcttagagcagttatccttgtatagggttactgaaggattcaattctgagtaaagtgtgagagggtaaaccgacatacgtgaggctgactcaaaaaacactcccttgaatgcaaacagatatgaaagaactttgcaggtattaaagttcaactgtaaattattattattttttctttttttttttttgagatggagtctcactctgtcacccaggctggaatgcagtagcacagtcttggctcactgcaacctccacttcccgggttcaagcgattctcctgcctcagcctcccaagtagctgggattacaggcacacaccaccatacctggctaatttttgtatttttagtagagatggggttttaccatgttggccaggctggtctcgaactcctgacctcaggtgatctgcctgcctcaccttccacagtgctgggattacaggtgtgaaccaccatgcccggcctaactgtaaattatttcaaaattgtttatcttttagttttgcctccctaactagagtgtaatgtctttaagggtggggaccctgtcttttccctctcatttcactacacgtttttcatttatttatttatttatttttacaaggactctggctctgttgctcaggctggagtgcagtggtgcgatattggcacattgcaacctttgcctcctgggttcacgcgattctcctgcctcagcctcctgagtagctgggattacaagcgtgcaccaccatgcccggctaatttattatatttttagcagagatggggtttcaccatgttgctcaggctggtctcaaactcctgacctcaggtgatccgcctgcttcagcctcccaaagtgctgggattacaggcgtgagccaccacgcctggccttcattctactacatggtttttgaaatgccttagtcatccttcagatcttagcttaaagactctcaaacgttctcagtttatgatgcccttagtgtctcagtttttttttttcatagaaactctagtgcaaaagaaatacctaacagctatattaagtaagtaattaggtctaaacaatacttaagaagtattttctaacaagttagtagctgtttgaagaaatgatacatagaaattaggataaaaaattaggagaaaaaaagtagcaatttaatttctttttttttttttttgagacagagtctcactctgttgcccaggctggagtgcagtggcacgatcttggctcactgcaagctccacctcctgggttcacaccgttctcctgcctcagcctcctaagtagctgggactacaggtgcccaccaccacgcccggctaattttttgtatttttagtcaatctcctgacctcgtgatccccccacctcggcctcccaaagtgctgggattataggcatgagccactgcacctggcctttttttttttcttttgagatggagtttccctcttgttgtccaggctggagtgcaatggcttgatcttggctcactgcaacctccacctcccaggttcaagcaattctcctgcctcagcctcctaagcagttgggattacaggcatgtgccaccatgcccagctaattttgtatttttggtagagatggggattcaccatgttggttggactcctgacctcaggtgatccacccaccttggcctactaaagtgctgggattagaggtgtgagccacaatgcctggccttttttttgttttgttttgtttttgagacagagtctcactctgtcacccaggctggagtgcagtggctccatcttggctcactgcaacctctgcctcccgggttcaagagattctcctgcctcagcctcctgagtagctgggactacaggtgcccgccaccacgcccggctaatttttgttttgttagtagagacggggttttaccatgttggccaggctggtctcgaactcatgacctcgtgatccgccagcctcagcctcccaaagtgctggcctcccaaagtggctcccaggcatgagctactgcgcccagcctaatttcattcttaagtaaccacacttactaatgaaatgtatatgcctgttgtgtactgtttctcatacgctggaatcatattggacacttccacctgcatttcttattaattttatctccctgtctcttttctttctctctctcttttttttttcttttttgagtcggagtttcactctggcgcccaggcttgagtgcaatggtgcgatctcaactcactgcaacctcggcctcctgggttcaagcaattgtcctgcctcatcctcccaagtaactggcactacaggtgtgcgccaccatgcctggctactttttatatttttagtagagacggggtttcaccatgttggccaggctggtctcgaacctcagacctcaggtgattgcctgccttggcctcccaaaatgctgggattacaggcatgagccaccgtgcccggcccgtttgtttgccttcctctccccctccccatctctcctcctcactcctctcccctctcctccccttcccttcccttccccaagtgattctcctgccttagcctcccaaataactgggattacaggcgcccgccaccatacccggctaatttttgtatttttagtagagacgggtttcaccgcgttggccaggctggtcttgaactcctaacctcagatgatccacccgcctcggcctcccaaagtcttgggattataggcatgagccattgtgcccggcctattttatttttttattttctttctttcccttcctccttctgttcctcctttcttccctccttccctccctccctccctttcttccttcctttcttctttccttccttccttctttccttttttccttccttctattcattcattctctcattcattcactttgttgcccaggctggagtgcagtggcacaatcatagctcattgcagcctccaactcctggactcaggccatcctcccacctcagcctcatgagtagctgggactacaggcacatcacaccatacctctctaatgtttaaaattcttgtagagagaggtttcattatgttgcccaggctggtcttgaactcctggcctcaagccatcctcctgcctcggcctccccaaatgccgagattacgggcatgagctgctgtgcctgtcccacattaattttcatgtgatacttgtttttatcacagcaatagcccataaaatcagcctcacaaagatatgatgtaattgaaaggaatgtgccatgatctttttgttgttgttgtttttggtttttgttgttgttgagacagagtgtcactctgtcatccaggctggagtgcagtggtgcaatctcagctcactgcaacctgtgtctcccaggttcaagcgaatctcctgcctcagcctcccgagtagctaggactacaggcatgcgccgttaccatgcctggctaatttttgtttattattagtagagacggcatttcaccatgttggccagggtggtctcgagcatctgacttcaagtgatctgcctgtctcagtctcccacagtgctgggattacaggtgtgagccatcgtgcccggtccatgatcttaagttgaaaattaactatcttgtgttcacttagtgtcacattgactattgctgtgtttcctttaaaaaattaaacccagggcactattgtgaatttgctgtaccacattccagtttagatgctaatgcaaaaggattgtaatcactgaagacctccaaaagtcacgtaggagtacagtattttaacgggtagctttctgaattgaaatccagaggattagagaaatcaatctagtagtgggactttttgtccaggtaagagagagaaaggatggggactctgctgggagtatagagacagcacatatattttgatgtcttatttttttgtttcatgttggcctagtcacactgattcttactaccttaaagctaatacttttagcccaattgccatatgaaaatgtgtttgctcttacattttagttgctttaatctgacaaattaagaacatttttacagactaaacatgtgataagagcatttagaactttaatagggaacaggtgtgacagacatactgtttgctgacagttttatgctgcctggtgcgtaaagttaacaaaccatcactttggtaaaggaaaaagcaccagttgttacttactagtctcagaggccttcactttgagggactgggtcctatgaaacatgttcttccatgcctggtttccatcagtcttctccagaagacccataagctggttccattccccgttggaatgtatcctatgtcaacaagcaattgaatatgcctaatttggggctacacaaaagtctgtttccatacccactttgtgtttggagcttccagaatgtgttagtcattgattggtattggaaaatgttacatgtttaatttaacccacaagctttacctgtataattatgtatgatttagttaggtaataacatgaattttcattttcttggtgcctactgggagtatagagacagcaaagatgttttgattgtataattgggtgttgacttaatggttaatttaggttttcaaatagagtttttccttgctatgtatcatttgaagggcaagggaagtgaaaagtggaaatggtaatgtttcagaagtggggaaaggcaaggaggaagcaaaggaagcaagaaggatggtcagaatcaggctgaatcaaggtgggtcaaatatgcctagctttctgtgtgtggataaagtttctgatctcatctgcaagccaggacataacaaaatgatcaactttgagtttcttctttaactcccaccagtagattctgttattcaatggccatagtagcttgaagacgaaagactgcatctccatatgggtcacctaggaattacctcagaggcctgttgtggaataatagagttattgagagtgaggagacctggattcaagtgccagatttctttccagtaactggcaagtcagcttatctcaatttccccttttgtaaaacgaagcgtatagaggagtagatggtcttaccagctccaaaacagatctgtacctcaaaacttctgtgttagatagcatataacccaatatagtcacacccaaaaggcaaaatatccagttactatgaatatgtgtgccttctttgctattctgtagcgtacgagttggagcaccaaggaattatgtttaataaattcctttatttcatgttcatctagaacttcacagtggtaacattgcacctataaagttgagaaaaggaaagctttttgaaatgtaacagttgcttgtgtgtatttttaattaaaaaattttaagaaatgtgctattagggccaactttctaaatgttcttgtttgtttgtttgtttgtttgttttggagacagggtcttgttctgttgcccaactttctaatttttctttttttgagacagggtctcgctctgttgaccaggctggagtgcagtggcgcaatctcggctcactgcaatctccgcctcccggttcaagtgattctcctgtctcagcttcctaagtagctgggattacaggcacgcgccaccacgcccagctaattttttgtatttttagtatagatggagtttcgccatgttggccaggctggtctaaaactcctgacctcaagtgatccgcccacctcggcctcccaaagtgctgggattataggcatgagccatcttgctcagccttattattatttatatagaaacagggtctcactgtcttgcccgggatggtctcgaactactgggttcaaacagtctgcctgcctcagcctcccaaagtgctggaattacaggtgtgagccaccatgctccacctactgtttttttttcttgagacaggaccttgcgctgtcaccaggctggagtgcagtgacatgatcatggctcattgaagcctctacttttcgggctcaggtgattctcccacctcagcctacaggcacaagcttgtagtcccagctacttggggccaatttatgggttgaggttggggagggggtgttgttttggtagaggtggggtttcaccatgttacctaggctggtcttgaactcttgggctcaagtgatctgcctgtcttagcctctcaaagtgctgagattacaggcatgagccactgtgcccagctattttggttgctcttatttaaagtagagtgtgcgtacattatagaaaaattggaaaatacaggccaggtgccgtggcttatgcccgtaatcccagcactttgggaggctgaggtgggcgaatcacgaggtcaggagttcgagaccagcctgatcaacatggtgaaacaccgtctctactaaaaatgcaaaaaaagaaaagaaaaaattagccaggcgtggtggcacgcacctgtaatcctagctactcaggaggctgaggcaggagaattgcctgaacccgggagggcagaggttgcattgagccgagatcacgccactgcactccagcctgggcgacaaagtgagactgtctcaaaaaaaaaaaaagaaaagaaaaattggaaaatacagatcccccacccttccctagctcctggtaagttctaatctactgtctctacgagtttgcctattttaggtacctcatataagtagaattatatgatacttgtcattttgtgtctggcttattttacttaacataatttttgtttgtttgtttgtttgtttgtgacggagtctcgctttgttgcccagggtggagttcagtggcacgatctcagctcactgcaacctccgcctcccagattcaatgattctgcctcagcctcccaagtagctgggactacaagcacatgccaccacgcctggctaaatttttgtatttttattagagatggggtttcactgtgttagccagggtggtctcgatctcctgaccttgtgatccacctgcctcgagctcccaaagtgctgggattacaggtgtgagccactgcgcctggcccataatgtttttaagcttcctccatgttagcatgtatcagaacttcctttttatggctcaataatgttccattatatgtatgcagcacattgtgcttagtcattcatctgttgatggacacttaggttgtttccacctttggttactgtgaataatactgcagtgattggtgttcaagtatctgtttgagtctgttttcagttctttggggtatatacatagaaatggaattgctgagtcacatggtaattttgtgtttaacttgttaaggaaccactaaactattttccacaggagctgcaccattttacatatccaccagcagtatacaaaggttccagtttctccacatcttcaccaatgtttattttttttgtttttgttgttgtttttaaaattatagccattctagtaggtgtgaagggttttttgtttttttttctcctcagaatagtgcatttaaaaaattgtctttggccgggtgtaatggcttacacctgtaatcccagcactttgggaggctaaggcaggtggatcatttgaggtcaggagttgatgaccagcctgaccaacgtagtgaaaccctgtctctactaaaaatacaaaaaatgagctgggcatggtgttgcacatccgtaatcccagctactagggaggctgaggcaggagaattgcttgaacccaggaggcggaggttgcagtgagctgagattgcgccactgcactccagcctgggcaacagagtgagatttcatctcaaaaaagtaaataaataaaaataaaaagatgtcttttaattgggttatatatcttcttatcgagctgtaagagtttatatatttcaaagataagcccctaatccagatgtatgatttataaacattttctcccatcctgtgggctgtcttttattttcttggtagtggtatttctttaaagtaaaatgttttaaattttgaggagatcttacatcttgtacaatagaacatccagtatgctttctattgcctatggtgcagagattaaaaaggctgataagctagtccaaaactacaaaaataaagatgtaactggtatctatatagtgccacgagttgggagtgggaaagagacggggtagtggtaaatggaaaggaaggtggggagggatagggggtcacagattctcattacttctttgaccagttcaagggcataattgagttcaagttaattaaatcagattagtgggatgcccattaagcaaaaagtcacctattttgtaaatggttttcagtgctttttctattgtgtagtcatgacaggaaaaaaatatggaaaaattttccataagattaccacttcttaggtcattttccttgatgaagttaggctctaatcaagaaccaagaggcccatgtagtctgctgtacattatagaaatgggtacagttatttatggtcatcattaaatcccatgctgggctgtggtttgattgcgatattgtttaaaaatgtattatcactaaactgactttaattttagattgagcaaaatatacttatgaaggtaaattttataccaaaatttaaaaaaaattactacttttcaagccaaatgatgatttctctcacacttctattagcacaggttattggagtaacaatgaaggtgattctttgttatctaagcagtgattgatgtttttctaaaaagtcaattaagagaggttacttggcacaataaagttatgaaagtgctccaatgggttattttggagactaagagtagtatgcttatattgtctatgccatagaagtggcatttctagaatatcttgcttataattttaaactcaaatgtctggagtagagcttcattgaaatatgtttccttttaaacttttgctgctgtaccttatggatcctctcaactgagtatgtctctaaatttccttctgtttctaggctataaaactggactgttttctgtcccctgtaactcttcatgcccatgcagtgtgtttctgtgttactatattatacttttgtttctcctttgtttaaggagtggatcactttccagaaaaatttttatctaaacacttgaattgatttttgtatttagagcagttcaccaatatgtctccagagctgctattctctatcatgatttagttttaaattttagataagtttttgattgtgcaggtactgtttcccttttttttaataccatatggtggtttttatattgggattcttatccttacttcatgtgagacaactgaattttattttgctgtgctcttaggatttgatgttaataaaacatttaaatcatcagtctttccttgtgatatttaccttttgttttgagatggagtctcactctgtcacccaggctggagtgcagtggcgtgatcttggctcacttcaacttcggtctcccaggttcaagcaattctcctgcctcagcctcctgagtagctgggattacaggcacccgcccccatgcctggctaatttttgtatttttagtagagatggcgtttcaccatgttgtccaggctgggctcgaattcctgacctcgggtgatcctcctcccttggcctcctaaagtgctgggattacaggcgtgagccactgcgcctcgcctgatatttactttttaaagatgtataggttgggcatggtggctcagtcttgtaaacccagcactttgggaggctaaggtggaaggattgcttgagcccggagtttgagaccagtttagacaacatagtgaaccccatctctacaaaaaataaaaaaatgaaaaaattagccaggcatgatggcatgctcgtagtcccagctactcgggaggctaaggcggcaggatcacttgagcccaggaggtaaaggctgcagtgagctgtgattgtgccactgtattccagcctgggcagcagagcaagacactgcctcaatagatagataaagatgtatggatagtgcatacttttttaaaactaaaatttttaaagtttatatgtatatgtgtatattgtaaaaaaaattcaaacaattttggaagtacacaaagtaaaaaatgaaagttctctttaatctcatcctaccctccttatgtaatcacttgtcaggtttttgcgtgcgtgcctttctggatgtatttgtactcagatataatgcacatgtgtatgcacatacacatagtgcttattgttttgtgacttgctttttttttttttttttttgcttagcagtgtatcttggagagcgttccatatcggaacatacagatagttctacttcataatatgcacaatagtttacttagccattcctatattggtggaagtttagatttgttttggtggacatagacatttgtttacaaaagacactgctgtaaacattcatgtacatatgtctttgtgcacatgtgcaacagtgccataactcctagaaatggaattactgagtcaaagtttgagcaaacttaaacttggattgaataaacttaaataatttgcccaagactgaactgatttatacttctatgaagtatgaagatactggtttctccatattcttaccattgctgaatataacattttattttatattaattttatgaacattagttttataaaatttttacttttaatccagtggaaaatggaatcacattgtcttttttttttgagatggaatctttgtcgctcaggttggagtgcaatggcatgatctcagctcactgcaacctctgcctgctgggttcaagcaattctcccgcctcagcctcccaagtagctgggattacagacacacactgtcatgcccagctaatttttgtatttttgtggagacagggtttcgctatgttggccaggctggtcttgaactcctgacctcaggtgatccgcctgccttggcctcccaaagtgctgagattacaagcatgagccaccatgcccagtcttttttttttttttttttttgagacagagtctcactctgtcacccaggctggagtcagtgatgtgatctctgctcacttctgcctcagcctcccaagcagctgggactacaggcatgcaccactatgcccagctaatttttgtatttttagtagagacggggttttagcatatcggccaggctggtctgaaactcctgacctcgtaatccacccgcttcagcttcccaaagtgctgggattacaggtgtgagccatcatgcccggcctttttttctggggggacagagtctcgctctgttgcccaggctggagtgcagtggtgcaatcttggctcactgcaatctctgcttcccgagttcaaatgattctcatgcctcagccccgcaagtagctgggactacaggcatgtaccaccacacctggctaatttttgtatttttagtagagacagggtttcactatgttggccaggctggtcttgaatttgacctcgggtgattagcccacctcagcctcccaaagtgctgggattacaggtgtgagccaccgcgcccagccagaatctctttatatgcaatatatagtatcccatcacctttgtatagtgaaaatattttcctccaggctgttacttattatctgattatacttatgatgcctttctttgttcaaaagtttttattattaatgtggtcaaacataaatcctagctgttttggttcttgtttagtgccaagcaagatgtcttttcctatctcagtttattttcctctagtactgtcatagggtttttacttgttttgtgttttagaactttaattcacctggcgtttagttttgttgtagtgtaatgcagagatctaattttattttttcccagatggatagccagttgcacaagtatcatttactaaatagaaataaataaaagcacctattttaggtgcttttattacttgttgaattcttatttatacttgggtctatttctggagtcccttgagtttcattgttctatttgtctatttttataccagtaccaccctgttttacttgctgtagttttataaaatcttatgtcacaaaagggacaagtcctcatttgtagttattaatattatttcagttttggccattcactcacatttactctttctgataagtttgagagtcaacttaccaagtttcatttaaaacaaaccaaaaagacaaatgccaatcaaagtttgcttaaagttgccataagtttatagattaatttgtggaaaactgaataattacagtatgaatttttctatctagtaatacagaatgccttctatttatttatttgagacagggtcttgctctgtcacccaggctgaagtgcagtggtgcaatcaaggctcacggcagcctccacctcccaggttcaagcaattcttgtgcctcagcctcctaactagctgggatctgagatgtgtgccaccacgccaggctaatttttgtatttttagtagagatgggatttcaccatgttagccaggctggtcttgaactcttggcctcaagtgatccgcatgccttcatctcccaaagtgctgggattacaggcatgagccaccgcacctggtctgcctttttttttttttttttgagaccgagtcttgccctgtcgcccaggctggagtgcagtggcacgatctcggctcactataagctccgcctcctgggttcacgccattctcctgcctcagcctcctgagtagctgggactacaggcacccgccaccacacctggctaattttttgtatttttagtggagatggggtttcaccgtgttagccaggatggtctcgatcttctgacctggtgatctgcctgcctcggcctcccaaacaaagtgctgagattacaggcgtgagccaccgcgcccagccctgccttctttttatgatattgattttatttgtcttacactaaagtgtttttaatttcttcatataattcttacacatttagttttacatttattcctaaatgtcaccagcatctggtgagggccttctcactgtatcatcccatgatgggagccaaactcatccttttacaaggaaaccactctgtgataacgtgataatggcattaatggattctttttttttttttttcttttgagacggagtttcgctctattgccttggctgaagtgcggtggtgtgatctcagctcactgcaacctctgcctcccgggttcaagcgattcttctgcctcagtctcctgagtagctgggattacaggcacccgccgtcatgcgtggctgatttttgtgtttttagtagagacagggtttcgccatgttggtcaggctgattttcaacacctaacctcaggtgatccacctgcctcagcctcccaaagtgctggggttaaagatgtgagccactgcaccggccaatctgttgttttttatgtcaaatacaatccaagcagaaatccattcttgagggtggggcttccatgatccaaacacctctcattaggccccacgtcccaacactgccacattagggatcaagtttccaacacaggaacttggggcacgttcaaaccatagcacataatattgatattgagccagtttggtatttctgttcctctatcggcgtgtaatttgtagttaagccactgattattttggactttggtctaggagtaacctgtatgagtttgtctatctcttctctgacctatcttgagtgctgtcatagtaggtctttttttttttttttttttttttaagggacagagtctcattctgtttcctaggctagagtgcagtggtacagttatagcttactgccgcctctaactcctggggctcaagctacccacttggctgagccttccgagtagccaggactacaggtgcacgtcaccatgacaggctaatttttccattttttgtagggatgacatcttgctatggtgcataggctgatctcaaactcctggcctcgagcaaccctctcgtcttgaccttccaaagtgctgagattacaggcatgagccacagtgcgtagtccctgtttttagaagtttgttcttcaagagattcttctagttgtaacatctaataatgatattttgctgtggctgttagtatagtatagtatgtgtagatgtcatttttggtagcatacatattatttctgttttataaataaacagatctaagaaagattaaacaaattacccactgtcacactgggttgtgacagagttataaaactttagttttagttataaaaccttaagcactctagttcagtgttctgagtgtgtgatttcatgtaaggttcaggttcttgtgatctttgctgagttctttgtgtttctccaaatttatttccccattagtttgataattttgcaaatgctcaaatgttatgtttgcttaatattattatttaggattctgtctcctttgtacatttttctggtgttgattcttaaattcaaataaattctagttcctaaagagcacctgagatactaaaatgtgattatttcatgaagaggatctttacatgttgcattttcaagcagttgaatcttttgggccaactttcttgcttttgaaattccttaggcaaatgatattctcattttaatgttatttacctttttataataagaaagaagtacaggccaggcgcggtggctcacacctgtaatccgtgcactttgggaggccgaggtgggcggatcacgaggtcaggagatcgagaccatcctggctaacatggtgagaccctgcctgtactaaaaatacaaaaattagcctggcatgttggcgggcgcctgtagtcccagctactcgggaggctgaggcaggagaatggcgtgaacctgggaggcagagcttgcagtgagccaagatcgcgccaccgcactccagcctgggcaacagagggagactccatctctaaaaaaaaataaaaaataagaaagaagtacagtgtggcctgtttagtggttgttaagaaaccttttttctttttttttttttttttttgagataaagtcttgctctgtcacccaggctggagtgcaaaggcatgatctcagctcactgcaacctctgcctcctgggttcaagtgattctcctgtttcagcctcctgagtagctgggattacaggtgcccgccaccacgcctggctaatttttttgtatttttgtaaagatggggtttcaccatgttggccaggctggtgtcgaactcctgacctcaagtgatccacccgtctcagcctcccaaagtgctgggattacagacctgagcccccacacctggcctgaaacctttcttttataaggagaaataggagaggctggtcttgaactcctgacctcaagtgttccacctgcctcagcctcccaaagggctgagattacaggtgtgagccaccacacccagcctgaaacctttatcttataaggagaagtaggagaggctaggccttcatctgagtgatttgatgtatacaaagatccatgttacctttgctgtgtgcctttctccaggtattctcttaagaactgaattaactgattcctaggcttttagaccacctgcaacaatatctaggttgtagtgatacatgagagacttcttaagatattgcttcttcctagaaataagatgagtatgtaacttgtatgttctacagtgacaataagaatttatcatttaattaacaagactaagtgagcgtttcctaagagtaacaagacccctgtgcctatccattaatgctggaagttttcaaattattgcctctgagctcctggactccctgaaggtgtctaagcctggtctccatctttgaccattttccattccttctaatgtagggaatgcaaattgattcaaaatggctgagatgaattaaaagaaataaaaatactggaattgaccaattacagaataaaattaaagtgtgaaaattccagtttacgtttcctatagggtccatttggcatataaatcagatgctataatcctctattatctgagaagccatccgtaaaatgttagagggacatccaggccttacatagatgaggaaacaatctgtttagtggcttctaactcactcttaagttttatttattctattttcttgccattgcttctgaagaatcagcttccccaagcagacaatcatcaagtcattaaagtcataaagactttaagttatgcaaatatggagaattacttttattaattagtagtgaggctcaagtcattttatagatgcaagtcactattgcatcctttgttaatataacccttttccttcctctgtgtcagcacattgcttggcactttgtagacagcaaatatttatggatttacagtaagtcgaagtgttgcctgaattaaggttttgttacatgaatattgtcatccaaaagaccaccaggatggctacatagtagaaagaagagctttattggtgatatcagtttgcatactggggagagagtccctggcatagattgtgctccatctttgaggaggagatgggcaggttgggttttatgcttcacagggcttaatattatatagtagtcttaaatatgaagctggtttgggagaaaagctatacatatttatgaggggaattgggcacatgtgcaatgggtaaacatatgtaacatacatcccatgttcattttggggtgggcttttagcattaaaataaggtggacttgttgggcgtggtggctcacacctgtaatcccagcactttgggaggccgaggccagtggatcatgaggtcaagtgatcaagaccatccaggccaatatggtgaaaccctgtctttactaaaaatacaaaacttagctgggcatggtggtgcgcacctgtaatcccagctactctggaggctgagacaggagaatcacttgaacccaggaggcggaggttgcagtgagccgagatcgcgccactgcactccagcctgggcgacagagcaagactctatctcaaaaataaatacataaataaaataaggtggaatttggctctttaggtcaaaggcgaactataggacacaaagacaagtttgtgtgcaacctctataaagtggctgaaactggcttaagatctgcaactgcatatcagaaaagaatgtttctgaggctggtcctctgtccaatcacagttacagtggtctgggttgtaaatcagagttaggaggggtctgataatttgcaagagtgtgattttttcttgtagccgtaggaatttagaaatttgccatgtcagccaggccctgagccccggacctgtaagcaacttttgtttccttaaccttagggtccatcttagttgataaagggatgtctattttggtctttcagatcacaagggaaaaacattgaggaaaatgttgtaattgtctgcaattgaatggattatatccttcctttttctcctttctaggatataagcttttaaaatactactcttttttttttttttttttgacggagttttgctcttattgcccaggctggagtgcaatggcgcgatcttggctcaccacaacctccgcctcccaggttcaagcaattttcctgtctcagcctcctgaatacctgggattacaggcatgcgccactatgcctggctaattttgtatttttagtagaaatggggtttctccatgttggtcaggctggtcttgaactcctgacctcaggtgattcgcctgccttggcctcccaaattgttgggattataggcgtgagccacagcacccggccttttttttttttttttcgagacggagtttggctcttgttgcctaggctggacggcagtggcacgatcttggctcactgcaacctccgccttctgggttcaagcgattctcctgcctcagcctccccagtagctgggattacaggcacacaccaccacgcccggctaattttttgtatttttagtagagacagggtttcaccatggccaggctggtcttgaactcctgacctcaggtgatccgcccgacttggcctcccagagtgttgggatcacaggcataaaccaccacgcccagcctggagatggagtttcactcttgttgctcaagctggagtgcagtggcacgatctcggctcactgcaacctccgcctcccgggttcaagcaattctcctgcctcagcctcctgagtagctgggattacaggcacatgccaccacgcctggctaatttaaaatattactctttattagaaaaagaaacatgcttcatgctaatttggaggttatctgcaaaagctttctacttaagaaaatatttagcttcgttgagaacttccatactttaatatgtggatttgcgatgaaatatgcatggtcaaatgcaatgcacacatttacaaatactgtgagagcaaactaaaaatgagattaggaatccactagcaatttaagtcagatattatactcagctttctcccactagatatttttttcttaatgataagcttcctttaagagtgattataggaaaaacccttttttccaacctctatgggtgggactggaaggaattctaaaaagttggccagtaaatatctgggcagtgtattcttacagtcaaaggaaagtaagttccccagggatggcaagtattttttctggaaaatccttatcatatgtcttatttatattacagatgttcctcaacttaaaatgtggttgtgtcccagaaaacccattgtaagttgaaaatgtagtaagtcaaagtgtgctttaaacttacaatacagtattttcagtttacgatggatttggaggtaacccccatcataaatgaggagtgtactgaatgtgtatgctttcacaccattgtaaagtcgaaaaatcctaaattgaaccatccgaagttagagattgtctgtaactggtaaaagtactattagaactgttttgaggttgggtgtggtgcctcaggcctgtaatcccagcactttgggaggccgaggcgggtggatcatttgaggtcaggagttcaagaccagcctgaccaacatggtgaaactgtctactaaacatacaaaaaaatttgctgcgcatggtggcggctgcagtggtgggcgcctgtagtaccagctacttgggaggctgaggcaggagaatcgcttgaaccctggaggtggaggttgcagtgagccgagattgtaccactgcactccagcctgggcaacagagtgagactccgcctcaaaaacaaataaacaaacaaacaaaaaacaggcacggtggctcacgcttgtaatcccaacactttggaaggccgaggctgacggatcatgagatcaggagttcaagaccagcctggacaacatggtgaaaccccatctctgctaaaaatacaaatattagccaggtgtggtggcgggcacctatagtcccagctcctcgggacgttgaggcaggagaatcgcttgaacctgggaggcagaggttgcagtgagccaggattgcgccactgcactccaggctaggtgatcgaccgagattccgtctaaaaggaaaaaaaatgttttgaaacagataatagacttacataaagtgttgctgggatgttgtgggctctaaagctgttgtttgcagcaggtaccagactggtgcatctggatgacctccccccatagtacctgcagcattttggggtgtttgggtgaaggtggattgttgacagcacataaccagcatttagattttaaggatctgcctttagatatgggttcatggccaaaagaaaaaaaaagattctaaggtttagtagtcttatggagaatgcaacataaccttagtcttcgatgcttcatagatgtaaatctaaaggacgcctaatagttttatatatatattttttgtttgtttgttttgttttggtttggtttttttgtttgtttgtttgagacagtcttgctctgtcacccaggctggcgtgcagtggcgcaatctcagctcactgcaagctccgcctcccgggttcacgccattctcctgcctcagcctcccaagtagcaggactacaggcgcctgccaccacgcctggctaattttttgtatttttagtagagacgggggtttcaccatgttagccaggatggtcttgatctcctgacctggtgatccacccgcctcagcctcccaaagtgctgggattataggtgtgagccaccatgcccagccatatatttatatttttaatatataataatataaattatatactatattacatataaattttatatattatatgccataagttatgatataaattgtataatatataatatatgaaaatgtaatttatatattatacattatgtgaatttatatatgttttgttttgttttttagagacagagtcttgctctgtctcccaggctggagggcagtggcatgatcatagctcactacatcctgggctcaagttttcctcctgcctcaaactcctaagtagctgggactacaggtgcacatagccttgcccagcaaatgtttttattttttgtagaaacatgttcactgtgttgcgcatgctggtcttgagcgtctgacctcaagcaatcctctcaccttggcttcccaaagtgctagaattacaggtgtgagccactgtacctggccgtacccaatagttttaattcacttcagttgctttaaaaatacatttgtatttaatatctctgctatgttccctctataatgcaagagaagctcagtagcagttcagtggcaatttctaattgccacattaatgggaggaagtgcctggcatctggatctcttcctgccttcaaagacttgccatttgtgcatcatttgtaccctgaagatctttttttttttttttgtcttgtgttttcgttgttttctgaatttaggagagatgcagttgctaagaaatgagataagttaggccagttgggatggctcatgcctgtaatctcagcactttgagaagctgaggcaggtggattgcttgagcccaggagtttgagaccagcctgggtaacatggcaaaaccccatctctacaaaaagtacaaaaattagctggatgcagtggcatgtaccactagtcccagctactcgggaggctgaggtgggagaattgcttaagcctaggaggtggaggttatagtgagctgagatcgtgccactgcactccaatctgggtgacagagtgagaccctgtctcaaaaaaaaaaaaaaaaagtgagagaaattgaacaagatggtttgatatttgaccccataaagttgtcaacatttgcctagttgtagtaaaatagagtaccattttgtacttgttgtgaacatggtgcttttttctccctccaaatcttagtgcatgatccgtaaaggttattgaattgtttttcaacttcttaaaggaaaaatttcagttaaaattttaggcacttattctaaatgaattgagtttatatatttgtcactagaaaattactatctttaggtcaggcatggtggctcatgcctgtaatcccagcactttgggaggccgaggtgggtagatcacctgaggttaggagttcgagaccagcctggccaacatggtaaaaccccatctctactgaaaatacagaaattagccaggcatggtggtgcacgcctgtaatcccagctgcttgggaggctgaggcacgcgaattgcttgaacctgggaagcagaggttgcagtgagcagagatggtgctccagcctaggcgacagagcaagaccctgtctgaacaacaacaacaaaaagccacgatttttagttcaatagtagcttgtaattgtagttatagtatttgtaagttgctatggttttgagtgttgcttttaagactgttgttagttacccactaagttttaattgcaaggaaatttcagagaatgtgaaaaagttttggttaagactggaaaatatctattcttgctttcctcaaaactggcttcagtgattacttaatgacagcagaatgctttgaaaatatgctctttaaagtctagctgttactaaaataccataataacttatatgtaagtgatagttgcttttttgttgttgctgcaactgtggtaagaggaaagcattattagcaaaatccttaagaaaaatatagtataaaaaactggtaaatagagaatttacaaaaatggaatgtgggtgagaacatgagacacatgtgtataggtttgacatctttatattcatttgaattctttgtttccttggactttgcaggtaaggttgttttttctttttgacaaactgtataataataataattatttttatttgagatggagtctcactctgtcacccaggctggagtgcagtggtgtgatcttggctcactgcaacttctgctgcctgagttcaagtgattctcctgcctcagcctcctgagtagctgggattacaggcacctgcaaccacacctggctaattttttgtatttttagtagagacagggtttcgccatgttggccaggctggtctcaaactcctgacctcaggtgatccacccgccttggcctcccaaagtgctgggattataggtgtgagccaccgcacccagcctttttttctttcttttaaaaaaaaagtttaatagagatgaggtctgtgttgcttaggctggtcttgaactcctgggctcaagccatccttctgcatcagcctcccaaagtgctaggattacaagcatgatctaccttgcccagcctgaccatttcttctaatggaaggtcctatatgacagagagacatggatgatattaggatcttgtttattctcatcaaactttatactcaattatagtcagcaaataaactatttagagttttcttttcatttgctgactaccttaccgttaacttattatttagtaagcaagaacaaatttaaccagcaatttcgggaatgagaaaaggagtaaagaatatatatggcttctgtaatccgaaaacagaaaactcaccataacctgggtaattgaaagagttgcttttgtaaaatgtgccgttgaaatactctttaaaaagggggttgggagtgtgggctgcctcaaatcttaacatcgaagctaaagataacatttaatttatcacatatttattgtatacttggataaaatgaaaactccattgagggagtcttaagaatttgggatgatatggttgttgtaactgagcgataaatatagttatcttggtgtctttaatatttgagagtaaaagcatttttaaaatcaattgtatgattcttttaataaaaaggaacttgcaagtttatgtggaagaagaagcttttctttttgtttttcttttttcactttttgagacaatgtcttgctctgtcacccaggctggagggcagtggtgcaatcacggttcactgcaaccttaaactcccagactcaaacagtccttttgcatcagccttacaagtagctaggactacaggcatgaatcaccatacccagctaatttttaaatttattttttattttttatttttatttgagatggagtctcgctgtcgcccaggctggagtgcggtggcacgatctcagctcactgcaacctccgcctcccgggttcaagcgattctcctgcctcagcctcctgagtagctgggattacaggcatgcaccaccatgcctggctaatttttgtgtttttagagagatggggtttcaccatgttcaggctggtctcaaactcctgacctcatgatccacccacctcagcctcccaaattgttgggattacaggtgtgagccactacgcccagccaggatatatttatctgaacattatagctatgaagaataaagatatccattaagcaaactggattatgggaaatatcttaaatttttctttattatttaatatacaagcaaaacttctttattgtagaaaaattagaatatagaaattaacacaaaggaaaaaaagtatagtcctaccactgggttgaatgaattctgatatttttcctatgtgtgcttctttcagaaatatggctacacacacctttctgcaggagagctgcttcgtgatgaaaggaagaacccagattcacagtatggtgaacttattgaaaagtacattaaagaaggaaagattgtaccagttgagataaccatcagtttattaaagagggtaaggagtgtgaatgccaaccagttcaaaccagcgaggaaagaagaaattaaattcaccttttggccaggcagttgctcatgcttgtgatcccagcattttgggaagccaaagcaagaggatcacttgaggccaggaattcaagaccagcctggacaacctagtgaaaccccatctctacaaaaaaattttttaaaaagccatgcgtggtggcatatgcctgtagtcccagctgcttgtgagacagaggcagaaggattgcttgaccccagaagttcaagtccagcctgggaaacatagtgagacctcctctcaaaaataaataaataaacaacaataataataaaaataaatccacctttcatatgtgtaatgaaaaatatcaaagattttttgttttgttttgttttgagacagtgtctttgtcacccacgctggtgtgcagtgtcctgatcacagcttgctgcagcctcaaccttccaggcttaagccatcttcccacctcagcctcctgaatagctgggactacaggtgcatgccaccacacctagctaatttttttctattttttgtggagacagggtctcactatgttgtgtaggctaggctggaactcctgggctcaagtgatcctctcacctcggcctcccaaagtgctgggattacaggagagagccaccacacctagctcagagtattgaatttcttgcttgtggaaggtggttatgcttgagaatggcagaactggaaactttgctttcacctgggaagaaagcggacagtggcaaggattctctgctttgatttaggatcacctatagctcaacttaacatccatttatgtgcacttggtcctttcttcccaacattcagacagttattctcttccatttctgtttcatcttttttcctccctctcctgctccctttccttttttcttttttgcttgctttcttttttttttgagatagagtctcgctctgtcgccaggctggagtgtagtggcgcgatctcggctcactgcaacctctgcctcccgggttcaagagattctcctgtctcagcctcccgagtagctgggactacaggcgtgcaccaccatgcccagctaatttttgtatttttaatagagatagggtttcaccatgttggccatgatggtctcgatctcttgacctcatgatctgcctgcctcagcctcccaaagtgctgggattagaggtgtgagccaccgtgcccggcccccaatttttttttttttaaataaacctctttctttcttctttctctctctttttttttttttttttggcggggagacggagtttcgctctgtcgcccaggctggagtgcagtggcgtgaactcggctcactgcaagctccgcctcctgggttcacgccattctcctgtctcagccttccgagtagctgggagtacaggcgcccgccatcaagcctggataattttttgtgtattttttagtagagacggggtttcaccgtgttagccaggatggtctccatctcctgacctcacgatccacccgcttgggcctcccaaagtgctgggattacaggcgtgagacaccatgcccagccctttctctgttttttaacccacgtccctctcatcattgatgttcgctcagccatggtgtctacttttctggtgtatcaccatcttcaatgtgaaatgctaagacttaagaacttttaaaactaaaatatgtcacatctgaggctgggcgcagtggctcacgcctgtaatcccagcactttgggaggccgaggcagggggatcacttgaggtcaggagttcgagaccagtctggccaacatggtgaaaccccgtctctaccaaaaaatataaaaaattagccaagtgtggtggcacacacctgtaatcccagttacttgggaggctgaggcagaagaatcgcatgaacctgggaggcagaggttttggtgagccaagatcatgctactgcactccaggttgggtgacagagtgaaactctgtttcttaaaaaaaaaaaaatgtccgggtgtggtggctcacgcctgtaatcccagaactttaagaggccaaggtgggtgaattacgaggtcaggagttcaagaccaacatggccaacatggtgaaaccccatctctactaaaaatacaaaaaaaaaaaaaaaaaaattagtcggccgtggtggcaggcacctgtaatcccagctgctcgggaggctgaggcaggagaattgcttgaaccaaggaggcagaggcggaggttgcagtgagccaggatcgcaccattgtactccagcctgggcaacagggtgagattccgcctcaaaaaataaataaataaataaataaatgtcacatctgaaaaacagacaccctgtatttactaggtaactcttcattctagattcctagaactataatcattaacaggtattttcacatagaagaacagtgagggagaaaaagaaatgcaatattgggaacaacaagaaatggctgaagcctgatggaaaagagctatgtaagcatctggttggaactaaagacattggggatgaaaagtggcttgtacacacattcttacctcttgtctcagaggttggagtaacctgcttccattccaaaataaacaaatctctctccctattcactctttctaatgtcctttctctgctctataaagcagagaaagtattatgaaagagcatatggtttttactttttcactctctacttttccactctctacttttcaaccctttgcagtcagattctgtttccatctccattgcagctgctcttgcatgttaccaatgatgatctctatcaaataatacttttgtcattatttttcttgtagtatttaactttaatcagtctgtttgaaaatcattcctcctttgttctttatgacagcgtctctttttcttctctccctactgagtgactgctatttctctatcctctttaatagttattcttttgcaagtttccaaaaccatgatgcttctcagggttttatacttggtcttattcagctctcatttcatatgtttctttctggatggttttagccatacccaaagctttcactatgctcatgctgctaaagtctatagctctaaaacaaaatgtttgttttgaattccagacatatatttttaactacctaactactaggcctttatttgaatgtctcacaagtgtctcaaaatcaacatgtcagaggctgagtgtattgtctaaaatgtgatcttcctttacttcctgtcttggttaatggttctgccatctacctagctactcaaggcataaatctgggaatcatcctatattctcctgcctcttcctcactttcccaaatccattcagtgagcatatctttccagttatttttcttttaatcctcttctgttagtctcttctctgtcatcaccttagttcacatcctcttttttcctatttttttttttttttgagacagagtctctcactctgtccgccaggctggagtgctgtggcacgatctcggcttactgaaacctccacctcctgggttcaagcatttctctgcctcagcctccccagtagctgggattacaggtgccagccaccacgcccagctaatttttgtatttttagtagagacggggtttcaccatcttggccgggctggttcttttgttgcctttgttttggggcagccagtgacatttgggtttaattagcttccgttaaaaagtattttatcctacattaataattaatgctaatggtcttttatatttgtccaaagctttgtgttgttggacttgaattatatgaatagcagagttgagcacctgtagaagtaatatactttccactatagcaaaacgacttgggaagagcaaagggaataaagagagggtctccagttgctggagcaaagataatggttaatggttattttcctcttattgccgctcttattgtttatttataactttgtgaatgtgtatgtgaaagtaacatatacttaactgtagaaaatttggaaaccacagaaaaaaattgtgtgtataaaatgaggtggttttgagaggggcatatacccataaccacaccaacttgaggcaaccatcttaatacattgatagatttccttctagtcttttttctttctttctttttttcttttcttttttttttttgctatgtaccctccaccctttacttatggtttaaataataataataaaacacccatgtatacactaccatgcttgagaaatttcattttgttaatgttgtattgaacctaaatcttctttttcctttaggaaatggatcagacaatggctgccaatgctcagaagaataaattcttgattgatgggtttccaagaaatcaagacaaccttcaaggatggaacaagaccatggatgggaaggcagatgtatctttcgttctcttttttgactgtaataatgaggtaatgaaaatcttcatctgcccacataggctttaagcaactgttagtcaactattagaaaaaacaaaggattttttaacttatattttatattggcagcagtgttttttgaattggtagattggatggacggaacagcactgtcttgctgttggagtattaaaaactatttggcattagcagccttgtggagctaaattttcctttattttcaaaataacaagaatcagttttgatttttaaaaaataagaattgacatacataataatattaggtaatgaagctgaactactttcttaggtagacattattatcaaagagtattttgccttagggtgttgtttactggaagagaaacacgtttctgagaagttgggaaaactttctgttttaaagaaacatacagggctgggtgcggtggctcacgcttgtaatcctagcagtttgggaagccaaggtgggcgatcaccttatgtcaggagttcaagaccggcctggccaacatggtgaaaccccttctctactaaaaatacaaaaattagcctggcatggtggcatatgcctgtaatcccagctacttgggaggctgaggcaggagaattgcttgaacctgggaggcagaggttgcagtgagccaagatggcaccactgcactccagcctgggcgacagagcaagactgtctcaaaaaaaagaaaaaaaaaaagaaacatacaggatagcctgatttgtcttaagagtgaaatgatcttgaaaaaagtaaaaaaatgtacttttctttctggtagttctaataatgaagccagacatacttttgaataactaaatacatttctcagaatcatttaattaaaaagcctgaagtagttagtaccttgaaagaagttggctgttcttaggttgaattgtaaatgtgcccctggtggagaatcttgctgcagcctttgtgttgttttattttattttatttttttgagacagagtctcactctgttgcccaggctggagtacagtggcacgatcttagctcactgcaacctcccaggttcaagcagttctcctgcctcagcctcccaagtagctgggattacaggcatgtgcaccatgcctagttaatttttgtatttttagtagagacggggttttgccatgttggccaggctggtctcgaactcctgacctcaggtgatccacccgccttagccttccagagtgttggaattgcaggcctgagccaccatgcctggccttttgcattgttttaaaacgtaactctcttcttccaaccccccaaaatatgttttcatttacccttcaaagttaactttagaatgttaccacagctttataacaaggaatgtttattcacaattaacaaaggatgctttattcaaatgcaaatatgttgactcaaatattttcaaatttatggaattatcaaaaagcagccaaaaatgaaacaaagtttgaggcatgtaattcatacctaataagttaataatatatctgagatggaatcatacacatacagatctttttattacagtttgaaaaaaaataagcaggaaaaactgagtcatgaatgaattcttattatgctctgtacttatttaacctagtttatataaattgaaccacatgtttacgtttaaaaggactttgcatgttgattaatgaattagacacattgggtttattgcagggtttttttggtcatctctttaaactcttgttttctttgcaggttaaaagaatggcaaattcatatctatatttttaataactttgtatctctttttagatttgtattgaacgatgtcttgagaggggaaagagtagtggtaggagtgatgacaacagagagagcttggaaaagaggtacttggcagtttttacatacaaccacttcaatcccagacctgccttatttggtacaggaataaaagagtcacatttaaacatgtaaaatggcttgtttaagatgttaggtcaatcagtcggggcagatccagtgttctgtgagctctcctataacatgtagaagaaaggatagatacctagaaccttgcaatatttacttcttttgcagaattcagacctaccttcagtcaacaaagccaattattgacttatatgaagaaatggggaaagtcaagaaaatagatgcttctaaatctgttgatgaagtaagtgttcctagcctgtctttaaaaaaatatgtcaaataaaaatgtgattatttgttttggggtaagcaggaaaaaaagaaatactatcacagattagttagtttttcaagacactggaagccagtcatggtggctcatgcttgtaatcccagcacaagtgttcaagaccagcctgggcaacatactgggactctgtctcttaaaaaaaaaagaagacactggggactaaatgaaaaattagggtttttttcctttctgagtaaaacctaaaatgaggtttataacttcaaacttgttcttcatgagaaatgggtggtttatgaattctaaatttgctcccaagcactagaaaactggtattttaagaaatgtgagttggatcacatgaatggcaagtcatctagctcaagagctccaggcttctttcttctgccacagaacaagtagcaccacaggtgaaggtttccatgacttatcacttctctttctttttcataaatagcgatctctaaattgtggtttgcaagcgcaacaaaatttctagtgtctcttaaggaacctaacctccctttccccgattccctgaatcttcatcctcttatagtcataagataaaaaagaaaggcccaggggaagaagattcagggaatctttttttaatccattgacactttgtatagaggtgaggtaatacatgagaaaactgtgttttagaatcagaactaagaagataagccacttcagttatattttatattttattttacattttatttacagtttatattttatcaaattattggtagcctctcaagaatattttgtcctaaaagcactaatcgaatgtaatatagtcataattttatatgtattatttatataatattactgtctaaagtaaaatagatgaaactaagtatgtgattcaaaaaaatgattcattttgaaaattaatgtaaatttgatttttttgtgtgtgaccctgtttggagatggagtctttattttttatattattttatttatatatattttttgagacagtgtctcactctgttgcccaggctggagtgcaatggtgtgatctcagctcactgcaacctccgtctcctgggttcaagtaattctcctgcctcagcctcctgggtagctgggattacaggtgcccgccaccacgcctggctgatttttgtatttttagtagagacggggttttgccatgttggccaggctggtcttgaactcctgaactcaagtgatctgcccgcctcgacctcccaaagtgctgggattacagatgtgagccaccgcgccccgccaaatttgattatttttaataagaacttagctgtatggtattttaacagtacctgcttttaaaattattatcatctttttcctttacaggtttttgatgaagttgtgcagatttttgacaaggaaggctaattctaaacctgaaggcatccttgaaatcatgcttgaatattgctttgatagctgctatcatgacccctttttaaggcaattctaatctttcataactacatctcaattagtggctggaaagtacatggtaaaacaaagtaaatttttttatgttcttttttttggtcacaggagtagacagtgaattcaggtttaacttcaccttagttatggtgctcaccaaacgaagggtatcagctattttttttaaaattcaaaaagaatatcccttttatagtttgtgccttctgtgagcaaaactttttagtacgcgtatatatccctctagtaatcacaacattttaggatttagggatacccgcttcctctttttcttgcaagttttaaatttccaaccttaagtgaatttgtggaccaaatttcaaaggaactttttgtgtagtcagttcttgcacaatgtgtttggtaaacaaactcaaaatggattcttaggagcattttagtgtttattaaataactgaccatttgctgtagaaagatgagaaaacttaagctttgttttactacaacttgtacaaagttgtatgacagggcatattctttgcttccaagatttgggttgggggcactaggggttcagagcctggcagaattgtcagctttagtctgacataatctaagggtatggggcaaggatcacatctaatgcttgtgttccttatactctattatatagtgttattcatgattcagctgatcttaacaaaattcgtagcagtggaaccttgaaatgcatgtggctagatttatgctaaaatgattctcagttagcattttagtaacacttcaaaggtttttttttgtttgttttctagacttaataaaagcttaggattaattagaagaagcaatctagttaaatttcccatttgtattttattttcttgaatacttttttcatagttatttgtttaaaaagatttaaaaatcattgcactttggtcagaaaaataataaatatatcttataaatgtttgattcccttccttgctatttttattcagtagatttttgtttggcatcatgttgaagcaccgaaagataaatgatttttaaaaggctatagagtccaaaggaatattcttttacaccaattcttcctttaaaaatctctgaggaatttgttttcgccttacttttttttcttctgtcacaatgctaagtggtatccgaggttcttaatatgagatttaaaatcttaaaatgtttcttattttcagcacttacatcatttggtacacagggtcaaatagggcaaataattttgtctttgtataatagatttgatatttaaagtcactggaaataggacaagttaatggatgtttttatattttaatagaatcatttatttctatgtgttatgaaattcacttaatgataaatttttcaacatacttgccattagaaaacaaagtattgctaagtactataacatattggccactaaaattcatattgagattatcttggtttcttggaagagataggaatgagttcttatctagtgttgcaggccagcaaatacagaggtggtttaatcaaacagctctagtatgaagcaagagtaaagactaaggtttcgagagcattcctactcacataagtgaagaaatctgtcagataggaatctaaatatttatagtgagattgtgaaagcaaccttaaagttttgaagaagactgatgagactaggtgctttgcttcctttcatcaggtatctttctgtggcatttgagaacagaaaccaagaaacatggtaattactaaattatgaggctttgctttttgtttgcttttaagtagaaaaacatgttggcaacattgagttttggagttgattgagataatatgacttaactagttttgtcattccatttgttaaagatacagtcaccaagaatgttttgagttttttgaaagaccccaatttaagccttgcttatttttaaattatttccattcagtgatgttggatgtatatcagttatttagtaaataatctcaataaattttgtgctgtggcctttgct

SEQ ID NO: 38235 - DNA, 846 bp, Homo sapiens
gaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccaggtttgccgggaggggacaggaagaggggggtgcccaccggacgaggggttccgcgctgggagctggggaggcgactcctgaacggagctggggggcggggcggggggaggacggtggctcgggcccgaagtggacgttcggggcccgacgaggtcgctggggcgggctgaccgcgccctttcctcgcagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacaggtacgcggagtcgcggaggggcgggggaggggcggcggcgcgcggccaggcccgggactgagccacccgctgagtccggcctcctccccccgcagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagact

SEQ ID NO: 38236 - DNA, 63088 bp, Homo sapiens
ccagcctgagccacatccctgggcttgacttctccagaacaagcctcctggtctttctgggagagctctggcagcatcactgtgcctgtgcagggagagcgggaacccacttcctgcaccggctttctctgagttcttcaggatgaattcgctctggtctaggtaagttctaccccgaggccaccttcacttcccaaattccagcttttccttctctatccaaactgttacaaacacagtaacaataatttttaaaagctttttttttctctgaacacactaagtccctgctaattactgaaactccaggcattacaggaatatgtggacacttaaagaatcaggactacgtgggagagggggaggcagctccccagggtcctgggttggcacacaggctccaccactgtgtgactttcaacaagcgacttccttgaccagctgcccgctctgtaaaatggggagagtaatattcggccacactgagtcggtgtcaggttgagttaatatttggagagtttctggcacaggtaggtgctccttaagtgcctgttaaataagtgaagctttgagaaagtgtctaaaaggcgacacactaaatttttaagaggctggaggtgggccagggaggggaggtctcttatgtaatattttaatatctttttaaacctgaagaatgtgttcttgtagcactcctgtaattaaaacttaatgaactaaaagtacacccctcctgctcataccccttttgaactccgcagccgcgccccccagccggaggccccttgggcagcagacaatgggtgtggattcgccccaggtcccgccggctggggcggcgacaatacaccagtccccgacagctatttacatgacaagggcttccgggcgtgtctacgcgagttcccgtctttcctggtcgtcctccttgggttcgggtgaaagcgcttgggggttcagtgggccatgatccccgagctgctggagaactgaaggcggacagtctcctgcgaaaccaggcaatgggtgatccatcttgggggcttcctccccctttctccaatttctcttccctgagcccccagggaccttgtgctcctcagaagataggctagccccaagagcctgggtcaaggaccccagggacgggggcgaggggagggcgcaccagcaacccgcccgggtgcggctggcaccgagttcggctccccggccccgggcgtgcgccgggcaggcgttccaagctgaccgccgttggggagagggcacagcgcccctcctccgttgcgcgggtgccgggtctacgtgggccgcctagctctggccctttaagagcccgccccgtttcccgtcaccccgccccccggctcggggagggggtgcgggggaacctcggcggggattggcgcagcgcgcgccccctccccggcccccgcgcggtgggaaccggcagccccgtctagcgctgacgtcagaccgtctgcctgcctccgaccgcggtctcggagcgaaacccgatctccttggacttgaatgaggaggaggaggcggcggcggcggcggcggcggaggcgctcggctggggaaagctagcggcagaggctcagccccggcggcagcgcgcgccccgctgccagcccattttccggacgccacccgcgggcactgccgacgcccccggggctgccgaggggaggccgggggggcgcagcggagcgcggtcccgcgcactgagccccgcggcgccccgggaacttggcggcgacccgagcccggcgagccggggcgcgcctcccccgccgcgcgcctcctgcatgcggggccccagctccgggcgccggccggagccccccccggccgcccccgagccccccgcgccccgcgccgcgccgccgcgccgtccatgcaccgcttgatgggggtcaacagcaccgccgccgccgccgccgggcagcccaatgtctcctgcacgtgcaactgcaaacgctctttgttccagagcatggagatcagtgagtgaccccacgcccccctccccggagactccatcgggctcggaccctatgtcggggcacagctgcgagcgggggtccgggccctgcgcgccccctcggaccgaacgccctgcgcccgggcagcgcccgccgcgccccgggcgcgccctcccggctcgcggcagctggcggccggcccggctttgtcccgcggcgctgcgagcctggcacggcccccgctgtccgcgccccgcccgcccggactcggacccggggctcagcggcggcgcacggcgcgggagggttggggcgggcggatccgtgaagtttccattttatttccctgagggcagtcgcgatggagcatttaggccggctctttatcaactttgggcgggggtggaggggcgtgtgagacactgtctggtctgcgaggtgtctggggctccgggcgtgtgtctggagtgttcgcggcgctgtgtctcgggctctgagtggatgtccgtgcgtctgtggagtgtgcgtggctgcgtggctctgtctgggtcttcggcgtctctcggggtgtctgggggtctgagtcgcggtcttgcccaagagtgcgtgtcaccgagtcttcctgcctctctctgtgtgtctttcccgtgtccgggccggggtgcctttcttgagcgtgtccatctttctgggggtctggtctggttgggccggatctggggaccgtgtgtgtccaggtgtctgaatccagggctcagctctggcccgtctggcccagcgtggatcttgaatgtgtgtgtgtcattgtgccagtgtctgtgtccccgacgcacctataaatagcctctgtctggacagcttggttcagtctggctgagaccatggttacaaaggagtcaaagtttggggctgtttgtgtttgggactgcctggccctaaataagggatcagtggaccaacggtggggagtggggttttgaaccttgtcgctaacgcagccgcctgggcacccaaaagttcagataagtaagtctctacctcctgcacacacagcccacctaggtggacatttggttgagtggagaattgaaccactacctcccgggttctggcttctagcttctagcctacaccttgtcccccagcccaccttttcggggaccttttgcttccctgagctttagtttccccatccccaccctgaagaagcacgccaggtgaaggggcacacagtccttccctgctgggggccaggctgcccctagctggggcccggagctgagaagcagccgctgtggaatgaaggcagtgtctgggcggctcataagcaagtgtccgcaggcggctgccagtttgtggcccctgagcctatacagtgagcttcaagtggtaaaaataaccaggctggccgggctttggtggtgggtccttccatccatccacctctccacactccctcccagcctggaatggaaagctctccccctaccccaccttagctggcctgtgccagactagcgaggtgccaggaggacctgcccagagccagcgtttgcggaaccgacttgccttcccagaggccctttgtgaactcaggaggctaatgaaatgcacgagaatgttattaaaatacgttcgcacacgtttggagagtcttgccttagatggattgctgcttcagtgccctccttgcctcactttttgcctttcgctctgtaaagctgccttgaggacctcctgctcgaggggcacacatccttgtgtcacccttattccaagggctgggcacagtgcatcattttgctcttgtctctctttatggttcaggacttaaaaaaaaaaaaaaaaagcattgttcttatttctgtcctttcttaggctcatcagtccatgatgtttttgacctgacatcaaggcctcttgttaaatgccttgccgccgccctctgcactttgccccgccgccgccagcagcctttgagtgattgggacccttggggttaatacctggaaccctagcctgttccagctggcccctgggtgccccagttagtcctgtgttctgtgtatacacagccccctacttattggaagaaagctgcaaggcacggagggaaccaaccagtctttaaaatgcaggtatactgtaacagtttgttttcatcagatttccccgagagactagggtgaggaagtggtaaggcctggtgtctcctggagtttctttacaccaaaagataggaaggaaggagggaaggaaaaaagaaaggaaaaaagctagtatttggtttttcttttaactagtagtggctgctgtttttcatctagtacatgctgggagttgtttgcaacgagaacttgatggatggtttggagttgggctttgaggcagtgtccaagtggctcctatcctgtaagataccttcttttggcagaaggaaattgaccttgctaggtccttaagccatgatgggcctcactgtcttcatctgaagaatgaggccgtgatggatgaaatctagaattctatagtctttcaagatagggcctctcccctgctgagcctggctggaggtcttcaggctggaccgggcttcccacccactgctggttcccctgtgtggtcttcagctaccccaaatttcagacctgagaggagcctacgcaagctcggggttcacatccctgacttacagatgaggaaagtccaccgtggaaagttttgcccgaggtccaaaacccacaccagccccaggccagggtggtttctcttggactgcacgcccacacctcttgaatttggtacttgggccccagagcaggtcctccttgaaattgggggctgggggaaattgtcagagcccctttgtacgccgggagccacgtctgctctcaggatgctgaatggagtgggcttgactgtaacaggacactcctggggccccattttttctgagagtcgagggatgaggctgctgtctggtgggaattcagtgttcccaaaacatacccgtgggaaaaccctttcttttaaaaagccaagggtcctgggattaaaagcaggcagcacgagtgacagccttgcagatgtcagcctggagcttgaagcggctacttttgaggaaaggactcctggcacctggttttcctggcaacctcatctacctcatttcagttctgctgcgtctcagagattacccccggtctttctcctctggttattgcctcaaacttctggggcccagatggatgctaagttcgctctcgggaaagactgaacctggggccacccggtgtctgctcacgcgggaggcgtttcctgagagttctgggaggtgcccctgccctgggcccatctctggtggtatctacggtggcagctgtctttttaacatcacccactggccagagtcaccgagcctctgattcttcttctccaaccttttccaaacaaatatgagaaaatatcagaaactcacaggacacccaggtttccctgggcttgcctggcacatgctgtttgacacttgcttgaatcaagtgagggtgtagagacagtgccttggcactgtgacattctgagcccggtaattctttgttggggggcaggaaaggccgtcctgtgctctgtaaggtgttaccagcacccctctcccacacccactagataccagcacccctctcccaggtttgacagccagaaatgtctccagacatggtcaaatgccccctactgagaccactgtttaatcagttagtggtttctcctaaggggcttgagggccagagggcagcatctgcgttgccaggagacccttaattcccgtcagacgttcgtccctgtgaaggcctgtggccactccgcagccactcatccactcagcttttactgagtgcctgttgtgtgccatgaaggaaagataggggcttcctcttgagatgaagttttcccgttttcgtcttggatttgcttttctaaggagagaccctggcgttagtgaaagctgatgttttggattggggttaaaatacagatgtccaacaccagctgttctcccctgtggacccgctaaaccctgggacttttcacccacaggttttctgactgtctgggttttaggttgtggtgcaataggggagttattaagggagttgagttctatgacccgaatcttaggtcagacagttggcctcagcttcccaggaggtctgggttaagccagctacactgcccagtgtgacccagggtcgaggtgagtttagcatttgtcaaagcacaaaataactaattgttcctgtacaaacacacacgcgcctgtgagtgggtgcttgcatgcgcacacgtgcagacacacacacgcgcacacacagtcatacacaggcacacacagcttctaccccatctgtctttcctgccctcttctctttgggttgggaatggttaaaacttctgggcatgtaagaagaaaaggaggaagagtgcacattctcccctgtaagaggtgcgaaggtatgcaccctctccataaaagaaggaaggtggacccctgtgtgccgctgcccaggagaagggaggccgtcgggaggtctgtggaggctggaagcgtctacagcagagttgcctccctcaggagccccaaggaagcctccatgctgcaagatgcacccgccaccaaattgccccagagccacggggtcaggtgtgcccacatgcctgcccccaccatctccactcccatcgtggcccagggccagggggtttaaacgtttatagtccggtcaatagtttaaaagccagaaaatgtttggaggaaggtgctggtggcagggtccaaacctgaggatcggtgtggccttctctcttcaggtgttagcatccagagaccaagtttgcaggcacctcggtgtctgggatcctgcccaaagagaaggaactcttacacggtgaatttcggaggctgtgctgctgccagcctcgggttctgtacggtgcacatgctgagagaaggagattgaagccgagggcccattttttgctttttacaaagtgttgcgtaacgcacgcatggttggggcacgtgcgggagctgtgcgggagacggacctactcttcatgcaccctctggagtgacaaggatggtaccatgctgtgccaggggctccccgaggctgggggagcatggttcagggaagcaaactcagttgtctttggggtgggctccagggaaccaggggcaagagtccagtttaaaggcactgtggccactgctcagcccaccattgccacatgggccctgagtggccagatctttccgttccagggcagccgaatggttagattttgacataaaactcctgggttttaagtgctggcagttccttttgtctcccctgtcaccaagaagccccacagaacctgctggcagaccccatctgtctcatcaagtgacctgccctgctgtgggtgggttaggagtgagaccgagggccagagggatggaggcgtcaaaacttgctggccgtgtcccctttgtgccccccttcactgtcatctgatgggtctgtaaagtggggtgataatagtccctgtgctgagggtgcagagagattctggctgtgtgtggcctagtgtctggagcagctgtgtgttcatagaggtgagcgatgatggtggggcggattggactcgatggtccattctgcctggttccctagcggtcactctgtaacagagtgcctagtgatgagaaggccttcaccagaaaaaggttgcccatcctcggactggctgggaaggttggaatcaacaggcccatctggggcccatggccttgaacatggaggtaattgactatctgtgtaatactccttgtccttgccaggcccaccgcagacctggctggcaacgaccccagcatgcccgttgctggcccaagaggccccagacggtctcttcgggtctgccagcagggttcccttaatccactgccaggcttggtggacagaggctggaagagggggtacaaggcaaggcacaaaactggggccgtgaggtcaacaccgccctgacgtccagatgccccactggctgcagttcctaagacagcctaacctgggagcagaaagcccagaagcttctgatggtttggggctcccctttgtgagaatcaattgaaatttttaacaggtgatcatatgtgggggcaaaccattaaaagaaaggccctgatgtcccccacccccatcaacaggtgcagcgggggagggccggggaggggccggtcttcagtttcacttctgctccaagcactccttcctgccttctccccagggtgggctgcacccctctgtgaagctgtgacagtgccgagtactgacagtcaacctcattttcccgttggatgacactacaaagccaaaccttgacacctcaggggtctcgtcagggtcttgtcaggcaggcactggcagaactgtttgtcaccaaaccgggaaaaatcccagaatgacttaccagccagggcaggggcttcagcaccctggggtgagcctggaagagcttggggcatccccagactatccgagagccacagaatggcttctcttttctgttcctgggttactgatggatttttttgcttctgctctttttcctagttgaatgtgaagagattattatgtgccaggtattagtgacgcatttttctcagtgttcaaaacaaccctgagagagctattgcaccaatctgcggatacaaaaatgggatcagagagtgtaagatacttgctcgaggtcacacagccaggaactgatgctccattgggattcaaacgcaagctccctgaccttgcagtccacactcccaggctttcttttccactacaccgacctcctgagctccagggctttctttgcaagattggccattgcagtgctattttaggctcccaagactgcaagcccatattggaccatttgttagggaagaacacatacgaattggccacctctcagagcaattgggtccattctgctctggcaagacaccggctgacattcattggaaatgtctccccaaaacacacgtgccttgtcaggctgcatgaggagctggtgtctctgtctccagctctctgtgcatctctgacataccagcaccaacagatgtcgtggcgggggtttggggagtagctggggaatgttcccagggaatcaaatgtagacttgataggggacatcactagacacagcctccgcaggggctcagcgttcagcaccatctgccacacacctctgacctccggtgctgttcccagggccgcagaacgtcagggaacgacacagacaaattcctgccctctacgagctgctgcccttgtagggagacaggtgaaagaacacgagtcatttcagaagggaagctgagaggccacactcagaggcaccttcagggcctcgcctagggagacccccagcctggtgtcctgtttggggcccaggagcaccctggccttcctcctgtcacacctgtcatggcagtaatcgaatctttgtgtcattagctgtgccatgtctgctttccctccaggcaccaagcaccgaggggttgttgttggttgtgtccctgaacctggtaggagtctcatgtgcgttggatgaagggaggaagtgggcaggtgaactttcaagagattccagattcttgtggtcaagatacaggctttgaagaccttcattctgggggtgagcgtggtatcctcccgagtctccagttgaccctctgtgaggtggaaggaagaatgacatctgttctatggggttgtcaggaccgttacctgaaaagcacctctggtacaaaatgtgatttttaatgctccaaagtttccactattgggggcaggaaactgtgcccgagtttcatacctgccctctcttctagagctaaggggcaggtacagaagtcaatgcagacccacctcccctgcacccgctccagttgccctgggtggtcaaggtttcacagtgatggctttagtcctccaaaggccatcaaatggcaaaaacgcattgccagagcttgctgcaggcccccagaaggagaattcctagggtgattcttcttggcacacacttgctgcagactgggagtgttttggggttattgtcctcacggaggaaggtggagtttgctcagaggtgatgttgagatgccatatgctggaccgagctaagcagctattgtgactcaacttcggcggtatcaggtggtgatcagctattcctaatgctccagcacattctaatatgtacctgttgttaatgggaatgggggtaggaagaaaggtggcttggaatcagtgcctgccataaactaataaggatgtcagaaagattcgaactatagtctgattttcttctctttttttttttgatgtcttcttttttcttttcttttctttttttttgaaatggagtcttgctctgtcacccaggctggagtgcagtggtgcgatctcagctcactgcaacctctacctcccgggttcaagtgattctcctgcctcagtctcccaagtagctgggactacaggcatgagtcatcacacctggctagtttttttgtatttttagtagagacagggttttgccatgttggccaggctggtctcaaactcctgacctccggtgatctgcccgcctcagcctcccaaagtgctgagattacaggtgtgagctaccatgcccggctccttttttgatgtcttttaactaaaatcatttgttattgtttcagtgggcttgggaaatggctctactggcagaaaagagaattttatttagtaacaagttgaaaatccccagtggctctgggatctggatggtggataaaggttgattgtgacctccacgaaccaactcttcaccatcagcaagaaacacctcgcaatcctccttagcagtggtgctagactccccttgggctggacggccacagctagaaccacctaacagccatgcaggttcgagatgccactttgccttttaagtcttaagaaactgtcctatatcatttgcccccactataggcttttggggcttcaggggaggtggctgtgccaagtgcttatttgtgttgataaaagttgcacgatcttggcaccaaatagatcaataaacattttgacagttggtggaagtggagttattgtgtacctcagtttccctgttcccccgaacatgttcggtaaagcatgggcctgtggaggggtctgtcagtggcagctgtcagcctctattgtcattgacaggttgtcatggattcccagtatgcaagtcgcatcagcatcaggagtggaagagtctctgctggtccttaaggtctccaggaggggccagttccatcactggctttgggagcatgaaagtgacaaatccagccatgaatttgcctgagtgtcagtggttaagaatacaaaaaggtgtgtttttatatttagagccacgtatcttcaagtatatacaatatacatttgtattttatgtatgatatatgtaaaacgcggactgtcgaaacatgtgcgttccaaccgccgaggccgggaggcttctctgaggtcccttgttggagtccaccacggacatcccacctcccacaggtgtgtcacagggtgagctcaggtgagcctgaccttctcccagctttgccccgggttcccccaggcaggtgaaatcagattttccaggccatgtcctcggcagcaagagaagtaggaagctgaatcggtttttcagaaattttgagcaatgcaaactgctctttcccccaggaggttttcagcaccagtggtctcagttgcctagttacccctctgctcatctagaccaaatcccgagagactgccctgcaccccacacgccttgcttggcctgtggggcagtcctggcacctggtagttgcacagggagagagactgtggcggggtcctggggctctttaacatagctcagccgctttctagatgtggagtctttggtcagctccttactctccctgatcttggctgactgatttataaactaggatttataattactgcacggaggtgattaaacaaattgtcttttaagcacctatcacagggctaattcctagtagatgctcaataaatggccacgagagtgttggtgccgatggtaagtagggattggtggtaagcaggatggctgcccgagagtgtgagctgggcggagctcaggttggctccttcttgcatcaagctgcccactaggcttgcacatccttgatgtgggcaacacccacagactgcacaagctgtcccataaggttcagatgcccagacaacaagattcggttcgagccctgtggggtgatgcattccagagaccacacttcctttagggaggctcagaatttgcatggggccacagcaaacgcctttcttcattcccctgagttatacagcaggtagcagagcttcaatctgaaacacctcgtggatgtcagttgagagatggcgtgagagtttggttgtggtcagtgatgtgcttcagactcccagagaagggagactctcaatgtcctcttatggctgctacatttaaggaataaaaaataaaagttaatacagagacttgccaagtctgtgtgtgtgtgtgtgcctctatatgtacgtgctgacttcttaggatttctgcaaggtccggaacagctttccagaagaaggtggaaagtgaagccggggagctttgcacaggtctgggaaccctgcaggaacttggtgcccgccgcgccagttccgcagattcccctcaccgggctgagctgatgtctgtagctggccagagttctaattgccttcctaaaaacaatttagttggtaataattctgtaaatgtctgaatcaactttgcgcaaacaccctgagtaatttctttgttcttttctttctactttgtaattggtgtctgtaaaagccaaaggtttggtcttgcggaaggcatgattcatttattggtgtctatgcctcctcgttattgagtcatttcagatgccatcacggtgagccagggctgattcatatggggctgagcttagaagccaatagggtcacggccataggaggaagctggttttctaatctgtttatgatatgggaaaaagaggcgggtgtattgagatgatggagagggtgtcaattacatgggtgaatataaccaatgaaataacaccaaccagcctttaaacaccactccatttgctgctgttgatcgttaggatagatcgcagctcaatgcactcctatctcgggtgtatctctccctgtgtttatggatcttgatctctgagcaggctgacacgggagggatgcccccaccccagacctggagagacgtttcaagtcataagccacagatgcagagaatgttgcctctttaaaaaatgtatcagctggacctaccatgaaacaaatgtttaaatgtttaggctcacgtgtaagggagcctctgccccattccctactcatttctctaacaatgacaattattagatgtttgcggttgttcgttctttgcattattctccaaactgtgtgaacttacacatggtgccacttattttgcctaattttattagttgctttggccctaaattgtcactgtcctcccgtctagagggtaatcagagttgtttgccacatggcccagaggtgtaattatgagtccaaattccaactgtccgtataaatctaggctctgcctgcaaggggaatatttcttcctgcagtgctttcctctggttggttccccatctgcatagctgcactgcatcctccactctgcatcggggaacaagggtctctctcaggtcgttttcaatatccagctcctagcttagggccaagtgcaaagcgtgtcattggtgtctgtctagctgctggttggatggctgtgagaaagttcactggaggagaaatttgccagtaaccctgtagaatccagccagtatttattgagctgcctagtgacttccaaagtatagatgagggatgttgagtgcatggcattccatccagtgtcccctacttgctgcccataacagacattgctaatcaattgcaccctccatccttgctgcactcagatcctcaccgaggtggtactcccagtgtctgctcccagtcggggttcagagagggcttgagtgatgacacttgttgaccatcgggttgtggatgatccttatggggaaaactggaagttgtgcagacaaatggctgactgaaagactagtggggctgcagaaatcctggtgcatgcagccaccaggaccaactcccatctgctcctccttgtcaccctgtgtgagtcccaaggcagttccttccatgagttctaaggacgttccccatctgtagatggcccagccccacacttcagctaccatgtagcgggaactcccacacttcagtgaagcagcatccaagggtgactccaagagcaagcctccccgaagagcatggctgcccggagtaagcattactccttggttccttgacaatatgtcattttccttttttaaaaatcaggggtgtaaacggaaatgtgcacagaggcctccattttctcttgccagcctctctccacagaaatcttgagctctgctctgagcgcttcgcggcattccctttcactctagtgagaatgagctctggatccttttcccagaatagactcagagcggagttgagggtggggttcaggaacaaagacaagaaaggggagaatctgggaggcagtcagtatttagggaatgaacccaacacccaacagctttgtctccttgtttttctgggttcttgccggtgacgtcgcggctttttgaaccctagcaattcctactgacagtggcaggtgctcactgagctctttgcacaccctgtctcactaatcctcatggcaaccccatcgcatggaggaggtggagctaagtcacctgccagggattgcccagcacaccgcagagcaggatttgaacttgggctgcagtgtcttggcacagggtgggagggagagtcacagagaagcgggaccctttgccagcccatggttgaaggggaaagttctagacacaaggttttcctggcattcctggagccccaggggcgcccaggctcatacctctttcttcctgaagcctgtgcctcatttgtctaggcagggacgagcccaccttcccctgagcctcagaaccgcctgtcacttggtttaagggatgggctggttgggggcctctgctccttcctcctcctcccatcctccacacacttccctccttggaagggtgccagcagcgatccctggggctcagagcaggagggagcagaaattgtcggtaacaggttgcagctgaagggagaaagtggtccctgtgaccagtgaggtgcttgggcaggatctgagctccccaggaggggtgaggagagagtccagagaacatctggactggagggaccctctctagccttcttcaaaatgcagtggttctcagtcctggccacacattaacaccacctgaggggctgtggcagcaccccagacccactacctctgggatggggccgggccatctgggtttcctaaagctccccaggtaattccagggtgtggcagagttaagcccgctaagctgccctcagccccaagcttgcagatgggtaagttgaggtctggtgagggggaggaggaaactcaggccacttttcagccacaaaatccttctggtgctaatcagaggagtactgctaggccaggcccagtggctcacacctgtaattctagtagtttgggagatgggttttcaccatgttggccagactggtctcgaacttctgatctcaattgatcttcctgcttcagcctcccaaagattacaggcgtgagccgctgcgccgggccaggcctgcagttttaagcagggcagacggattgtgaaagggccaagctgggctggaggtccgattctctagcggtgaaatgccaggtgcttcagcggggaaaacattttgtaacctgaatctgggcccgtaacgggtaccagagacctgggtgtctgtcccagccccagccagggggcccaggatagtggcagagccttggagactggacagactccagcagctctggggctgggttggcccatcagccgctgttgccagccccgctgggctccagcccagagccaccgcctgcccgcctcacctggcctgcattcctttgcagggaatgaggatgtgggtgaccccagacaggtatgaatcatgtcttggggaggtggttactcagaggcggcaaacgccgaggctgccttcctcccagacagcgtggacctcagtgtggagcttcgtgtcctgggcttggggcatggctgctgaggtgggtgtttgaagggcctcattggagtgagatgggctgacaggcagtggtccctctccccttgactctagcatgctctgaagaagaagaagaaaagagcagtgtggctgtggcaccgggataccaggtcacagtcatggcagcctcacttaccggctttgtggctctcaggcctatttttcatctagagatagaagtgctgggaagcagtcctgacttcctcctgttgtgagggcagcatggacccccctccccttatttcctgaatgcctaccatgtgccaggcacagcaccacatgcagccctgcaagagctactagacttgtcttacatggcgctacatgcaaccctccaagagctactagacctgttttacagataaatagactgaggctcagagggcagaagtcaattgcccaagggtgcatgactcgtaattggccccactggatgtccagcccactgcacccatctgtgtcctagccaccctcccatgtcagttccaagaaatctataaacccgaagcaaacggtagcacatgagaaaactggagatggcacgtggatggtcatttaaaatttaatagttccgtactcatgtgaatgtatgttaggaaaaatataacaagcacattgtcgatttcgtgagtattattgcttaagatcgggttaagtaataagtaaaccaattgaatattttatttcagttgaaaagaaaaatactgaagaattttaatgcctttaatggggtacttgagtatggcaaaaatcgggaaggctgagagtgtcatttgggagctgtgtcccaagtccctcgtgggcctttaatcagcagttacagatctgcagctcctcctgtaggatggaagcactttgctctttggccttttgaggtcacccagctatttgaaggtcaggggcaactcgattctaatgagatcaaggtcacagggtcatgttgcccccaggaaagtgggagatggagttctgtggtccaggctgtggccctgctgcagggctgggaggtggagaggtgtggacagagaaggacctcccatcctcaccggcagagaaagctcagagatgctcccagctggtgatgaggctccagcctgaatctcagcctgctgctgatgatggagaagccagcacttcactgagtacttccttggtgccccgtcaccacccaacacctcctcacaaggcttgcagaagagcctgctgagactcagagtgtctgtatcctgccccaggtcgcagctgtgtggcatcctgatctctgtgtattttaaccaagatctcgatgttccctttttgtaatggaaaaaaaaaatctccttaatttaattgttctgtgatgtctgaaatgggtggatattctgcagaataggtctgtgacttattatttagcctcctcatgtacctttttagctctggggagaaagacaattggaagcaagtgaagaaaagggctcaggtgtgtcccagccccaggccttgcagttacacctgccacctgctggccgccaccgtctgctggcccccaccttcgacttttactgctaggaaaagtcccggggcggggaggtgttggggaagttctgccgcctgtctggcttgtggtttggcagaccttcctggatgcaggtctcggatcctgggcttgagtctcatcctacaagaactagggggaaaggtcgaggaggcagctcctgagcccactggctctgacttgtgtggggcagggagggcacttggcactctgggcctggtctctctgctcatcctgtgggcctgcctcctacctgactacctgtctaggaatttttatggcagcccgcagaggtactgcaggtcggctggaatgtgagatcctggccctgggaggcgtggggtaggcgggcttcagacacagctcctggctgctgggcaggaacgcagagcgaggcggccactcccggcctgctcacaacataagcgtgaacatcgtggttttgccacttcgggacttggctgagttttgccacgtttccttatgccctgattctgccaggttaattctgattaggtttcggtttgaccactgcctgggacaccttgacccacagcagggattgagataaacagttgattatcatgagttgtgaaagatggaaaatagtcctattaccagcagcacttaggcagccccctgctccctgagacattgctgagtgctgtcctgtagaacagaaccctcccacttagcctggcctggatctctgccttttctttccacaatgaagagtatccaggcaagaggaggtggacggaggttcctcaggctccaggtgaccatggcttccacaagccgccctgccagtggcacccggctggcatggggtgggacagccacttggcctcctctgcatctggcagcctcagccctcgaggaattgaatcctcctggggccaaaagtggccgtgctcgtgacccgccagctgcaggccaggtacagacctgggcccttggaaggagcagtggcctggcagggaggggcttcagggggaccgggctcaggagtactgggcatcctggtcatgaggtgggagcttcgctcccctgtctgggccgccctgtgagttcctgccaccagccctgacagaccattgctcacctgcccccatgactcttcccacacctggtgggctgtgccttggtgcttgcagctgcccaagtccaggggaggccacaccccatccatagggagtgagtggtcaccacgtaagagtgtcctcggggttgcgtctcctctatgagcctctgtttcttcatctgtaaaatggggattgtaataggcacccactacacagggggcatcgtaagaattaaatgagacagtttgtggcaagggctcagctcagtcctgggtgctttgtaaatgctcgagaaacaaagcctgttctgtttgtaagacgtagccagtattggaggagtggtggctccgtaagccccgggacctacccgtgaaaagggagaagagggtgatgggatgtgaaaagttgggaggctcgtcggggaaggagatgtgagaatgaggcctgcagtgtgagtaggagttctgcccagggggaggtttcaggaagcagcccgtcccaggcacacccagggttctgtttcccctctctgcagatggaggtagttgttcaagaccacacagcgggggtggctttggaacgagggctgcgggcaccagtgaggtgggtctgagctcctctgtgagcatgaaatggacagtctggaccgggagatggtgcacccagccttagctcgcagcttcttcctctgagaggggtgagagtgagggtgagggtcctgcctcccctgtcctattcccacctctgctgcaacctgtgtaaccctcaacagcagagtaatgattttcttcgggggaaaacgttctccctaccccatccctgaggaagcaggaaaggagttttggggagtaggagctggcatcagctcaggggagaggagcggtgccagtggtgcctgtccctggggctgctatagcctggacaccttcgccctcctagaccagcccagagactgtgattcaactctcagtcagtctggggccttgactggtcctcggtctgttcctcctctttcagagcctgcacaagaacccctagcgcagcccctctgctggagggaccttcggaagagttggggagaaggaggctcccctcatgccatgttaatgggaggggacaccagaaggctgggtggcatttgccattttgcacaattaggaacctcgctaatgggtaattttactcaatatttcacgccattcatgaactcatctgacacattcattgagcacctactgtgtggtgggcctagtgttttggacacacacaaccgtgaaaaagacaggccagctcctagtgtggcagactggaaatcggccagaaaaccaatgactgtagaacagcttttcagaagtcccgtaggaaaagaccgaggggccggtagggacgaggaggaggcaccaggaccagctttctctaaccctgcttctctggtagccttgtaagcgggatccccaggcctcggggtgtagaggcatcagcgtttatcaggcgcagtagttctttcctcggatgtgagctgaaatggggcgagtgcaggaacctgcatgctcacacattttctcccaggaggtgcaagttccagaacccccggctcctggatcctcaccaactggtgggtgaggagtagacggccaggctccaccccagacttccggcaggtgggggtcggctgggcgtgtcacttacaaaactcagaagaagccagatcttcatctgcaccgagtgtttcccaggacagagcccaagcaggagaagcgcaggctggggtgcgcgcctgctctccaggcccctgccacctgtttgcacatgaccctctacacccgccatagcaatggagaccccgcctcctgctacagttaattaatccttcttttttgcttcacaataaaaatagcatggctcttctgattgtaaaaagtgatatacactccttatttaacgaaaaattcaaagaatttgataaatgacaggcgaaaagtcaaaatgcctgcaattccagcacatggaggtaagtttcttctctggggatattctcaggagcatttgcatgtgtagcgctgatgcagggcgggtggcagtggtgggggtgggtgcaggcactgggcccggcccccccgggtggtctgtgccccaagccgctgcccagcgtctcttcgctaagaggtgaggtcagaggcttgcttgggaacctctctggcctccctgtcagcccagctggcagaggcagggagggttccacatggaggcccccaggctgaaagccaggcaggtgggaaggttagatctggctggctctgccttcacccaagagcctcgtcctccttatccataaaatggggtgacaccgacagttcctagctcgtggagctgaggtgaggagtgcatcgggtgttgggagaagctcagcaaatgcctcgcacacagtaagtgccccatggacctcggctgctgccgggcgatgcagccactggcccctgggacccacgtcagccccagcagcgccgtgtctgtgtccctccgatatatagagctgctgaatcagactttgattcacaatcaaaggcttctgtggtcaaacacgtctgaaaggccacagcctctctttttacgacaggtccctgagacccagagagggtgagtaggaggcaggagcatctccccatggccctgggaggcagattcagggcggcccctgggtccccttgtccccggagctgggaatgtacttgaagcttctaagctgatcatcatgagaaacagctatttatgtgggcacagttgtgaggactctccttgaactagttcctttagcgacgggcaaagaggattccccgagtttcatttggagactgtcccatcttggcactgacctaggtccgattcccggtgctgggtccgatgctggactccccaggaggaacggggtggtgtctgttgccacagaggtggaccaggccagagtcacccctcacctcgccccactccccagccgacctttctgcctgggaaggccaggcctctgtcctggtcacacaatacccccttctcacgttcagactggcggtctagacactcatgctccctttgttccgaagggtcaggagttgggggagggccccagaaagtgggatttgggccgagatagaagagagggggtgggtagtgggtgaggggaaactggcttcaaaggaggcggccagttctccctccgcctgcccagcgagtgaccagccctaccaacaaaacgtgcaccaatttctaatgatagaggcagctcccaaacagaaacgcgttttgaaacccaatcaagctgacgcccactcgggcccatgcgcccagagctgtttagctgacaccgtctaaataaaaccccacagcctgtgccaataagtctggggcgggctgccagcggggatcgaaggcccagaggcagcgctcagccaggtctgagccaaagaaacccctggggaaagatgcagaattcccacccccacccgctcagggaatgctcaccatgcctgggtgcctcgtaaaggggaggacaggcgggaacatccccgaagccaccttgtcctcatggccgttagtgacaagaagctccaagtactgacccaggagagaggcagaatctccagtttgattccctggctctaggcttagtgtttgcctatccaaggcctgtacctcttttagcctcggtcgcctcatctgtcaaatgggaatgtgagcatttgccgtgattccttagggagaatgaatgtgaggctctgcctggcacaaagttccctgcctggcagagtgaggtcgaccactgggtgctgaggatgatgatgtggtagtcattcagcccttgctgcctgccgttctttgtggcttcctgatactctaactctggggttctcaactgccccctagggacattggcagtgtctggagactttttggttgtcacaacctggggcatggaggaagtgcctaccccgtaggcgtctagtaggtagaggccagggatgcaactcaacagcctgccatgcccagaacagcccaccccacaaagaagtgtctccttcctaaggtcaggcaggtggaggttgaggaaccctgatttaactcaatccaggccccagacacccccctctccaacttgctccctgcataattactcacatgaggctaaatagaaagtagttgcactgacctgaggaggaaaacggagaaatcttggaatggggagaaacacccaggtgcctactcccctggggaattcaaagctggtggaggctgagctgaggccgtcccgaggcggaggctgagctgaggccgtcccgagatgagggcagaggtagcagagaggcctgaaccacccggcctgaccttatggtgctcacagtgagaggggaagagggaaagacactgaacccagggtggatccaatgtcagggcccgatctagatgcaggttcagacttacttccctggacagggaacccatagactagagagagctcatggctcaggagccctgctgggggcccttgtgggctggaaatgagtttgggcaagcttgggtcagcttggagttgagaagggcaggctgagcagggccctgtagcacaggtgcagaggctggacattgctgtggatatttctggtgactcctggagcccagctgtgtcagttgctccccaaatgcccctgatcttgtcctgctggatttctcatctttcttctgagtattttatcctttcttttcaggtcaaccaccccatgactatgtttggggaagagttggccaaaaaagttgtatttgcctgatggatagagccttcctggtgcagtggggagaggaagctcctggaggcagggctgggctctttgagaaggagtgtggcaattgattagtaatgtcagtcgtggttgccagaccagggagtggctgtaggtatgtgtaggggaagtcacacatgcaaaaagcacctgggttctttcctgacctggttgggttgctctgggcaagtcatgtcccctctggccttggggtccctctgttaaatggcagggctgagtcagtggcttctgggtcacttcactgatgtgctatcttgcggagccttggaccagccccaggcacaggtgccccaggcacaggagatcacctggagaagaaggaagtcgctcagttgaaccccttaacggaaaaagaacattgctccacatcttgaactcattcctccgcgttggcagatcggttctagaacctacacatccacgtctggggcagaaccagaggctgtgcccacagacggcagagcttgtgggctgcttgctgcaagaggagcgaagattaggaacagtcgtttaaaagcaattattaaaaatgagagtgcggaaaccaaaaacagaaatgggggaaaactctgcagtcctctgacatagcccatcacccttttgggaggctgctgtaaggagcagctggagaagtcctctgggtgtatctccctggtgcactgtccttcccacgggattagtgtagacagctgtttttggtggggatcctaagcctgaccatggttttgtttgtggggtgttcactgcgggtccagcactgagctccactctttggtgtgcactgtcatctcctcttcattgcatgggattgaggcaggtacttctggtcactccatctcacaggtgagggccttgaggcccagagagggggaaggagcctgcccagggcctcgctgttgaaagaggccggtggatgccgtgttagtggctggttagtgggtttaatgcacaagggcatttaatcctcacaacagctctttaggacaggtggttgagaccccatttcacagcagggtaaactgaggctcagggaggtgacttcccttggaccacacagcctgaaggtggtggagatgggctttgtctggttccagcgtctgggctttacaacatttgagagagaaaaaggaaggaagggaggacaggaaggaaagacagaggaaggagagcagaccagtctcatatagaagctgccatgagcagggcaggcatggaaaggaagtgaccgcttggccggcaccccatcagagaaaggtcgctggagtgaatgagccctcactgggcatctggcaggcagcaggtctttctctagattggaagctgacagtcccaggggaagaaactagttcccccatttaggagaaccacccctgtccggctgccccggagtgtaacctgaaggagaggtcagcgcacggcttgtgttgaggctctgggagctcctggatgctgttcttcctcccttggaaccttggctgcatggaggcccactccccagtttagagggtgtttgggtgtcaccctgagtgtgtccccgggccacacccttgcagccagcccacctccaaccctgtctttctttcctgggaagggagggtgactcattttatagtgaccctttgtatgagaagggctaaaatgcaaagttggaggtgagaccagattcctctcctcttggttctggtccacccggagcaggtggaaacaagttctcccccatgcattttcatgtaacctttttttgccacacgccccctttaagtgaacagtgctacaacaaaattgctgctactaggtgttagagacatcttagcaggcgccttcccagaacaagaagagccagaattatttgctgggcggccacgtacagtcctattttaagagcgacctggagggcagcccaatcacagatgatggtttctagttctctggagcagccagccccctccccccagccagtccaccagcagaccccaaaccagaccgataacttagcattttcatttaagtccatctgacaaatcgttttaggccgagaaagcaatactgcatctttaaatggctactttgtcagcgcgtctctgtgcgctgtaaaaagtcctttgttatctgtgtctagacagcacgccagcggaatatttggtctgcgtgaggggagagagatctgacaaggttgaattcatttaccggcttatttaaagcgggatttcaaaacacttgctcataaactgttttcggcccagactccccggcctcctcctagcccacactggcttttcttgcttttataatttttcacctgctcgggcagttagctggaggttgcagccgggtgggtaccctggcgaggagagtgactgcggcttgcagcttttttctttttttaattgtcctctttatgactgtctagacgttctgcagatgcacgttctcgggggaaatggcttttccctctggttacagtacttgggagggttgcagacggcaccccctccaaccgtttgaccacccagccccctttctaaaacccctcagccattcttcctctccttaaatgaaggcactttgcctcctggcagcatctttgtgtttataacacatttacttgactgtgctaattttataccatcatcgaaaaaggaaaagtgacattccaggttttcttctctctgaggggtgggcagagacccccccctcccagctcctccccacaacttcccccatttcttcttacagctcctccttttgtggcaatgttttgttttgtggcatgcctacatgcctagacaaataaaacaccagaggttggcttcttaaggatgaaaatatcagggctagttgaatgcgtccgaggttttagttctgccaaatagatgcattaattaacctcattgccatagcgactaggtcattgttaccgcagtgaaaaactggcaagctatgggggtggagggtctcccgggccccccaatcacccatcacccgcccaacaggaaccggtgcagaggccaaataggcatcgtcctgccagcaaccagaaagtggtcccactttggctccttcagactctgcagtgggtggtgggggcggttctcagagcccccctccttcttaggcagctacacagcccagtggacttgggaaattcagttgacttccaggcccgctacatgttcaggtcaggagggaagcaggcttccgagttcccttctggagcgagggctgcggggtggagagaagtcaccctgcccccctcccagctagacccctaactccccgacccccacccgtgaaaactattgtcattaccattgacctgctgcaaagccataaatttccacccgcctcccctcccgcagtcatcaatctgccctccggtttttacttggtagggggcacaaaagctggggagggggagtcaggcgtgggcagctgaccagatgtctcctgggatccctaaactgcgtctcatttctgccagatgaagcgagtctaacctatcagcctacttgactgcggtgttgcggagccgggggtggggcgtggtgggacatttcgtctgcaggagatagagaaggacatcccataacactccaggtttcttggccagatctttttatttctacccccaaaacagacagcccacaggcaggagtggtctgttgagcagctactcccattgtgccccgcatgggtttatgatggactttgtgcaggtggctggacagtgtgcttcggaggccgagaactccaagaactctgagagctgctgggctctagtccttccctcttggtggcagcctggaagcctgtaaatttccccgcggagtggggaagtggggtgactgtgcttgtaatatttcaagttatacagtcattcgggggttctttctgctctctcataattacagcatctttaagaagaaatatcaacatgaagtattttcaggggaagagacttttaaaagaaacacacacacacacacacacacacacacacgcacacaggccagaacaccaccaccgagttagtatagtaatgcaagttcgtaatgcatgcagggctgctcgctccaggaagctcccaagcaggaatgttcctgaaggatgggctattaaatattggatcctcaggctggcagatgcgtctgcgctgtaattgggtctttcctggagtaattaaaggaaaatgattatattaacccaagtcaccaggccagcatggcatagagaactgaatggcaacagtattgatgtttccctccaaaaactggcctctctcagcacatcaaaaacgcacccttggcttgagtttagggagctttcctttctttgcactttttataattgatcgcgtgtctcctggccttctttttctttttaaaaagcagtgggggatatccgtgccctctaacgtgagcagcctctacctgctcagggagatctgagcttaaggacaagtgtggcgtaaatgcccccggagactgcggcgtgagagatgacattgaaaaaggtctggcttttagagctcaaacctgggaggcttggactcttttttcttcttcttctccttttctgaagagttggagaagccggagtttcaagaccgtcttggtgtgctgccttatttaggaggcgagctgctgctcatttgtcaggcaaaacagatgtggtggggagacaacatctattttcataattcgaaacaaatctggcgagccgccttccttttcagcggggcctgctcatgcagaaagcccagctcccaggcagcatctagcagaaatatttatagctcatccattgaactttccttcctccaggaggagttggtttctgctggcgatggggacacagacttgacagggagtgggtgctgtttcagggattttttttaaatcaaaaactggaggagtgtgggtcacagccagcgacgcagctgtgcctctccttctcgtgtcctttcgtcttccaggtgtggggcggtgggcacgggagcctgctctgtagcattcagcagcctctttactgggagggcagttaaaggctgactttgaaactcctctgggccggcgcctaggaccccgacactccagggagacccagaacctgggcccctagttaccagtgactttgtgcttaggtatgcaagggcagcgggctgtcatttccccattttatggatgaaaccaccgaggctcagagaacagcttgcccaaggtcacacagggaaccgctggtggagctggtcccccgctctgagcaccattcacactcagctcaagccttcattcccactgggagcctttgctacgccgtcacctcccatcgaaggtagctgtgtctgtctgtgtgtaatagtgacctaaggaaggaggacagacccggtatttgggcgaatcacccatcttctgttcatttatccagtaggtgagctccttccctgtgccactggagatgggaggacctggtgaatggaacaggcctgagcctgccctcagggagctactagtctggtgcagatgggaaacagagtcagatactgaacggaggaggagattcgacagtgtcacatgactgtgcctgggggctgctttattggtctgagagggtctctcagcagggctgaccttgtgctgagaatgagggatgagaaggagtcagcggtgggaagaccttggggggagtacctcaggcagagaggagaagccgagagggtgaggtctgctaagctaggtgtggtggccatgtccagttcccagctggccgtgtcaccttgaggggggactgaccaggttgcagttccttcttctgtaaaatgagggggtgactaaagcgtacacaagttctgattctgggaaaaccacagagaatcgagttttgtaaggtgctgccagcaggggaggaggtggagggtacgtggagagctctattattgcttacagaattgaacgtgaaacgacaatggttgctaaattaaaaagttggttattttaagcagtgaaaggtctgggagggccgttcccttcttgatgctgggaccacccttgtaagaggcagcgccacaccatcctcacggtcgtctcaggcaggggacaccctagagaggtctctcgctgtcacccgcagatggcagaagtgggactggctccggggcaacccctggttgcctcgcacagggctccctccctggcaggaaggaggcccatgcagggtgagggtgccctcaggagctcaggcaggcggcaggtttggagggacgggggttcccagtggcagtgatggaggggtgtttctcattccccactgccgtgattccatgcaagtggatggagcgtgctggagaggtcaggaaggagcatgggcgcctgcctcacccctgccccaccagcactcaggcaggcctcacaaatcacaatgggccctgtccctggtagcacccagggttgatgaatggggactcccaggccctggggcacttggaaatccctcatgcaaaaggtggaaactagaagttgtcctgcagattgacattctcagaactccttccctcccttcctcactgacccggccccgacccgtgggatgattttcattctcctgcctccagagaaggacctgtgcttacgtcctcacgcagactgctctccgccactttccctcacccatgtattcatttcacaagcatttacgaagtgcctcctgtgtgtctggcatggtggttggtgccagtgtgcgttgatcggtgatcaaggtggttgcgactccagcctacagaaatgtacaatccaagtgtgaaatgaacaactgccctttcctaagcgtttgctttcaaagcagatgtttttagactaagttgttgttattcttcaaaccggttgtgtgtggtttcagtccctgcttctgtcttcacattgaggcctaattaggaatcagctgttgcctagctaatgtttattgagcaagcactatgcacccggcactgtgcctgagatattcactatcatctgatttaatccagagtttctcgaccttggtgctgacgtttgggctcaataattcttttctgtgggggacttccctgtgcgtggcagggtggatgtttagctacttcccctcgcccactggatgctagtaacaccccctcccagttgtggcaaccacaagtgtttccagatatggccagatgtcccctggggcaaaatcatctccggtagaagaaccacaccttagccctagcagctgcccttgaggtcccagtcccttcatctgcagaatgcgggtgttgacgggactccccaaagcggctccttgggagctttgaatgatataatgcacttaaagctcttagcacaacccagctaaagctggagtggctgcagctctccccgctggtgtgtctgagtgtctgacgggcagaagtcgtttttaccatccactcatcccccgacggttccctggggcttgcagtgcaagccagactccatgccacaagctaggctcaccttgcaaagatggtcaaggtcacagccattgtgaccctcactcccaccagggatgcctgcgtggacagcctgtacccaaggaactggaaggcgcaggctctggctctagccagctttgcacggttgctctgtgtctctgggcaactccctccccctctctggccctgtccttttctcatctgacccattttaggggcttctaagccactctcctcccctagaaactcagtatctaagagggtgagttttttcccaaggttttcccctgggtcgtttacaattctgatcacttagggatctctgagccactcacagtgccaggtgaccacccccttccagcataacaaattcacctatgtggctccagcagttgctttcacatcctgggcttcataattgaacaagtggttccttcactaaggaagcgagcgcctggttggaatctgttcatccatagcgggcgcttgtaagtccattccctgcaggtcccggaacccgccactgaacgatgtcaatttcagcctgttggacacggctcccgcattgtctgaaaggagcttccccagcaggtctgatgtgtgccgtgtttggagagtcacactggaaaatgatacctgaatcgtttcaagttcacgttgtctatgctgcctttgccccaatacacacccatggccacctgcaggaagtctcagtgcagctttgccaagccccaaagcagctagctcctcattgtatcttcatgctatgccccaggaggtagggtttcttgcccttgaatgagacaaaggtttcctacctcagggcatttgcacttgccattgtttggccaggagtgttttttccccaactctcctcatatttaaggtctctgctgaaaagccacctcctccgaaaggctgtccctaaccagatcatttaaggaggtccccgctcctaggtgctcattatcacaaacctgctctagttctgttccatgttctggagaagacagaggaggactcttcttcaaaaacactcgtgttgttcagagatccctgcagttcctggctcttctgtgcctgaagtgctcactggcagagacgtccgcagttcttcctgaacaatatgttgatactttacagtgatgctttctcttgggggtacagtggtagtttgggacatccttttgggagtatttgattgtattggggaggcagtgacactttacatcggggaatcccaagctgctctccctcccctggctcttgtcacctttaagacagaggttggaggttccatgcttattacttggggcagacaataggagccagtgcttccagattacttaaaatctcctttcctcgtttctaaattttaaatgacgtgtttagaatttaatcttcaaacctgggagccagacctgcaagtggagagatgacagccgagagatggtttcgtgtggctgcagcagccagatggcagatgctgtgagcgggaggcgagggaggctgcgagagagggaagcggcttctgtttcggctcttaccctccctttgcaggaaactaaccccctcccccagtgccaggcctgggccaggccctaaggaccgcttaaggctgctggcctcagcctctgccagggcgattctggtgatgccaagggacagggcactcccagaccgttcacttgttttcagaaaactttttattttgagacaattgtttgttagcatgcggttgtaaaaaataatacagagaggttctatgtagatatcctccagcttcccccaatggtaccgtcttacataactgtagtacagtgccaaagccagcagttgacatttgtcacaaaccatcaaccttacctttccccagttttacacacactcattcgagtgtgtgtgtctgtgtgtgtgtttcgttcaatgcagttttattgtatgcgtagatttgtgtaaccaccagtcaagacacaacagtcccatcacaagaacatctcattctacccttttctaactgtatccacccccttacccatgaaaccactaatctcttctccatttctataatattgttattttaagcatgttatagaaatggagtcatacactatctagccttttgaaattggcttttttcacttaacgtaattctctgaagatgtctccacgttgctgtaggtgtcagtagttcattccttcttgttgctgcgtagtgttccaaggtatgaatgcaccatggttagtttaaccattcacctgttgagggacatctggattgcttccagttttttttgtttgtttgtttgtttttgctatgaaaagtaaagctgccgtgaacactcatgcacaggtttttgtgtgaacattaagtcttcatttctctgggataaatgcccaggagtgcaattgctgggtcggatgggagttgcagatttagtttttgaaagacccttcagtttccattcacatccatgccctcctctggtctctggctttggtggaaagatgcgagtgctggggaatggacattttgcagagattccttcctctttcacatgttaatcgagggccacttcttgtgtcaggtgtggtgttagccctcacggatacagcgccagggtaaataagggtcatcgaggcgctttcttgctggtgaggtgcacttgacaatgaacaagcaagcacttagaaagaagatggtttctcatagcagccaacacgtactcagtgcttcctacacaccaggtgctttctgggttctttacgatcctcaaacaacccaatgagacggggccatagttcactccatggtacagacaaggaagtggagacacacagctgctcccacagccagaataatccatgctcctgaccatactctgcactgcccctcgtgaccaagacaggccaccaggcgatgcagagtaagagaagaggtgagagcacatgtgggatgacagacccagggcaagtcttcccacagacaaaactgcatgtgcaaaggccttggggtgggagcaggcgaaaggccaggctggctggcgcatggtgagcgaggaaggagatgggaagtgcagtggtgaggtggggtgggcctcgcagggttttaacctgagcatagtgtgggaagtcagagacttgattttttttaaagattgttccggctgcagggtggagaatagacggggggtgtgtttgcaagagaggaagtagggagacaaggaggccacgtggagaaaccttctgctcttgagggatgaacgccaaggttctctctcctcctcctttggccacagggtctctgtgtgggtgctcagcagtgcaaggaggcctctcgtcatggggggtccagctcccagtggctctcccacagctccgcccctcgagggcaggagagctgatccccagccagtcggccccttgagcctctgcagctggaccgtgagctcccatctaggtctgtcttctgatggatgtttctggtttcttgagttttctcaccatttctctttcttcctcttttcgtaccagttgtgattctataaattgaatttacctgctcagtatcagtcactccagatcgttaataaacgtgcgcctgacatccttgacgcattcaccatgcttgcccggtcagcatgcatgctttgccatgtcatgatgcctgctttgccatgtcatgatgatcaccatttattatgcacttgctgtgtaccagctagcgttccgagagctagtacctatgtccctgttgagttcacccttaagcagtcctgtgaggcaggtactgttgttgattcgtgccttactgtgaagaagctgaggcaaggggccaggtcaccacagacaccacacatacagcaggtggctgcatctggattcgaatccagagccaggctccctgccttccacagctttgctgtgtccccatctcgacgctcagagaaaagacacctccggaagcttcccctgctgccttcgcagaacagttggtcagaacctcgtcttcccagaatttgggattttctgcttctggaagatgctgcttcgaaaggaagtgatagcaagggctggaatagcctcgcctgtggggcggggacagggagaggcggctgatgtctgggaggcttagaacttccttcttggaatctgtttttcacgttgcctgaaaaagaaagaggaagagactcatacagatggagacacagggaaagactcaacggatttagaccccagacagtcacacaccggagacagacagacagacagatgccccagaggaaaggacacacccccaaacaatcaaaggtgggaggcagacacacagacacccttggacacgtttgctgccctggagccccctctctagcgaggtcgcccttcccatctgagctccttccctcctcaagctgccgctgggcccggcaatccattcaggggccgactgtcagtgtggccagcagcatttcctagaccctcctcccccaaaccggaaaacactcgtagcaaggaatgccccgcctgtgggccaggggtcttcctgggcctctgagccccacatgaaggtgatgagccaagcgccaggctagggtcagcaagttggcatggttggggggcacgtgggtcatgatggcagtgaccttccagctcagtcgggctcctgacggactcaggccttgccttttgctgcttccaagaggtcggaggaggtgaaggcatggctgccggtggaggggtcggggctgctggaggctgcttttcggggtgggtactttgttttgagtttgttgtccactcttgtgactagtgagaacagatatcacagcaccgggctctgtgtcccaggcacagggaaagtctggcccttgccacctgaacttctgtgacttttctgggcgggacgggtggagggtgggcggtgacattgttgcacctctccgagcctcagattccttatcccaaaaatgggatgataataagacaagcgtacttcctgggaagctgctgagaaaattaaatgagatgacagaaacccctccatatggggcatgaaacacagcaggagctcactgtacctactgcacgttcactgtggtcagaacggctttagaagattccaagctattcctcgtatgtccacattcatctgtccagatataagtccagcctgatttctggggtacaggatcaaattgctgtgctccagagaggacagatcacagtagaatttgcgtgccctcgctcctgaggcctggcctcaatcatcgtgaattctcagtgctcatgcagggcctggcatacagcaggggcacgataaatatatgcgctgccgcagtgagggaataggaagggaaagggcctgaggatagatttagatgacagaagaaaatgtctttcatggaaaataaaataagacatccccctgggcgtccctgcatggagacagagggcaggttgctaatattctgtcccaaaggggtgtagctgggattctgcaagtccatcatccagggcaggggtcctgcctcctcaccttgcagctcatttccctctgttcagccccctctgtctgtctaaacaaggtgtattattctgctcaggccgctgtaataaaataaccccggactgtgtggcttagacagtagacatttgttttcctgcagttctggaggttgggaagtccaagatcaaggggccagcaagtttgggttctggtgagaactgctttgtggcttgtagatggccacctcctggctgcgtcctcacatggccgttccttggtgccagcacatggaaggaggggggagagaatgagctctatgctgtctcttcttatcaggtcactaatcctgttggatcaggcccccacctttatgacctcttttaaccttaattacttccctagaggctccgtctttacatgcagccacaccaggggtcagggcttcaacatatgttggaggggcacagaggtctataacacgaggtcctttgctttctgctccaaacagagggtttgggaagggaggtgggaatggccacctctataatgttactattagcaacaacccaatagtggccaccacttgtcaggctttgggagaggcatttactatggaactcccatgttggttgcatgagtgaggccccatttgctcttggggtctgaaggtgggaaaacaagcccagagaggggagggtagcactcaggtggcaggtagcagggtccggactagggtgcaggtgtgtgccacatccaggttcacaccgtgagcctctgtactgctctggaggtagtagcttggctgatcatgtgttgactggctgtgggtctctttgctggctgtggaccaggtgccagggacactggtaaagggacactcatgatgggacactcttttccttgtagctgggagtcccacgtggtggtggcctgtgcttgacaccacagtagttactactactatgcaggatgtggcagttctcaggcgaccagccctgggctttgagggttaaagaggagtctaccagttagagactggactcctgcatgccgggctcatgccggctttgaggaggctgcaggacgaggcgattgcatctgacagagtggccacaccaacgatggcagcaagacatagaccgaggaaaggctaagtcatgacttagacattttcttagaagtcatagcagatgtcttgggtggtatttacaaaattaaccaccacatgggagagtttaaaactgccagagacagccagagaaggaagtggctgcaggggctgggccattggaaatggggtagacgcaggccaccgagaatgggcagcaggaggagggcaggcaccccaggcaggtgggccagcccgggcaaaggtgtggccccaagaaggcaggccttctgctcccagtgcggccagggtgctggcggccaagaggcttggaccacagtcaggggcaattggtgatgaagtcggggcgggggcccaggagaaccggcatgttgggcccagggagcagccctcttactggcggctgatacttactgcgcacctaagtatgcaccaggtgccgttcattgtactttatggctcttcactccactgcatccacacagcaacccgtgcgtgggtgctagtggtattccgcttttccagatgtggaaaccgaggcacagagagtgaacgaatcacttcctgatgccctgtgtttggccatggggagagctgggggttggatccaggcaggacagcgccaggattccttttaaccgctaagctactccgctgagtgtttactgaattggattcgactcctgggagcccgatggtgcaaggggcctgcccagaccctcactgcttcctccagcctctctgacgcctgaccttgcccatctgcccacctccctgcctctgccccaggggagaccgagaatagctgggcccctcttgctcccgaaagacagagccaccccgggttagcggcgagacccctccagacggtgcccgtcgccgactgaccctcagaggctctccagcacgcggcgggcatcaatgaggccccggggattgaatgaggcactattgagaagcggctaaataccagccgcattgtgcttcctgatccagggcttcgctttttgtccaagagccttggaaacggagccccggttcacttcccctcccctgggcgccgcccgccatcctggctcatgtcaggaaacaccaggctcttgaaaatcagtaattgagagaaacatctgctggttaccaaggagcacgaggtgcttgccgagtggcgagggcatacgtgcgtcactgtcggccggttggaaacacacatgtgagtgcatgcaggcacacacgtgcgcgtgcgagagtctttctggtatgttattaagatttaaaaaattagaagtgttatgcctgttataaaaatgcaaacaatttacgaatacaaaaaagtaaaagggatagccccttcatctagaagaagtcatcatgaacaatttaattttttatcctcatttttgctataaaaatggatccatattttatttaccattccagtttcattatttctgccccacaataattgccagcatccatccattatcagactgaattggattcaattcctgggagccagacagtggaccagcagttcttagccaggggtgacttgccccacagggggcgtttggcaatccctggagacatttttgagtgtcgcaatggggattgatggtgcttctagcctctagtgggtagagcccaggttgctgctgaacaccctgctgcttaggacggccccacaatagagatgatccagctccaagctcagtttcccctgctcagagctcagcgtagatttatgtcatcagttttaatggcctcatcccataatgtgatgtaccaaggtgtgtttggtggcatttagatggtctctggttgatcatttgaaaaacaccccatgcaatatatatatatgaacagggatatatatgtgtgtgtatatacatatttgttttgtgtatatctatatatacgttttgggcccttctgtgaatttttccactggatatgattctggaagttgaacttgcagggttgaaaggtgaagtgcttgtgtaatgttgacaggcactgctcaatatcctccaagaagactgtggccgtcaacaccaccacggactcactcacccacgcccacccgttccccatttgtcgtccactctcctcaattaacaaacacatttggtttattttaaataactttcggatgttatgcacctccgacatgtccactgactgctcgctcactgtgagttcactccgttctgccaataattcaaacggtgactgatattttgctgacagtggatgtttaaaggtgttcgatgtcagtgacaatagaaacaaaaatcccattagttctttccatttggataatagcaagaaggataaaaggcacagctttgtcttttctcattggaggagtattctaaaatcatcaggttctaaaatgattctagagaccgtttactttcctgttccctgaatgcactttcagacgcagggctcacccacggccgcgctgcatcctcctccaggtccacctcctgtgtgatgactcgggacactggttgggggttgggggggcggtggggaagaacgtgtttctctgtgttgctcaggaactcccaaagcttcggaaatgaatggggttctgcacagttctctctgggtggtataaaaaggcagcccgcccctaacctgagtgggcctttgcaaactagaacagggtaccagtgaaaagagaagcacacagaggccaggtatgtgccgttcattgatctctgaaatcccttgggtctgtgctggctggggacggaatacaacgcggagtcaggcacacccagcctgacaggctcagaccatagggcagggggccaagtgggagttagtgtgggagcctggaaggggaagaccaaggccgacggggcattgcaggtgtgcatgcgacctgagggtggaggcttgtcaggcgtgtcagccttgatcctggcacctaggagggagggaggttggaaggagggaggaaagattgtggtgagtcagccaggtgaagaaaaggtggaagtggtctctagacagcgggcatgagtgtggatcctggggcttgaggccgggtggtgagacagcacactcagaaccatcatctgccagcccattagctgtgctgcaccacggaggcctagagaagacaccttcctccctggagtggcccagtgaaggagagacagtggaccggtgggtgccacagggcagcctgcatgcctggctccatgtactaccccccccaccccacccctacctccaggccaggagagggaaggcccaggaagcgagatgtctggtgcctggatgccaccttggggccctcagccagggcacgtggaggggtggtcaggtgcccctccctgccccacccattcccagtgcagtatctgtgctcctagggtcaggcagagactgtccggccttcccaccctaattccgagcccctcccgcagcagcccttgtcagcccagggtgacagcacctccgcagagaccacctgggaagcctcgttatgggagcagctgtctgttttggatactgacagatgcttctcaaatcttttttttttccctcttttactataaatataattatatgtgctccaaaatgctgagattgcagaaatgtattacacggaagggatgtcccctggtgtctgtggtccctcctcgagggacccacagctggcagtttcatgcatgccctgctggtccctggtctgtgcagacgtggacagtcactcataaatataggtgtgtatcagaaggtttcacctgtatttttaaaaacatatttgttgttcttttctaacccagtttgggctcatcccgtgaggatacagactgaccggtggctgtgcttcccagggtggtgtcatccctgccagggacatttcagtggttcccagttgattgtgaccttttgtgcaaacctgcagggggccttcttgcacactcatctgtgtacaccagaataaatgagcttcagttgggtgcggtggctcacgcctgtaatcccagcacttttggaggccgaggtgggtggatcccttgaggtcaggagttcgagaccagcctgtccaacatggtgaaaccccgtctgtactcaaaatacaaaaattagctgggcgtgctggcgggtgcctgtagtcccagctacttgggaggctgaggcacaagaattgcctgaccaggaggtggaggttgcagtgagtcaagattgcaccactgcactccagcctgggcgacagagtgagactctgtctcaaaaataaataaataaataaataaataaataaataaatgtgcttttttattcagtgtagtcattacgtgcctgccttggggaaggcaccattctaggtgctgaggacaccatggagaatgagttcgctctgagccactgatattccagaggggagaggcagagagtgcagtgttgggtgggtcatatacagcttccagatcagggctgcagagatcagtaaagcaggcacagggatgggggtcctggaggctggagggcagagggctgttttagtctgaggcagggacctgggggccgggatcaaggcaatgaagggagcaagccatgaagatattgaggaaaaatcattccaggcaggaagaatggcacgtgccagggtcctgaggtgggtcatgcatggtgcttttatagaacagaaaacaagtggctggaacagagcacatgggggaggagcccaggggaactggaaatgggtgatcagcacccagctgtctatatgctggagcaaaggttcacacctgaaaatatccagagtttgctgtttcactctgcagaggtgctccagcctacactgcacataagtgatggcgctggaccggggcctgcttaagggaaccttctccacccactgtgagtttggatgcctgcagctcatgtcttgtggggacaggggacaggcgtaggaggagcctagcccagagcttggagttcttgactcaagaggttccatccgggaagttaactttcgtagttcttgctacaaccttgtgtacaggggacttagttatctctccgttttcttctcagatgagggtaccaggagatttactgaaggtcacagcaaatggcaatgcgaggacttgagcccaggaccactgggtgctagctgcatgctgttaacctctatcccaagattctaccaagaacagcagggcagggagccagcgcaggccctgatgtgggccccagtccccaccctggctgaccacgtgacttgtcccctctcagcgtccctccccaacatgggacagtgtcccaggttcacctgtccgggtgccaggtgctcagccgtgtgcttgccacaaagcaagcactctgaaagcagtacagtctggttttaaaaacgagaaaaccggcctagatttgccgcccgccccccaaacctcaagaggaagacagagcaaatttttttacccataaaaggtcttaccctaagaaatagacatgccgtcgggggtgtttgaaatggcaccaggagtgatcagaaagttattcctttgacggctggtttgattgtacttaaaattcggggggctggggtggggtggcagggagctgggttcctattcaaatgtagtgggggtaggtaggggagagggcagtaaatgaagtggctggaaccccagggccgctggggctctgcagaatgacaatgaggccccgccaggcgggtctcatccaggcaggcctaacaagattagattttcataaatttcagacagcgccaattcctaattcctcggtgtgcggccaggaggccagacagggccccatgcactggctgcttgttaaccaggaaggacgccagctgcccctcccctgggacagactgttggggtggcggtggaggggggtcgtctggtctggaaacctccatggggccggcaggagccgggtggactctgctcccagctccccagctgaagagagagaaatgagccccagcaccccattgttgcccccgttatttctgagaaactcagtcgccgccgcacctccccgcctagtgcccccgtgggctgggtgggttcttcttgcacattaacaaattttccagcgaccctctccccgtttacagccatgaaacgtcccaacagggatctgaaccctgaggcccctgctctgccctcagttcaggtccaggctctgcccccaagaacagaggtccagaaacttggatgggaaagaatagtgtctttgccttacctgagctctaactgaaaggtggggtccccttggatcccaaatgcaggcacctgaccatcgtctccttgactgcaccaaagacacagctggaggtgggagccaccatcttcactccacaggcccatgtcccgtacaggccttccagctctggacgctgtgggtgtccactgcgaggtcatttaatgcaattatatttctgtatcgcacacgtgccatcgtgtgtatcattcccgtgtcacaaatctgcttcggagtttggaaactatttccaggcccgtcccctcgcctgtgattggggcaatgctgcccctcggggcttgtcatgaaaaactcagagacagggtgaagtctttcgtggtgaggggcttggcacacaggaagaggcagaggagagggcagctgtcagcgtctgtgttatgccatggcaggtgcccataactcctggcacccgcttccttcctcaccgtccggattttgctctgcgctggctcagaggtgggtaccacaggccatgaataccagcttcatggactgcgttgggggcgacacgccaggcacttgttactgaccccaagatcagtcacattcaacacaagcccttggctcaatctcccgctgtttctggcattttgggataatcacactcaggactgctgggggtcgggcaaacggtcaggctttggggtcagaggaactcatttctgagccttggactgtgcggtctttggcggtcgcctcacctctcccagcctcagtctcctcatctgcaaagtgggggtcccataagtacggacctcacagaatgacggtgagaattcaatcagatgatgtgcataaagggttcggcccccctgcatggcatctagggagtggcctgctcacggttcctctcctgccagtgtaggacaaacaggacagggcagagctgtgcccgcacctcccagagggactgtgcctgtctctggaggagaccatgaaaaggaggatggggcctctccaacgaggcacacgaacctgttaatgtgaaattattcacaaggaaagaggacactaaattaaattagagtgaccttattttgtgtttggaagatgggcttggtcacccccgagagcctgctgcattcatcaccctccccaagggaaaaattacgaagaaaaatggcaggagcccccgggccctccaagtgatgagcacagccttgatgcccagaatgaaatgagagcgagatgtttctccttcccagcggcttgtgttgccacggcgggcccttgggggagagaaaggtgcctccccgcaagggcctcagagtcaagttcaaaacatgatgtgtgtatgaagcggcaccaatataaacatgggatccagcgcatgttagcccctgaggggccttgggtccagccaccatcctgggtgacctttgggactgacttgagctcaaatctcccaccttggggacagaagccagtcagggaacacctggctaagcaggcttgtactctgcagcccagcaaacctcagcatttccagggaccatcaggggaacgagggatgctttttgtccccagaggagtgtcagtaattgtgacaatggtgacagttgagtgtgctacgttctgtcccgttctgagctctcgcatccattatttcacccctgccccggttggttcttttttttttttttttttgacagatgaggtaacttcctctcaaggaggtagatgcgcacagcatcacacagacaatggatgcacgaggactggaccagaacatcagaaccacatcctcagattcccggggcagggggcgggcggactaacgccgtgggcgagctaggaaaatttagcaggagaatgaaacccttcccccttttgagttcctatatggcggctctgggctcaagtctcaaccttgctcctagttgcatcttctagggctacttctccctaagcctcagtttcttcatctgcaaaatgggcatggtgatgttacctaaattggggaggctcagctcagtggccccgggtcatgtgttagaatcatgacaatacttacagtgactacagtgagtttgggtgtgccctctcctgctctgtcccctgtggcctatgactgcttggcaatgtgtcctgtggtcacagcagagttgagcctaggtcagggacagtggtaggacccacccctgcaggtgtcatactgggcatttgatctgggatgtctttgtccatgccttggtaaaggggcagtctgtcagattagggaaactgaggcaggattggtgtggctccatatctgccagtagtcactaagtgacctggggcccaactcttggccagaagtcctgaagccgcctgccctgcagatgccttgggtgtggcctgcttggcccttttaaaactcttaaatgaggttccagccttaaaggaccacagcttcacagccggctccagggtcctctggagagagggagggatgcggccgcgctgggccttctctccttccgcctcgcgttggcagtcctgctggggttccttcccttgcccgcgaggcatctgatcctgagagtccggctctcaagctgcgactgggaatgggccccagcagcctccctgcgctcctcggaacaaatgcaggcacgaagaggattctgcgagctgccgcgggtggagagccgtgtttatattggtgccgcttcatacacacatcatgttttgaacttgactccaaggcctttgcggggaggcacctttctctcccccaaggggtctttgctggtggattcacggtgcctgcccagagggatgtgtgggacttagtgtggggagggagcccatgcttgatgaactcggcctgagtgggccctgatcagtgcgtcgtagaggcccgcatgctgagtctcaggcatccctggggtggtgtggggtggggaccgacagtgtcagggcgtggctgtcccaggccaggtgagtcccgggaccaggcctgtggagagggtggctgcccacagccctgctcccgtgatgccaggtgggaacacggctggggccagggacggtcggtgcgcgtgcccttgggtctctggtttgcgaccgacctcgccagcaggcactgcatggtccactccccagagaatgcattcctgtcccctaaagctgagcgtctcctggaagcagcaccatgggtgtgaaagtgcgtggaaggtgcctcctcaccccatgcccaagggtggtcttcgttggacctgtttgtgggccccaatgctgctgtgcctgaccagccttcctcccgcacagcatccgcgccggtggggcttgactggagctggatggagatttcggggcctccttggcccagggtgttgccttcctgatgggtgggggtgacccggctgctggctggagcacctctcttgcccccctcaacacctccaggtctgggcatgtccaggggcatccaggagggtctgggttccggcctctgctcacctataccctctgcctgtgctccactctgccccgcactccgtgccctgcaccaaaagcctcagtgcccaccttacagggagccctccagggtcttccattagatgctccctctgcgattccagagcaggtcatgtctctttgagggtggatgggtttgggccacccttgttctggtggagccaggatggaattgagcatcccgtgtctgggtccacctccagggagcactacatgctgagcacatgtcccccgcacatcctgctgcccactgtccccctgctgcccaccgtccccccgctgacacagggagactgcgatggactcagagagggcccccaagagccaggctgggacccgggccctctgagagagccactgtgcttccctgccaccaccctgctcctctccagggtgctcctgagccgtagtctcggcaacccttgcaaatctccatctccctaagcctggacccaggcccttggctcaccaagtctagccagcagtcagttgtagtttctcttttctagagagtttttctctctcctctcccatgtgaattttcctgggccagtgacccaatgggagttggtggcccagggaccagggtgacgctcttatgcgctactgagcccggtgctcatttctgggagcgtttttctcactctgtggatacagacgtccaaaagtcagatccccctgcccctggggccgagcctggcggggccaggagagccgtgagggtttgtccacacccattcagtctgcaggggcctcctccattgcccctgcatcccaccggccctgcagccccagctaccgtctcactgctgtctgggtcctgcgggctgccagggcccgggacagggacaaaaacagccacacacctccctccctccagggctgatgtgggctgggcccctggagacagctggggaagggggaactggggtgaagagtgcacagggttggggggcagggaattgcaggccccgggggtgggggggcgtgggtgttacacaaagccagccctgtgtgtaccctgaatgcggctttatcctgagtgctaacagacggacctgggccctacagaatcaggccaggctgccccggccctggacctgcctgtctggggagacaggaggtgtggccacagcgacctgggtctgaagcctgatctctcctggccaggaacatgcgggtgtcccacaggcggcccagggcttggggcctgagttcccagcaggcagggccgaagccttctcggggcttgggaaagccccaccaagcctagtgggaggacgcgccagctctagggtcttggacttctcgaggcaatcacttttccctctgagcccgtgtctcctcacccgtgaaatggggatgataataaaaacgcccgttcttaggtgtgctcagcccacagcatgaccgactggattggatcattctttgtcatgggggacagtcctgtcggtgcaggacggttaccacagcccctggcctccacccactccatgccaggagtaccccccagttgtgacaaccaaaaatggctccagacatcgccacatgttccctgggtgcagacgtggccccagctgagaaacactggctcattagcagtgtagacaatggcgcgctgagccctgggtgcagatgcggccccagctgagaaacacgggctcagtagcagtgtagacagtggcacgctgagccctgggtgcagacgcggccccagctgagaaacactggctcagtagcagtgtagacaatggcgcgctgagggtggcacagatgcataaagtgcccgagacggggaagttctggaaaacctgttggggaagaaggagtggcagtggacacaggtgtgggagtgcttctgtgtggagaggcgtctgccacttcacagacagtgacattcccacctaggatgggctgctttcctgccttggggagagcgaggctggtggcaggagatggctgggccccccgggtttggagtgtgcttgcctgggctgtctgatggcccgagcgcctggcatcggctctgcacggcctgttttttctccagttgccacctgacacctgcccaccccgatccccctcccccggctttggttcctcggtcctgggaggaggaggaactgagtcagtggcactgggcttgaactggggcccccagggagcctggctaattgcttgttagtgccagggagccctggggagtcctccttgcccccatgccagccggggtctggggagtcacattcctgcacaccttgggcagggtgtcctgggcagggcgaagctggaggagctttggccccggacgctgccggctggtgcccactctgccgtgtcaactccaagggacccggcgtcttgcccattgctgggggctctgctggcaccgtgctcggccagctgccgaggccgcttcggcacagacccgcttgagtcagcagaaactgcccggctcaggcaggatcaaaataaccttcttcctattccagcacttgagggtttttccgccttctaggggaaaaacaaatcaaaaaccaaaaaagaaaaaacaaaaaaacccaaccttagaaaatgcgaatggcaacatccgcagccatctggaatgtgggttttctgaggccttttcaccaagaggagggtcctgacacccccgtcctgttgagcgtggcgtgtgtttgtgagtcctgggatggatgtgtgtgtgtgggcacgtgtggtgcgctgtgtctgtgtgtgtttgtgtctgttgggaagtgtgtgttgggatgttgacttgggtgtgggactgttgaggggtgtgtgttggggtgttgatatgtgtgtaggagtgttgggtcgtgtgttggtgttgacgtgtgtgtaggagtgttggagtatgtagtgttgttgacgtgtgtgtaggagtgttggggtgttgtgtgtggaggagtgttggggtgttgtgtgtgtaggagtgttaggggtacgtgttggggtgttatttgtgtaggagtgttgggtcatgtgttggtgttgatgtgtgtgtaggagtgttggagtatgtagtgttggggtgttgtgtgtgtaggagtgttaggggtacgtgttggggtgttatttgtgtaggagtgttgggtcatgtgttggtgttgacgtgtgtgtaggagtgttggagtatgtagcgttgttgacgtgtgtgtaggagtgttggggtgttgtgtgtgtaggagtgttggggtgttttgtgtgtaggagtgttaggggtacgtgttggggtgttatttgtgtaggagtgttgggtgtgtgttggtgttgacgtgtacttaggagcgttgtgtgtgtaggagtgttggggcatttgtgttggtgttgtgtgtgtaggagtgttggtgtgttgacatatgtgtaggagtgtcaggtgtgcataggtttgtgtacacacgttcacatgtagctcctctttgtttaattccacaaagcttcactcccaaactcagtgccaacttcctctctccgcactcaggggtccccttctcctcccaactgctccctccctgggcccctaagaagggtctgtgaccgtctgcccgagcctttgcccagcgacaggagccagtgcgcagggctccctttctgccagtcagctcacgctgtgcatctgcagaacggctccaggaggctctgagagcagagagcagggccttcctcctgcctgtcccgttacctccttccggtcagtccctacagagggggtgtctgggtcccaggacacctttgaggtgctctcccagccagcagtaccccctcctccgccgtgagagcagcttccctgcacgtaccccagccccaggcatcgcctgtgaccttgccgggagagtggcgggggctttcctgagtctgggttgcactctcgtccccctaggtgggtgaaaaagctcaaaagggctgagccctgagcacagcgacctgcaggtgtccagggtctcacgtgtccctctttgtctccacagcggagctggagtttgttcagatcatcatcatcgtggtggtgatgatggtgatggtggtggtgatcacgtgcctgctgagccactacaagctgtctgcacggtccttcatcagccggcacagccaggggcggaggagagaagatgccctgtcctcagtaagtgccccgccatcccatctgtggcctgagggtgcggcagtgggacgccccttgtaaaaactcagacgggatccaatggcagcgtttgcaggaaacagattcagggcaggaagacaggggctggggagcccacctgacagcagcttcctcccctgaaatgggaggaaagcacccgccaggcgggcctcagagatgctggaggaacgtggggaatgaagagctgggctgggaagaggcttcgtgatccactcacgcactcagctgactctcgagcagcctcgggtcgcaggctctgtgcagggcctggggagagggcagcacacaggtccttgctgtcatggagctgacgttccaggagggagatgagacgcccagtggtgatagcgccatgcaggagatgcgaccactgggacctgggggagcctctgcgaggaaccctcggctagggaggcagggctgggctcacaagcagcgcaagctgacccccgtcttgacccacatctctcgaggctgagtggagacagacctagagagatgaggctgaaagcagggaggcacctggggcaggcagcacaggaaggcattctgggtccacacagaggcctgacacaacaggatggtggagacgaggggccggcatttggctcttacccaccggggtagtggtgggaaaggtgcctgcagtcctgcagccctgacccagacggaagggaggtggcggccctgccctcgtgcccgtgctatgctgacatctggtcatgtggtcacaatgccttggagagccatagaggcaacaggacaccaggtcccggggcctaagtttaatcccatctccaccagtactggccacgtgccctcagacctgtccctgatctacaaaatggggcttcagatcccccatttgtaaaatgggctgacagtcacatccacctccccagagattcagggctttagcacagagcacgggtctggtcattactggctataaaagcacttccatccatccatccatccacctgacagatctctacccagcacacacacggggtatgcaaaattccccctgcgtttgggaagtggctgtgagccagtcccagggggtgctgctggtgagttggatgggcgcagacaggagcaggtgcacggatgaaggaagccgagggccgtggccaggaagttggggcgagctgctcttgaggccgtgctgtgcaggaccaggtgaagtgggcgcgggagtgtgaggaggacagagccctgcaggagggaccccgctctccattacagtcctgggtgttgatctctcagagttgtgagcattggtgggtgttctggaaaccccaagaatttccctttcgaatctccacaaagtcaggggcaaacagggcagatctgggtcggtgggaacttgcccgcctctgacggtgaactcccggctccatgtcggccgcctgaagcccggctgttcggtatccttcagcaggtggaccaaagggcggcacagagttaatctcttaatggcttccatctctgcacccaggatgtgtaactcaaccacgtggggcaggaagcggctgtttaaagagcaggctgggaactgtggggaggaggtggcacgtggccagccctggggctgcggcacgtctctgagccggggctcaccaggtgtggggaggactcacagaacaggcagcactgagtgtggcctccccacttctggggacgcctggggttggtggtggcgcccagagtccctgggctgagccaagtcagctgagaagcctgttggccacagtccctagccggaaggcctgtccctggcaggtctggacacctctgcttgcatcaggccccagcctcagtgcgtcaccaggttgccagggcaaggagcatcagccctgggacctctgatgggaatgcctggcccacagacccggggcccactgtgcgtcccagcacgctgtccggagggcgtgctgcagacctgctgctctcaagccccgacgtgtttatttgctgttgctaccactccagcaacaagcactggttacgtctgcccagggatgccatcagggacttcaggggttcaccccactttccagaggagaaactggggatgagagaggtggaacatttgccggaggccacactgcttgtcactgccggtgtgaagagcccacagcctattccgtcctccctcaagtgctggggagagtgacggtgcctggacattccagaaggcaccagccctggaggggcactaactccaggctggactcaccttgcccctcggagcctcagtgtgtgcatctccacagtgggttgaagctaggcctgtgcggcccgtggtcatggggaggatgcagttagtggagagtgtaccgtacccagaggccgactgcaggggcttcactgttgtggagcaggagacggcacctgggatcctgctgccaggaaggggtaggattccgtcacaccttcggccaatagaaagtctcctcccactgtctacccagccgcctgcacagccgcccgggatgcctggctgggtaaacgtggagcctcactaggcctaaagcagaatgtggcagctcccctggggaccccctgccagacaggagtccctgggccccgcggccttccatagagatccacatacagctcttatctgtcccgggcccagtctacatccccccagcccatccatgctctgcccctggcatggctatccgaccatggccccttttcagggtgaccctgggggtcccctcttgcctgtatggagacaagagctcgtgcctcacccacctgcctcaccatctcaggtaagaccctgagctctgaggtcttttctcggccttgtcacctccttgttgtgtgacactgggcaaggatctgccctctgagggtgaggctccagtgcaggcaagcccctcgaccagggatggcacttccaccctggcgctgctccgagggtattcgggacatgatgcagaacgtcactgcagtgaccgcccagccacggagtggcgcagacttcaggtttacccagaaaggcaatcccagtctttgtgcccaaggcctgctcagactaggaactcaggccttggatggggtgaccctttgtcctctttatcccccaatcagtcctcagtgtgggtctcctgctcccgagagaacccagcccaccaagggcccatttcccaggggcagggacaagactgtggccaggccaatgtgcgacaatctgccagcagcgggagccaaagacctagcgtccactcccatggcctcaggagataccgaattcccccaggccccttgtgctgggctgtgggggaattcagtatctcctgaggacatgggaggtaccgaattttttaggaacatctctttattctttagaaacatctctgagtcctcgaagtttgatagaaggccatcccgtccccttggatgttcctggggactccaggggaagaatgggcagctacgttctggcctcgtggtgttaagactctggaggggtctgggaggagctgcctgagcgtcagctcactgcggctgcctggttttgtcaatgaggtcttttctgagtgtgaatgaagtgttttcgagtgcgttttgcccatagctgcgcttggctgtagcagcagggttcagtggtatgacagagacccgccggcccacaaaccagaaaatattttactctctggctctttatggaaacagttttcagacccttggtctagaagcatctaaatggggaaggcgcaggtggactgggtgcgcccacttcaaagaagaggagtccaccccgagccctgggagtctgggagtggttggaggctgctgggagcagggggctcgtcagcagtggctgtaggattggaacctgtccttgtcctccacctggggtgactggcagacatagccagaggctggggaaggttccagacaattctgaagctgggcccacctcccccgacttctcaagccactttggaacctaattccacaaagatgacttgcacgggtcacccagcaacttccgcacttaagtagcaacctgagcactccctgactgcatagcacgccggcgcctggcactggggaaacggtagcagctcctgcagggcgagtgagacccctgaataggccaccgggggcagagggacaaaggctgtggtgcaggaggggactggaggagatgggaggaggtgcctgacccgcctggggggctaacggagagctctggggttagcacacctgggcagaggcttgaggggccagtcaaagttcttcaggaaagggaggaaagaggggccattggtccagacccaggatgggctcagatccaaaggcaagacgtgagagtctgtgttcactgggcaccttgcagaacacactgtatggtgcattgcaggcgctgtcatcagcccgctatacagataggaaaacccgttaaaggaaacagctatactacggccgtggacatctagggggtatgggcctcggtaaggggttggaactttctctcctggaggcagcggggggcccagacggtttaagcagaggagtggcagggtgtggggtggggggcatgagggagatgttcccacttctgtgaggaggaagggccctggggaagggcaagagtggaggagaccctgggagacccctcaaggacctcaaagaccagcggcactcgcagcctctgggagatggtgagacacgcaggctcgccagccctcctgctacagaatctgcatttttgcaggctgcagatggactgtctgcacatggaggccctggttccataggactttgctgtccactaggcacagatgctggggagagaggtggatagaactgtctaatagaaggagaagtgagaggggatcaagggtgggtggaacaagggtggtggggagaggagctgtcaggaatgatcctgtggatctggctttgcaacttgaagaatatcagagccattcgctaaatcaggagacgaggcagttaagacctccttaaggggtaggagcggtcctgacgggacagttttgaggggccacagagcctcctagtggccatatgggaaattaccaccctctggccgttcctacccaggctgcaggtgagcggtatcctacctgggaaccctcaaaaaacctgccccaagggaacgtttgaggtgatggacatactcattatcttgattgtggtgagaggttcttggtataaatatatgcccgaaccaaattgtatgctttgaatatgtccatttatttgcatatcagttatatttcaatgaagctataaaagtaacagacatccctttccccgggcccagggctcaccgtcatggcatttggggaaactcagaggaactggtcctggcatggggtctcattttcctcagagcagatggcataagcttcatgaagtggcagctgtgcccctgcacccagaccagagcttggcgccacagtggaaccacacacctcctttgccagaggctgaatcactgttttatggcagagcagccgccttgggcactttcctcaactctcctgtttttcacctgtgaactgggacatcagtaatgatgggctcactagatcaagggagagaaagactgtaaagaaataaatgcatagaagcaatgattaagttaggacaggtgctggaaagggaatcaacagatgacaaggttcacgggagaggcccttcagatgctggtctccaagggtctgcaggggacgctggaactgaaagtggacagcagcgggccgtgcagcctggcctgccgtgtaaaggacctggggctcgggctgagcttgttgaggccccagggggctggtcagcatggctggtgggagtgtggaggtgacacccagcacattcacatgctacctgagtgccacgtgggctccgggtggtttttacattcaaattcagcaagtgcttgagcaactatgaggcaagtactgtaatctcaagaactgtaattcaggtacagaaactgcagcgttgaaattaagtaacttgacgcaggtcacacagccagcagggggcccaggcccaggggagtggggccaggggtgaggggctgaggccatgttcagcctggtgagaagccactgaggcccacgggaagctacaggcagctttgagaagggggccccacaagtgggtgtatgttttggaaagtgtcaggctggattttcaggggacagcagagggcacctcagggatcagtgaggaggtgattgcgctcacgtcctggaaaagcgcccagggccaggggctggggaagctggttccgatgcagagaggtgggcgggttcaagagctgattccagggtaaaggcctaagagtcgaatctgggttgagcctttgctgtccctcctgcccaccccactgaccctgcttgtacgtttcttcctgtgcaggaaggatgcctgtggccctcggagagcacagtgtcaggcaacggaatcccagaggtgagacctccctcggcctcccctccaacacccccatcccaccctgggctgctcccgctgcggctggaacagtgtgggctgctaaaggctcacccctccgccctcctctgcagtgcccttgctgctgggatcctccttgccggagatcatctgctccctgcccctgagggagcagcccagctctctgctctctgcacacgggagcacggacgctgccactgtttggaggagggcggtgcagctctgcagtgctgccccccaggccagggcccccgcgggatcaggctctgggctcccgcccccgccagccctgctgccctctccctttccccagagagccaagtcccatgcagcagaactccagtctcaggatcgcttctggacaacccacctgagacagccgccctccctcactcccgctctgcttcctccagccgcaggtctacgccccgcctcggcccaccgaccgcctggccgtgccgcccttcgcccagcgggagcgcttccaccgcttccagcccacctatccgtacctgcagcacgagatcgacctgccacccaccatctcgctgtcagacggggaggagcccccaccctaccagggcccctgcaccctccagcttcgggaccccgagcagcagctggaactgaaccgggagtcggtgcgcgcacccccaaacagaaccatcttcgacagtgacctgatggatagtgccaggctgggcggcccctgcccccccagcagtaactcgggcatcagcgccacgtgctacggcagcggcgggcgcatggaggggccgccgcccacctacagcgaggtcatcggccactacccggggtcctccttccagcaccagcagagcagtgggccgccctccttgctggaggggacccggctccaccacacacacatcgcgcccctagagagcgcagccatctggagcaaagagaaggataaacagaaaggacaccctctctagggtccccaggggggccgggctggggctgcgtaggtgaaaaggcagaacactccgcgcttcttagaagaggagtgagaggaaggcggggggcgcagcaacgcatcgtgtggccctcccctcccacctccctgtgtataaatatttacatgtgatgtctggtctgaatgcacaagctaagagagcttgcaaaaaaaaaaagaaaaaagaaaaaaaaaaaccacgtttctttgttgagctgtgtcttgaaggcaaaagaaaaaaaatttctacagtagtctttcttgtttctagttgagctgcgtgcgtgaatgcttattttcttttgtttatgataatttcacttaactttaaagacatatttgcacaaaacctttgtttaaagatctgcaatattatatatataaatatatataagataagagaaactgtatgtgcgagggcaggagtatttttgtattagaagaggcctattaaaaaaaaaagttgttttctgaactagaagaggaaaaaaatggcaatttttgagtgccaagtcagaaagtgtgtattaccttgtaaagaaaaaaattacaaagcaggggtttagagttatttatataaatgttgagattttgcactattttttaatataaatatgtcagtgcttgcttgatggaaacttctcttgtgtctgttgagactttaagggagaaatgtcggaatttcagagtcgcctgacggcagagggtgagcccccgtggagtctgcagagaggccttggccaggagcggcgggctttcccgaggggccactgtccctgcagagtggatgcttctgcctagtgacaggttatcaccacgttatatattccctaccgaaggagacaccttttcccccctgacccagaacagcctttaaatcacaagcaaaataggaaagttaaccacggaggcaccgagttccaggtagtggttttgcctttcccaaaaatgaaaataaactgttaccgaaggaattagtttttcctcttcttttttccaactgtgaaggtccccgtggggtggagcatggtgcccctcacaagccgcagcggctggtgcccgggctaccagggacatgccagagggctcgatgacttgtctctgcagggcgctttggtggttgttcagctggctaaaggttcaccggtgaaggcaggtgcggtaactgccgcactggaccctaggaagccccaggtattcgcaatctgacctcctcctgtctgtttcccttcacggatcaattctcacttaagaggccaataaacaacccaacatgaaaaggtgacaagcctgggtttctcccaggataggtgaaagggttaaaatgagtaaagcagttgagcaaacaccaacccgagcttcgggcgcagaattcttcaccttctcttcccctttccatctcctttccccgcggaaacaacgcttcccttctggtgtgtctgttgatctgtgttttcatttacatctctcttagactccgctcttgttctccaggttttcaccagatagatttggggttggcgggacctgctggtgacgtgcaggtgaaggacaggaaggggcatgtgagcgtaaatagaggtgaccagaggagagcatgaggggtggggctttgggacccaccggggccagtggctggagcttgacgtctttcctccccatgggggtgggagggcccccagctggaagagcagactcccagctgctaccccctcccttcccatgggagtggctttccattttgggcagaatgctgactagtagactaacataaaagatataaaaggcaataactattgtttgtgagcaacttttttataacttccaaaacaaaaacctgagcacagttttgaagttctagccactcgagctcatgcatgtgaaacgtgtgctttacgaaggtggcagctgacagacgtgggctctgcatgccgccagcctagtagaaagttctcgttcattggcaacagcagaacctgcctctccgtgaagtcgtcagcctaaaatttgtttctctcttgaagaggattctttgaaaaggtcctgcagagaaatcagtacaggttatcccgaaaggtacaaggacgcacttgtaaagatgattaaaacgtatctttcctttatgtgacgcgtctctagtgccttactgaagaagcagtgacactcccgtcgctcggtgaggacgttcccggacagtgcctcactcacctgggactggtatcccctcccagggtccaccaagggctcctgcttttcagacaccccatcatcctcgcgcgtcctcaccctgtctctaccagggaggtgcctagcttggtgaggttactcctgctcctccaacctttttttgccaaggtttgtacacgactcccatctaggctgaaaacctagaagtggaccttgtgtgtgtgcatggtgtcagcccaaagccaggctgagacagtcctcatatcctcttgagccaaactgtttgggtctcgttgcttcatggtatggtctggatttgtgggaatggctttgcgtgagaaaggggaggagagtggttgctgccctcagccggcttgaggacagagcctgtccctctcatgacaactcagtgttgaagcccagtgtcctcagcttcatgtccagtggatggcagaagttcatggggtagtggcctctcaaaggctgggcgcatcccaagacagccagcaggttgtctctggaaacgaccagagttaagctctcggcttctctgctgagggtgcaccctttcctctagatggtagttgtcacgttatctttgaaaactcttggactgctcctgaggaggccctcttttccagtaggaagttagatgggggttctcagaagtggctgattggaaggggacaagcttcgtttcaggggtctgccgttccatcctggttcagagaaggccgagcgtggctttctctagccttgtcactgtctccctgcctgtcaatcaccacctttcctccagaggaggaaaattatctcccctgcaaagcccggttctacacagatttcacaaattgtgctaagaaccgtccgtgttctcagaaagcccagtgtttttgcaaagaatgaaaagggaccccatatgtagcaaaaatcagggctgggggagagccgggttcattccctgtcctcattggtcgtccctatgaattgtacgtttcagagaaattttttttcctatgtgcaacacgaagcttccagaaccataaaatatcccgtcgataaggaaagaaaatgtcgttgttgttgtttttctggaaactgcttgaaatcttgctgtactatagagctcagaaggacacagcccgtcctcccctgcctgcctgattccatggctgttgtgctgattccaatgctttcacgttggttcctggcgtgggaactgctctcctttgcagccccatttcccaagctctgttcaagttaaacttatgtaagctttccgtggcatgcggggcgcgcacccacgtccccgctgcgtaagactctgtatttggatgccaatccacaggcctgaagaaactgcttgttgtgtatcagtaatcattagtggcaatgatgacattctgaaaagctgcaatacttatacaataaattttacaattctttgg

SEQ ID NO: 38237 - DNA, 153241 bp, Homo sapiens
gaaagccgcagcctcagtcccgccgccgcccgctgcgtccgcccagcgccagctccgcgtcccgaccggcccgcggcagcctgcgccgcgccatggccacctccccgcagaagtcgccttctgtccccaagtctcccactcccaagtcgcccccgtcccgcaagaaagatgattccttcttggggaaactcggagggaccctggcccggaggaagaaagccaaggagggtgagtgcggccaggccggccgggcgggcggtaggagccgggggtgccgtaggggccgaggggccggggcactgggaccgggcgggagcgcgccgcgggtgcccggcgcggtggggcgcgcggcgatgcgtgcgcgcgcttcccgggtacgtcgggcaggagcgacgcgcaccccacactgagcccggggctcgcgggccatcgaggccaccccgcccgctcgcggtcgcccgggcgctgccctcctgggccggggaccaggccaacgcccccgccgggccgtgggcgggcgccgcttggcggccggaggcggcgggaccggagcccaggcggggccccagcccgcagacagtgcgatccagtaggccctgccccgccctctgcgcccgaaggctggcatttcccaagtttccgctgcagctttcctgggcgccgtcgctcttactcgttgccttcattggtccttaaaatcaggtcgtttcctggacctgctgacgtcctctggcagcggcgtcgtggctttggcctcttcgggatcttttgtccatcccgagggctgagaagggctctgttaatggagtaggtggacatcgagtgtttgttgaatgaatgagcgaaaaactggcaaacctagcgtgccctcggtgtaatacacaataaactcccaccaaaggagaaaacctgcgtgagacacaaacttcgtcatgggcctgctgtgaactcaggcattcagggctttcgtaaaaacctttgttttttccccaccagagtgaattgaggcgaccttattcttttttttttttttttttttcagggtagtttgcatgtaaaatatttttttttcccatgcacagattttgcgtcctggtttttggtttgaaaacgaggtggcagttctcaagaagcactgtggtgactggtgtgtagatagaagttgctgagttaaacatttttgttttaaacattttttagttgatgcatgatgtacatagttctggggcacatgtgataatgtaatacattcatataatttgtaaagatcaaattgcacaggaaaggggtcccagtccagaccccaagagagggttcttggatctcacgcaagaaagaattcagggtgagtccacacagtaaagtgaaagcaagtttattaagaaagtagaggaataaaagaatggccactccatagacagagcagcctggggctgctggttgcccatttttatggttatttcttgatggtatgctaaacaaggggtggattattcatgtctcctctttttagaccatatagggtaacttccggacgttgccgtggcatgtgtaaactgtcctggcgctgctgggagtgtatcagtgaggacgaccagaggtcactcttgtcgccattttggttttggtgggttttagccgacttctttactgcgacctgttttatcagcaaggtctttatgacctgtatcttgtgcccacatcctatctcatcctgtaagttagaatgccttaaccttctgggaatgcagcccagtaggtctcactcagccttgttttacctggccccattcaagatggagttgctctggttcacatgcctcggacaaaatcactgtacttgggatatccatcacgttaaagatttgtcttttctctatgctagaccactggaattctagatattttgaaatatacaagaggttattgtaaaatatagttagtttaccaatctaacactaggtcttcttatatcaaatggtatatttgtaaccattaatcaacttctcttcccccctaaaaaatgtttttaatagattgctccatgaattagaaataaccttttgaaagctgtgatgctgtgtgaaattttcatgtttgtaagtcatcttaaagtataaaaacatcttcagcgctgaggattatcagacttgatgaagaactagacttctattccctagattgaaacgagaagcagcaaaaacatacaaaagtttccccacattggttattttggtaacccatcgagtagtgtacagttggtggcaaatcatgaaaccctggcttgggaagctcttttctagaccatgtttctaacttcttccttgcagcattcctgacatagtctcatccagtttaagatggggcaactgagaaatattgaagctcatgacctaccaggataaccatctttacctactctgtagaaatttatctctctgtacctatcactgttggtagagccagagaatgagtctggggtggccttttattactaccttgctgaagtaggctatcctgctttctagagtcttctctccaccaggcccaacatcctctattcctcacagacataattttaaggacttttgcatcctgtctctttagtttcagacagggtccctgcaggaaaaagaaggccaatttagttgagattttgaaaataatttagtgaaagggctattgacagagctgtgggcagggttaagggaactaagaagggatgctgaggtccctaggggctagcaacaggaggaagctcttaatcactccgaggcctgagggacaagggaagcaaattggaacctattacaagctggggttatggacgaggggctgctggactggaactatagtcatagagggatgcagctactgtccgaaatatgcagacagagcaaggagagagtggcacaataaatgcacattctgcatgttctctgtcttcttgcccgtgcatcacctactggtgctgaacccagtgggaagccatcagagcaagggatctgcaatagataggggcagcgtccatagggcacagagcagtgcagagaatagatcacagtggggacggtggaaatggagaatacctagcagatcaacctgttaccagacccgctcgaagtgagctctccagaagtcaccatagtacagttgtagtgcaagccagccaccccagattaggactgtcatctcccttattctagcacagacacaatgttcttttaatgcagctaaggttgcctctaactattctgccagccacgtcgcactgtgatctctcattgagcttgctatcagcttactcaaagacatttttatatttgttgctcctaaatcacagccttccctatcttggatttactcagttgggtttttgaaaccaagtgtaagatcttattttcatccctgttatatttcactgtaaagtcctgattccttcattcagtctgtcaactaatccaggggctgtaaatggatgaatggaagaacacagaacgtcttctgaagggccagccaccacccagctccagctgcttgctgcggcatatggtatttctgcaagcccaggcaaagaaggcagtgggttggtttgaaatgactgtccttagtgagtatgtgctggatctcaatgatcagtgctgaagtgatggttagtaggtgtggggccccattaaccatcacttcagtaataataaggccggatcttgctctgcatcctggataagctcacagctttgtgctctgtagaatctgccttcttcaactttctctttggtgttcttgaacctctcattcttcattcctcaagatcactgccatcagtctgtccacagattatctcagtgctttggtgtagcattctccgaggcccaaggactcccattcattcatttggtacctgctatgtcccactgtaggacacaacaaatggaaagatataatacttgttagaatatagttgacccttgaactatgtgggggttatggacattgaccccctgtacagtcaaaaatctgtgtatagtttttaactccccacaaacttaactgctaatagcctaccgttgaccagaagccttactgataatggtcaatcaacacatattttgtattgtatactgtatacttaacaataaacaaactggagaaaagaaaatgttataaagaaaatcataaggaagagaaaatacgtttgcaaaactgtgctgcattactgatactgtaagtttacattgtctgactgaaatggtaggtaaccacagctgcacacctcaacctatggtacacatcaagcaattcaacttttcttataatgtcatgacttttctctgatacttgggagtacttccagcatctctagtggcactttgttagagtcccatggtgttagtcaaggtttatggtatttcactaagcatgaaaaatatgcgagaacctcaagagatcacttttaactgcggtacacaatttactggagagatgaactgttcacgtggagatgattagcgtcacaaggtgttttaagcagatacttgcagcgcttgagctcaccacaatagcaacaggaggtagctgtgaaattattacagtggtacagtatgtactacagttcatttcgtgcagtgaggatttaatctttacgtttacatttctctcatctgcagatggcatcacgcacagttcttgtgtgtatgtgtacattttgacatttcgataagttctaactgtttgtaatagatttgtttatattttatggtagtaaatgagaaggcagacaagtattgatgtatattttatgcatttgtgacatgagtaactttttctttttttttttttttaatatttctaggctacatggttcatctcaaggtttttctaattgtcacagatctccaaaaatattttcccatatagttattgaaaaaatttgcatataagtggaccctcgcagttcaaacctgtgttgttcaaggatcaactctatttaggttaataatttcatgtaaaaaatgtcctcctaaggaaaactacatcatagaatgactatgagtctcataagaatgcactcaactagtcatcactcctgtgttttcataagaaaaaacagtgttagagtccaagagagaacaagggttaaaagcatggtctttaggattagacacatttcaattggatttctggttcaaccccttattcattctatgacttaagacaagttacttaacccctgtaagcctctgtgtcttcatctataaaatgagaataagaattccttctttacatggaagttgtgaggtttaaatgagatcgagaatgtaaaatgcattgcatggcacaagtaatggtagctattaaaattgacaactcaattttcattggtctttgaaatttgaaatagtctttttattatggactgcactggctttttcaggttctgtaaatagcctagtagcccatgactatatgcctgtgggacactattttgtccctttaggagttaagggatctttctttgcaagtgagatcctcccttttcccaagatgacacatttcagcactttatctgggccccttcttatgagttgtagcttaagtggcttttgtttttctctgttgatctttttcttcttcttttgggttttcaattccatttctgttggacatggccctcctgtgtggattctttcactgccctttcagagtctacttgccagagggccacttttcaactttctttctctgaaactgtcctcaagacgtgctctttcaagcaacactaacttgaattgtacctctctgctgaaggcacccgaattaggccagcagcactggtcattcctgtcgtttacccattcatttaagtttttatcccccagagttttacattttgatcaggacctgaggtatccaatgaaggctttaatttcataattcttctaataatactagttcttaccacttgattctcattggctgcccagtgttgctggagaaaaatccacaaaccttgcaacaaatttatggtttctagagtgagtagaacccttagcactgcagagctacccttttcttctaatcagccggtgcattctcatttttccaaagtacatctttttctgtagagacacagtcttgctatgttgccctggtcggtctcaaactcctgggcatatctaactttttcttaattttttttgatatttctagatcacaaaattcatctgcaattttttcaaattgttgcaattctcaaaaaagtttctaatacatttattttaaaaatttgcatataagtggactcttgaaattcaaacctgcattgttcaaggggcacgccttgaacaatggcacccatgttgttgtccatagcccctaaaacccttccctggattttcagatagaaaattgagaccagctatgagctccttcaagttccctttctaccatatctggccagtcccacccatatgtgcaactgtctttgtgctccccacctgccctagtcccttccaaggaggtcccttctctccttgctcataaggccatttctttcagcttcctcccagacttggcatagccagatatgctatttctcatatcccatctttttttgccactctgtcgccctgacgttctgtaaatatgcttgagtctttcctatttggagaaagtctcctgatactggtttcctctttagctactcaccagatgccttgaaagagttatctctacctgcttgtcttttcttatctcccagtcactttctgatccattatttccattctttcagcaactatttattgagtgcctaacacgtaccatgcactgtactaggttctagaaaggaaaacaaaacaaaaactcttgccttcctggagcttacattctaacaggggagacaggtaataaacaagataaattggtaatgtttgtattttgtttgagtggtagtaagtgctagagagcagaataaagcaagaaaaagagaaatagagggttgtggtctgaggatggttgtcagtattaagtaggatggctagagaaggcctcactaagaagggtagatttgagtcccaatctgaaggaagtgaggaagagaaccatatgtatatcttggaaaataacattacaggtggaaggaatgacagatgcaaagaccttggggcaggtgtggacctggtacattattgaggaccaagaaggaggttgatgtgactggagaagagagtgagcatgattgtggaacgggggttggtcccgggtgtaacaagaggaagggcagaggcaggttttgtagggccctggaagccattgtaaaacttgggcctttactcagagttagatgggaaggctcgggaagactttgtgcagaggaatggcgtgatctcacttctgttttaactgatggtgctaaaacaccatcactcagatggtgttaagtgactgaagcaggcagagatgaagcagggagatgaggcaaaaggtttctagaatgaggctgggcatggtggctcacgcctgtaatcccagcactttgggaggcgaagtgggtggtttgcttgagctcaggagttcaagaccagcctgggcaacatggcgaaaccccatctctacaaaaaaattagccatgggtggtggtgcacacctgtagccccagctactcaggaggctgacatggaaggaacgctttagcccaggagtttgggactgcagtgagccatgatcacaccactgcactccagtctgtgtgacagagcaagaccctgtctcaataaataataaataaataaaggctaccagaatgacccagctgagagatggtagtgctgaggaacagagtggtagcaagggaaggagtgagggtcaaattctggatatatttttaaaatacagcagatcttgatgaaagatcggttggcagctaagagtagaattaagatgaccccaaaggttttggtctgggcaactaaaaagatgaactgattttaactgagttggagaatcctggaggaggtcagcaactttttctgaaagggccaaatagtaactatctaaggctttatgagacctatgacctggtttgcactattcagctctgcctttgctgccagagacaataggtcaattaacaagtgtggctatgttcccatataattttagttatggtcactgaaatttgaatttcccattattttcatgtgttacaaaagatgcttcttttgtttcttctcagctattgaaggaagcatgtacgtgtacatgagaatgtaaaaaccattcttagcacttgggctgtacaaaatagatggcagcctgcacatgacccaagggcagtagtttgctgccccatcctccattttattccccatgtctaatcatcttttatgaaatcctgctgagtctaccatcactaaatatctaaatatcactgctttaattcagccttcacaagtgctctggattgttcgttcattttcaaaatttttactcttattttccacctgaaatactgtgttatccacccagctaggcttcctatcatgggtccatttttgttcagcccattcttcatccttttgccactacattgttttttaaagcacaaagataacttctctccaggacaaacttcttaacatgccatccaaggccttcacagctactccttcccttacctttttgctgtctcctctatttcccttccaataaatctccatttttaccataggaaaccactcttaatcccccaaacatgtcattttctttcacatgtttatgcctttacatgctgttccatattctggaaataccttttccgtttcctatacaaccaacttctgttcattcataaagacccaactcagaagtcctcttctgcatgaagccttccacagtgcccacaggaagagtgagatgcttcctcctctgtgatcccacagtgccttgtctatactctgtgctagcactggtcatgttgcattgcagctgcttgtcacacactatggtgacagccctcttgcctaccataatatcatcaaacacacagttattagaatttctgtggaatgaatttccccatatttaccttgatgaaaatagcccaccattaactggccatgtaatcttagacagatctcttccccttttggtgttatttgcccatttctaacattaaaagattagactaaataacctcttaggtccctgctgcactggtattctatgatttctgagctcttatttcacccagcttctctcaaattcagttttattgtctgtgtagggtggtctgggaattacatcatcacaaagacctctttctttcctctactaatgaaggcacctctgtgtcgggaggaggagatggataccaggataagtgggccccggcccaaggacacctccatattaggaatcagccttcttgtctcatggaatatctctatttggttaacaagcacagttcataattatgttccagccatgagtccaggagaagagatgaaatcctcatgtaaacatttgtaagcatctaaaatctccactcactgtcatggaacaaagaacaacatttgaggaaagccctacaatcatttcaaaaataaaatacttttaaaaagtatgtgtaaacacattctgttaggttttcaataggttgtgcagcctgaaatcagtaggaaatccaatgagggctttgcctgaggaccagagcaccagcacaaggagacctcctcctgcacaggccctaggcagcatcctttcttttctgttttttctgcagatgccatgagggtagccgttgtgtggtatctttggtgcctagcatactacctagtacttaaccagtgctccctaaaatgcttcttaactaactgtctgaatcatcactgggcatcttattcccatagagggagtccccaggttaccccaaactctgctttaaccttggatgactcttccagtccccagattctatccaggtctctatttttgagcgtgtgtgtgtgtgtgtgtgtatgtagcttatgaaaatgcctcatccctacccctaggaatctcttttccttttgcgggaagacattgtcagttaatcctgttatttgacaaaggcctgtgagaccagagggtcctagagtccatgggcactgatttcccagtggcagcagtgagcccggaggaggcccatcggttggggggtttggggtgggggtgggggtgcagggggtgaccagatggaatgtgaaggccggttgacttctttgttttcatccagaaaagcttgcttttctgaaatggcatggtacgtatttatatgaaggaggactaaggtaaaagagcccaatagcaagatttaggagagataagagacttacagaccaaaactctataggagagattcagagttcccttaattccccaaagtctgtctcattctccctcccctgcctattccatcccctcttgcccatctcagcttcatttcctcactaaagtgcaaagtgaaggcagctgaaaatcagccagatgcagagccactatcattcctcctcaacaagagtctcctcacttcagccctcccccaaaagacagaactcaccaagaggagaagatggctggagggcacacctttggtgagctttgcctagcctcagttaattgcagctgcttaatttttgttcaggcctgggacaaatgttagctgaatgtgtggatcactataggacttacctaaaatctggttctactagcatttaataagtgataattctgtttgcttggaacaggccagcctgccaaagccttagtaaaccgacacgtgaccagtgtcactgtctttgcttcaaaccagctttagggcaatgagaggccgtggatggaagaggcagtgaacttttatcagcttaaacagaaacattcttaatgactgcacactctcttgggggaaagaagaatgaaccaaatcacttaccatctgattttttttaataaaagtttttccttccccattataaaattagcccatgcttacgggatttatggaaaaatagataaaaccgttgtgcaaagttccagctcccaaaggcaattgctattagcgttttgcttcatttctttctattcttctttattataatttttttcttttttagtattgtgagtatactatgtatgttgtaaagataagtttttttatctttttcatttattataatgtaaatatttttgtgttataaatcttattaaacacaattttataggcacataatactccattgagtgattatcttgttgtttactttggtctcattttttttcttctgtaaataatgcaacctaaagcttttttaaaaaaattcagggtactttactttgggtagagtcctaaaagtgcaattacagggccagagtgtgataattagcttatcatcaataggttagaactgatagccaagaagaaatgattgccattaatcattatcagagggatctgagtgatccctctgataggttgcttggaattaaaaccaacattgtgaggctgaaagtttctatttgctctgggctggcaggaccagattacctaaggggtaggatgggaggatgatgggtcagggagaggagatttccagcctggccagtaatgtgctcagaagcaggcctttatttgagaatgttctctatggccatctttccatccatagatggccctgtatatcaccccagtgtctgctcccttctgtcagagcccagagcgtggctgccctggggactgccatccttgaagctgtctgagaagcatggccaccatcccctcttcccctctgagccctcgccactcctgtgtgagacccagtggaggtctggtcaagaagtctctttctcttgcacacttttctccccacctcccagcttctgagttcttggacttaccccaaacttggcaattacagacacatgggaggtaattgcaagacagtgggctgagtgctgcagtagaagcatttaggtggaactcttaggagacatggtgatttcaagctgggtcttgaagccagcaaagggatcccctcccacccatttcccctccagggcaacaagagaagggatgggctttgggaacctgagtttcagctggttttgacagagtgggttgggctgatgcctcaggggctcagtttcctgtacctgcattagaagtcagtaggcaggtatctcattgcatctctgaagaatggatctgagccagttagagcacgtcattatcacacctgacacctcagggagtgtttctggggagtcactggaggacgtggatgctctccctgggagggatgtgtcagggcatttatttcatcattgaatcatactcttttccgttcactcattcccttacctcttttaaaatccagaggcaatgctcctcttctactctgaaaagcagcctggctctggggagctgtgaatgaggctcttcatgaaaatgcagcccatctcttggggatgatgatgaactaccaaggggcttggctgggggcctgtttcttctctcttggtgacataaacccaggtggagcagactctgtgctcgtttctttccaggaaacattcataggcagaatcgttaatctgccaattgcagtattacattgactttccaattcaaaacgattattctgaaagcattttctgtcttggctagcatggttttggccgtgcgatgtgttgagagcccctggtggggatggggaaggagagaggaattcaggaggggtctgtagttctaatcaccatgtttaggaagcagggcacaccaggtctgttgaggtgggcagtgagatggcagggtgcagagattctgagcagagaattcttggcatctcttgagtgcctgagtcctgaatcaaggagactcctcagagtccagggtgaggtctcagattcagagtcctggggacagaacctggcagaatgtagcaggcaggttacgaccctagctgagtaagtaaggggcagaggctgctgtagtctctatgtggaattagaactcctggccctgcaaagtagaggtcggtggggaggctcacaaagggaccctggttcttgcctccctcactccattctcccacacttgagacttgaaaataaactttcctctctgttgggaggggttttcctatttaccatgaggctgagctctccctggctctcagccctggtgaggcagacctgcagatgacaggtaattaataatgacagctgggagaagcaggggcagcaggaaccaacagttttgatgctgtttgcaaaacacaggaggagggtaacacaattccattttaaagcagctctcaggatacaggcaagtcctgaaatagccccatgtaaggagtagcagctgcctcttggctgagtgttacaaggcctctcttggtgggctcagcagctccttcagcacatgcccaagttcccagagaacagaatgatccctttgcctgcatttcctccatggccatcattacagtaaattgcaaggctctcatgatgactatagagaggcagattgatttgttccttctgattgtcactgtgctgaacgtggccggagtgatgggcacccagatttcacaccttgtaatggccctgccagggtggatgttagcacaattgggacctgacgcttcaataaatctgagacattctgctgtggagatcaaagttcggaattgcttaaattggtgttggagcaggtgggaaacaggagtccagggccatgaattggctagatggcaattgtcgttcagtttgtgagatcccagtgtcgcctcttcagatgatatggcatcaatttaagtaatttgggctcccagctacctagccctttcagtattactggttctgggaagtgtgattcatggtctagcttatgctcttgtgtgaaaaagaaaaacaacacccctgcttgtatctctggggttggaaggttgtgtttgtgcaggttggtatcaatgggttatcagttttcacgtgagtgtggacgacaatttcatctcctacctgcatatgctgctaactccccaagctacacttccagccatgacctctcatcttcacttcagactcattagcatgtgtgtgtcatgtcattgtcacttgcacacagaaatggaccggattttaacacacagcatggaattcccaaagacttcttatgagctgggaacgtgctctgccttctgatggaagctcaagtccagaggagaggtggtctgatccattgggaggagtgggcacttttttaatatagcagctttattgagatacaattcacccatttaaatggcataattcagtggtctttagtatattcatagttgtgcaaccattgccacaatcaattttagagcattttcatcatcctgaaaagcaaccctgtacccattagcagtcactcctcctcccctccccatttcctaaccccaagttgtcactaatctactttctgtttctctgaatttgcctactgtggacattccatgtaaatggaataatatatattattataataatggaataatatatgtggaataatggaataatataatatatggaatagaataatatatggtgttttgtgactggccttttacacttagcataatattttcaaggtttcatctatgttgtagcatgtatctgtacttcattcctttttttttttttttttcctgagacggagtcttgctctgtcactcaggctggagtgcagtggcgcgatgtcagctcactgcaacctccgcctcttgggttcaagcgattctcttgcctcagcctcccaactggctgggattacaggcacctgccaccacgcccagctaatttttgtatttttagtagagacggggtttcaccatgttggccaggctcgtctcgaactcttgacctcaagtgatctgcccacctctgcttcccaaagtgctgggattacaggcatgagccaccatacccttcattcctttttatgactaaaaatattatttgaatatgccacattttgtttatcagttgatggacacttggatattcatactttttggcaattatgaataatgtgactatgaatttgcatgtacaagttttggtatagacacatatttttctttgtcttaggtatatacctaggagtatacactcaagtgtatttaaacattttacagagttcagtgcacatctcctcagtcctgagccttatgagttatctgactgttaaccccgaaaggtacacactggatctccttcactcattttttaaccctgactgggacaccagagacatgctgcatcttgtattaggtgtttcatcttgcagaatggctgtgctcctgaaatatttcctgtgaagaaaattgttacaatcccattacatcactggcttttattattaaattggaaattgttggctggaaacaattttaaccccaaattgtgaaaaaaaaaaaaaaaaaaaaaaagaaagaaaaaaaataccagaaaagtagcaaagatttacacgtaagtgaaatgtagacattcttgatgatgtaccattatttttcaaataatactactgttaataacaacaataataatgtaagtgcatcagggacaagcacttacaaagtgcgattatgggccaggtaatgtggtagctttacatttgttaacatatttggtcttcctaacaacctcacaaaatacatattaatattagcatctttgcccctttacagatgaggaaactgaggcacagagagaccaggtaacttgcccaaagtcaagactagtgtactagttaagataacattagctgctgtaacagataagccccaagttcttggaagcttaacataataagcttatttcttgcttacagcacaacctggtggcattgtttttgattgagttgtcttccacatggtcattcagggatccaggcccctttcatcttatggctctaccttcctgaaggtttttcaaatcctcatcactcagctggtgggtgagaaagaaagcaaggactcagtgggaggtcttgggggaccagcctgaatgtggcgtatgtcacatctgccacttcccactggccagaactcagctatgtggccacacctaagtgcaagagaaatataattttgttcttggccccaggggaaaggaaatgggtttgagcaaacacatgtttcattttggcactggtagcaagtggaagacatggatttgaacccagacagtctggctccagaagcttgctcttgagtggcacgctcctctaccttcctctgaatagtagctcagaggtctgggaaaaatgtgtggttgcacaagtttttactcagttttcttcccacatataactattatgtggttgcctggatgctgttgaagtcattgccttttagaaaaagagaaacaataaaaaccaatattaatcaagtatttgccctatgccaggcactgttctaagcatttcacacttactattttattgaatttttacaaaaccctatgggatagggaattattattattttcatttttcagatgaggaagctgaagcagagagcttggttccacgtccaaggccatattattagtaagaggtatcactgggcttggaatgcccccacacaactactgtgctaggaagggattgaagggaagaagaaagaagatgagagatccaaagccaccagagacacaattcaaagtcaaaacccagctagttgttttgaatcctgcttcaaacaaatcaacttctacaagtcacttatgagactatcaagaaaatgtaaacactcatgggagatctgatgatattaaggaatcattgttagcttactgggtgtgagaatgatgttttggttatcttaccaaaaatgtccttatcttttcaaggtacatactgaaatgtttgtggatgacacaatgaaatgtctaggatttgcatcaaataatgcagtgtaggggtcaaggtaaagatggaatcaagagtaggcacaagttgttccttgttgtagaatggtggtgggtatgtggagagttgctgtagtattctgtctactctgggtatatctgaaattttccattatgattacaatcatcctcctgtatacacaagagattggtcccaggacccctgtgtatacccagatccgagcacactcaagtcctgcagtcagctctacggaatccacctatatgaaaaggccctacaggctgggcgtggtggctcaagcctgtaattccagcacttggggaggccgaggtgggcagatcacctgtggtcacgaattctagaccagcctgaccaacatggtgaaaccccatctctactaaaaatacaaaattacctgggcgtggtggctcatgcctttaatcccagctacttgggaggtggaggcaggagaatcgcttgaacccgggaggtggaggttgcagtgaaccaaggtcaggccattgcactccagcctgggcaactggagcgaaactccatctcaaaaaaaaaaaaaaaaagaaagaagaggccctatggaagtttttacatgggttttgcatcttgcagatactttatttttgattcacgtttggttgaaaaaagtccacatataagtgggtcttacaactcaaactgctgttgttcaaaggtcaactgtataatttaaaaaaaaagactttaatgaatcatgagtgtagactttctgtagtccccggatagtaaactaagagcaccgaatgtgtttaccgaagaacagctttacacaggtcttcaggggctctgtttgggagccattggtcagcttttgaactctgattctgagatactcctggaggtagtggtcagtgccgggagaatcgggctgctgaagatgagcgccggagcctctaaaagttagaagcacaggcttcctgggtaacggggaagccaggccaaagtctgggctctgccctggccagattggctcagcctgggttagttgttcaacccatgacacatatcttgcttgaaaggtacggtgcggcccagatcccagctgcatgttaattaaacagtgaaaatccatcaaagactcggcctcttccactggctagttctcctgagtcccaggtgaagcttgctcatggctggccaggaggacctcccaattctccacctaaaatcaacagccaacacttggcagcccagcttctgacccaatgcaaattaagcctggcatttggagatggtattaaacgtcctaaatcaatattttggaggcagaatcagaacaattaaaaccctgctttcctattcagaccattggaatatgagtggatataagattttcagttcacttttaaaactcagaaggttgaaaaagaaagattatccttggcaatgctctgagcatagttgattccatcttcagcatcttttccttttatttgtatacgtatccaacatatgtcaagcacctagggacctccatatattatatcacatttaatccttacaggaaccctgggaggtcccaattttacagatgaggaaactgaggcccagagaagtgaactgacttgtctaagatctctcagctattaattggtagaacagggatttcaactggtttcttcataccaaagtctaactctttgcccactataacacagctggcttttctgaagtatttatttttcattcatcaataataattattaataagataaatcaacagtgacaatagaaactgtttaataatttaccatttttctagtctttaaaggtgctggcaatttgtctagtttgtccatttgttcaacaaatgttgattgtgaggcaagcctgggaaggaggtgtctgggccctggaagcaaagtgcctggtcctagcacacactggctgtgtcacctgggacaggttcatcattctctctgagctccagtctcctcatctgcaaaatggcatgactagcactgtctcataaggttgtcttgaagatgaaaggaattgatacttgtgaagtgtttaaaacagggcctggccctcagtgggcattccagaaataggatcccctgccaggcattgcccaagctctatgtctttgctcgcatggaacttcctcttgttcacagtacgtttaaccagttggtattatgacttctatgtgtattaacctagctaaaactgtttaggtttatggtaaaacagaatttttaaagggtagaaatataaaatgaaaagtaagggccccctctttcttacttccaggctttgactgtagtagtgtagcctgtgagaaatgcttgttttgttctttcttcctttcttcctttctcctttcctttcatgtacttgttttctttcctttcctttcatgtacttgttttctttcctttcctttcctttcatgtacttgttttgtttatatacagctgcaatattattgttaagagtgttcagcggtttattctttttcacgtacctatttgtcctgggtatgtttcacatgggggattgacctcatttttataaacagctttatgcattgcttggatgtgccactcaatgcataaaggtgtttaataggttccctattgatgaacatttaagtttttttataggctgaaagataatttatttaatcatatctttcatttatttattcttatttttagagatggcgtcttgctatattgcctatgctggacttgaattcttgggctcaagcaatccctctgcctcagcctctccagtagctggggctacaggcatgagccactgcacccagcttaaatttattttagtgttttgctactctgaacaatgctgcattaaacatgcttgcaaacaacattctatgccagtttgtctgcacaataaattcttagaggtggaattgctgaggcaaaacgtttttaagtttggattttgctggattttaccatattgctctccaaaaaggaaatgatagagaagaaaaacacctacacacattttagtaaaactcttattcttgttaagaattcagtcttgaaaagagagggtggaaactaaaagttatccggatctctaatcttattggaaatacttctctttagccacacatttttaggcaacaaattctcaggctcctagcttcagcatgttggttcagacaggatgttttggatctcaaggcgaaatcctgtgtgttcttaaccatctctccactcccaagtcccctgcccccattttctgggggaaggtcttttttttttttttttcttcaactttgaggataaacatttagagatttcacactcctctggatgcagaggggccagatttctgacgagaggaggaagtcatggaagagcatccacacgcagaggtctgaagccagtggttgctaagtgttccactagcccagcacgggcctctctgcccccttgaattcctccaggcccagaacagctgggccctgccagtgtccttccctctgcttccagtccatttggcagggagagatgggagttgttaacaggctgatttccttttagggatgactgctccaccaacccccagccaactaggagcagacacccaaatgatgaagataataaatgacatccaaagccatggtgaggagggagtgttgagtgactcacgagcccctgcatcctcccgttacattccaagagctgccctccttgggacttagatcactccctgagaacaacaccccaaccaggctgcggaggaagaccagctgctgtttgctggcctgcatgacagggaccaggtgagggccctggctggaaacaagttctggatttttattttggcctggtcttttgaataggctggtgaccctggctattgtaagagccctgactggggtaggcacaggaggacaggggtccctagaggctagaccgtgaaccccttataagagcagaaatgagacacagggcatttctacttttataaggggttcacagtctagcctctagggacccccgtcctcctgtgcctagcccagtgtcctggagggagacagacctaatagcttggtgaccctggacatgtcagttcatttctctgaatcttggtttttccttctacaaaatgggcataagaactcaataccagatctctagtgttaataattaaggagctaattcatgttaagtgcttggcatggaaccaggctcatataaagcacttaatattccttgctgttattaccacatataccactcctcttaacccatgttgcaaataagacattggaagatatggtctgactgtggctgtcacccatgcccatgacttgtgataataatagtgggcacttacatagaccttattgtgttccatcactttgtatttattgaattatttaatcctgccgaaccctatacgtaactatgagataggttctgtttttatccccattttatgcatgaataaactgaggcacagagaggttgagcaactagcccatagttagtaaatggtggagccaggattcaaaccaagattgtcggttccaaaatctattttcctaaccatgatgtcattctgccgctcagtatatattacatttctatagaaaagttttccaaacatagcagtccactgacatttacttttctctgttttctttcattaaaaaagttttttcttgtaatagctataaagcattataaaaaattttgaacatatggaaatataacaatattttcccacagtgctactacctacagcagaggggcagttcttttttatttccaatcctttgtggactgtgatgtcctactgtgtgtgactactatgcagcttgtgtaacctgtaattctccactggagttggacagcagtcaagctggtctataccctgttcaactagacagtgccatggtacaccctcctgaatgtcatagcaatatcaaattgctaaatatttctaaatgtttattataagttcttgtcttatcatggacagggagcaaacagttcccaggctgatgctggtctgcagatcacactctgtgtagcactgacctagataaacactgtttgcattttatcatatttatttccaagtttcttgtgtgtgtgtattttgttgtttttagcttgtatatactttttgatttttttctcattacattacccattacaatgttacagtaaataattcttgtatatcttctttagtgactataatgtaaataatatagccatttggaagatgtaccatagattaccaaccttttccctcattgttggagcttaggtatgttttcagttatttgctgtcataaaaatacattgattaagttttatataaatattttttccatatttagtgttacttctttagggtaaatttcctagaatggaattactgggtcaaacattatgaaggcttttaaatttcttgatagatggcagaaggatcacttgagcccaggagtttgagaccagcctgggcaacatagtgagacccaatctctattaaaaaataaaaattaaaacataaataaataaaaattacttgatatatatgcctgatcaaattcaaattactttttaaaagggatgtgccaacatatgttcccagccgtagtctatgagagtgcctatttaactatattatttttagcatttattgttttaatttattacatttgctttgtgggaacaactttaattgtttttatttgaatttccatgattaccagtgaggttgaatgtttttcgtgcataaacccatttatatttctccttttgctttataattagttgagcactagaataaaaatatattactttgagtagatttcaaactacttcagattggagggcaagtcaatgtgtgtagaaagtctgtgcatatggacataccttatctccactgtctagatccttctctttttctctgctcttggaattggggagtacttttatatgaccttgatggtccttgtctttagaaaaatgcacttgaattccaaccaaatactatgtattgataatgtagcaagtgtatgggacttttcttgagtatttccaattatttcttcagccttattaaaaatttttctttccttccgtctcttttttgtgagttgggcctattttgtaagtattacataccagtttgaattaattaatttttgcaactgttttgcatccagtggaatttctgacatatttttgttaattatagggaaagcaagaagaatatttgaaatctgggttattttgggaacttctagatgcctgaacacaaatatttaactgtattcccatgtgatctgtgctatactagcagtgtgggcaaagggaggcctgaggagcaacataggcagttggggctggagtctggcaataaatgttgacctgtatttcccttgaagactttttgagggctcatttgttgtttaataacatgaggagatgtttatcaataagacagtgatttctcagtgtgcaccaaagtgcacactttcaaagtgtgtgccactgcggcatgtagtgggaccagggtattccatcacggtcgattcccaccttaacaagccttaggtcctttccctgggctggtagttatttttaagcaagacaaaagagcatacttggaatctgcagcgacctcacaggcaaataattataagtggctaaaatatgtggatatctgttttacatttaggaaagctatgttaataaatatctacagaaaaaatgtattatgctcaactttttggaaaaagcaaggttaaaggggcttcttttcctgctaaggcttaacacactatttcaatttccaaagaagaggcaaaggtgggatttaatatgcagttttttcagaactttttttgccaatgggatcctgtttttcaaaaagcacctactaacctcttgcacagtaccattctgcagcacacacagacaatggagcatgctggtgccagcccagtgtctgtggcattgatgtttaccttggtcatgaatcttacgaagttgaagacatcgtactgaagtatagaattatctgtgaagtgggaatgatggtccctactttagaaagggctggatttgaaatgcattcacgtcccccaactttcctttgcatccagtgacagaacagtaacatttagggaacaataggattgggaaaccatgatcgcagggcatgaaaaaatgtttttaaaataatcaagacagcctaatatgttaggatattttatacaatttacaataccagtgcaatacttactgcacagtagctaaggtgtaatataggcatgggagtgtgattgcttgtgtcaaatctagactttgccacttaattacctttaagcagttagtcaacccatcagaattttcaagttccccaactagagaatgtagataataatttcacccatttatagggttgatagagggattaaaaattcatgtaaagtgttataacctcgtgtatgagtcaaggccctgggagggaacgctttgcatactctatggagtgattgaagagagtagtggagggaccatttacaaagagtgggtttgaagggaaccaatgagggcgaagtgccccaaggcaacagcagggagcagtgactacccttagataagaagtaaggggacaggatattgaccagcagctggggagaaagccataggcacagaagagggcctcagcagaaactgtggccctcagaagagcaaaaccataactgccaatgtgtggcccagcagggagggaaccaggggaataaacatccattattcctgacgtcatccattggccaaactcaaccacagtacagagtggatctggaggggcaagtggatatttagcatagtaaatgttaactaaggttgatgggtactatgcagttaatttcctttttcccccttggtcacaagaagttctataggattgctattactatatgtgtaacttttggaaaattgaaaattacttaaccacatggtgcctaagctttttctgtcttggtaaaggagatactactagtatattcccatgatgtaagtaagataatgagttaatacacatcaagtgcatagaacaaataatgtctgacccatagtaggctctcaataaatgtgaagcagtgagctgttttccttcttcacaatttcaaagagatgttgacatgtacattctgctttgtttcagagactacacacacatacgtaagaaggagcttattttcctcctgggtctggccctctgtcagaaagttgaatgcctttctcattttcgtactcggagtggttgagtctccattctgggcctcaaccgagtctcagaaatccaaatacatttttctgatgctgatggtaacttttctgtaacgtacttggcacggctgagaatatgttgttctcattccctctctatagcctgtggttagccctgcccattaaatcttggtactaaagcacatattatcagccctgctggcacatgcctcgctgcctccttccccacaggggccagcacagggcagctcgaagggcctgtcccctcttctcagtctcccttctctctccctttttcccaaggcttcattgtgaaacccctactgtactctgccttgtatttaacccactcctgtccccctccctcttccattcctatttatcataataggaggagggggagaaggaatcttcttgtttttccagttttgccaggagcagcctgagtccttagttttgaggtcactagggtggggagcaacaggtaccctgattagtcccctagcaggtgatggaagcctacacaacctttagggaagctgaaggcttttgcatggtgatgataggaggcccccagccttctctgtgcccagccagtgctctgagcatttccactgtgtgcgtgggaggttctgatgcggtgggactcagaaggtagcaggtcaaatacttgaggtatgtgctcaatgtttagttatgaggagaaactgacattacattaacaaagccagtaagccggtttctttatattcaaaataagagattagatttgtttatttcatgtcattttctgcactaggcaatgtcttagaaaatataggaaaggagttaaaatttagctactcagatacattgctcattcccaccaaacaactctaatgtctagggttagtttagtttcaaactttcagctgacctgcacctcccaacatcaggttctgtcagccagctggttttggggttggcacctctagttacaccttgcaccttgcacttttggcagtgtaaacatgttcatccaaagtagctctcagagagaactgtgatttttaaccctctctcaccaaatgcactatcttctttgacagaaatggaaacaatttacactttaccagttatggaagaagcagcatgtagaaacctgagttaactggtaccatatttccaatttattctagggatatttcagcatttcttataaactcgcaccccaggcagctgcccagttggctcaccgtttaatatagctctttttttttttttaatcactgagaaatgcttggataggaggcttgccaggacctcagtagtatggcctatgtgtagtctatttattcattttttcagcaaatactagaagttatcccagcctgcattaccatcaggtcttagggttgcagattatagcaggatattccagggtaccagtgcttaggaatgaaaggcttatgatttggggagatgagtccatttgttgcagggatgctgatagagcaaggtccagttccttggggatgcaaaggagagcatgagggccccaaaaaagggtccagtcctaaagggattcaagagtgcgctcagtctgggtgggcccaggagggaagagggaaagcccttggtgctaggacccaatcagagcctccacagaagcagaatttgaagttgctggcagaaggagttccttttgtatcctaaatcttctgcagttgggctatcccttcatgggcatgggatggcaggtggccagggccatgtgccaataattagatggggactggagaggctgctgagactgaaagaaagtgctgaatttggccccatttagggtagcgcgggtggccctgtttgcttacagctgtggagcttgagtcattaggggtcctggccagatgctttggacatgtggcatagcccaaagcacttttggtcctggcacctgaccctggccatcgttacatcctcatcttttctggagcttaatgacccattgtctgaagtcactgaagaaagctgtggaaggccaaggagaaaaccctgtaatgtaattgacatggttctcccaaggtccatatgggagcagtagtgaaagtcattcacatgtgtctagttttacagtttacaaaggtgggaatctgggctgggtcagctaccgtctgggtatctaggtgcaactcatttaaacccttttagcctcagtttcctcatttataaaacagataataaaagtctctgcctgacccatctaacaggtttttcatttgagagaataggctttttccttctgggcaagaaaaaagagtccaaagagaaaggaacaagaacaacaaaaaggtggggctgggacaggtccagaggaaaggccaggaatcagatttttgatgtgagatggtaaagaagcatgctgtcttcttcagattgcctaaaattgcaccatatacctttgagtgggcattgaaattgcttcactgaattcaaattacattgtaattatgctttccctgattacaaatttaacacatgcgtataggaaaaagtttagaaaaatatattaagtataaagaaaagccaggagtgttgcctcatgcctataatcccagcactttgggaggctgagcgggaggatcacttgggccctggaggtcaaggctgcagtgagccgtgagtccaccactgaactccagcctgcatgacagagtgagaccctgtctcaagaaaataataataaagacaaaaaataaaccatagtgtttttgctattaatatttggatatgttttctctttcattgttcatatatctaatattgcaataatagaattagagctggacacagtggctcacccctgtaatcccagcaatttgggaggttgaggtgggtggatcacttaaggtcaggaatttgagaccagcctggccaacatggtgaaaccccatctctactaaaaaatacaaaaattagctgggcgcagtggcaggtgcctgtaatcacagctacttgggaggctgaggcaggagaattgcttgaacctgggaggcggaggttgccatgagctgagatcctgccactgcactccagcctgggtgacagagagtctgtctcaaaagaaaaaagaattggaatcatactatatgttcaattatgagacccaagctttttcagtgttatttatacatgtatatgtttttagctttgtttttacaaaaatgaaatcatactgtgtattagggttatccagagaaacagaaccagtagggaagatatacacacacacaaacacacattgattttaaggagttggctcaggtgattgtggaggctgggaagtccaaaatccataagcaacccagcaggctggaaattcaggcaggaattaattaattctattgttttacgatagaattccattttctctgagaaatctcagtttttattcttaaggcttttgactgattggatgaggtccagccacgttatggaggataacctcatttacttaaagtcaactgattgtggatgttacccacatctgcaaaataccttcagagcaacatctagattagtggttgattaaataacaggatactgtatcctagccaaggtgacatataaaactaaagtataacatgctgcatatcccacttttgtattttgatttttttttttactttacatgtcatgaacattttcccgtaacaccaaacgttctacaagaatttgatatttaatgactatattgacttttcatcaaatggctttctcatgatttatttaaaatttccacattgttagctatttaggttgtatctgtttttttttttttttttttttttttttgagacggagtcttgctctgttgcccaggctggaatgcagtggcgcaatctcggctcactgcaagctccgcctcccaggttcataccattctcctgcctcggcctcccaagtagctgggactacaggcacccgccaccatgcccggctaattgtttgtgtttttagtagagatggggtttcaccatgttagccaggatcgtctcgatctcctgacctcatgatccacctgcctcggcttcccaaagtgctgggattacaggcgtgagccaccgtgcctggcctgtatctggtttttattataaacattcttattgacatctttttgtgcattttcttcttatgtatgtcttattagaccctagaatatattcattagcctggaattactgggtcaaaaggtatgaagattttaagcttttgatgtacattgctaacatttccctgggatgttgcttctcaaagtgtgatccttgggccaatatcattagtatcaaagcagattcactgttttgatgtttaaaatgtgtatatctgtgatatattagcatctggaaatatcaattccttgggaggctggaaccatcttttttaaggcttatttctgatgtttcagttctaccttgcgtgccttcaggaaaaatagtggataaatttagttttctactgtaggcatcatagatagaactgatgctagggaaagcccatagacatgtacactgctattctttggagttgaagcatagaggagataaaccatgaaaggatgttttttaatgtttcatttaaaagatgcccagtaaacagttctttccagccagcttttaaaggtgttttttgaaatcaggaaattgtaaatattcactatggggacatgggagaagggatttcttaggctccagttacatgttacagtgtccaattttttctcctcttggtctcttctcacaccctcctaaatgtccccagctgctcaaatgatcaccagcacagaggaaagcagtttgatgctctaaggcctggaagtattaggttctccctgcatcactctcagagtgtacatggctcagccctcttgaaggacctcagcatgaggacagagccctgacaggtggctttgaggtgcagaagtgttttgtgattggaggcctttttgcacctcataaggagtaggtctccctgccatctgatccatcctgccttccattgctaaaataaatcttcctaaaacacaggcttctctgttgttcaggaacctgcgatgagtccccatccttttaaagaggaagtataaattctttagtccaggtttaaggactctagagtctggctcttacttggctttgttttcctttgctttataatagcaatttctactgactgtttttcacgtgtgtcctgccagttctaaggtctgcacctttgcttgggcattcccctgttgtcaccacatgcccccaccccgacctggccctacttattaaatccagccactgagaccccattgtctctcacatgtctggccctgcagcctttcctgtcgcagcagtgaacccaggctcatatgcctcctgtgccactgaccgtttcatgtttggggttggttttcccaaattgattgtgcattcctggtttgtggtgagcacatcctctcctgttctcagccctctcggttggctgagctgcagaccatacctagtgatgcactgattacttgggccacagcagcctctcaggaggcctctgtcttggtttcactgcacttcacaaagctggggactgcttgggagctggacccaatgttttcatccctgtgcctctcagccagaccctgtgatgaagaggtcagggatggttccttcggaggctggggtgtagagtacatgctttgttggaatcccagctaactagttctgggaagttggccatatcacttagtttttttcatttatccagttcagaactgctcacttaacaaatatttcttaagaccctactatttactaagccctatgttaggggttggaggatatagcagtgaatagggtagactaggtttctgaccccatggaccagacaggcaatataaaacaaataatgataattttagataatagtggcttggtgggaagcggggtggtcacttcagagcagatggctaaggaaggcctccctgaggacagatatttcagtggggattggaatagtgaagtgggactaactatgatcttgggaatgaatgttccagaaagaggggtcagtaggtacagccacgagagttcaaggaaccaaaaggaggcccccatggctgaagcacggaggacctgggagaggccgagggggatggtgctagatgttgggccaaaggtaggtcccacagggccttgcagggccactggaagcctatgaattttcctaaggacatatggaaagtcattagaggattttagcaagtgagtgaccagttctggtttcttaacagtgcctgcttcattaaacatcaaatacaattaagtaaggttatatatatataatatgtagtggtgtgcctggtacacagagatgcttcagaagaggtaattattgttttcacattttggagacagaatggttatctcctacagtttgaccttaaaatctggggttgtggtaggctgaatagtggcagcccgaaagtgtctatgtcctaatccctggaattgtaggtatgttatcttctatggtaaaggagaattaaagttgcagatggagttaaggttgctaatcagctggccttaacatagggagagtttcctgagttatccaggtgcaccgaatgtgatcacaagtgtccttaaaagtggaagagaggacagaagaaagagtcagaaggaagtgtgactatggaagaatggccatgaagatgtgacatcactggcttttaagatggagtaaggggccacaaaccaaaaaataggggtggctgctagaagatgggaaaggcaaggaaatggattctcccctagagccctcagaacggaatgcagccctgccagcatgttgattttagctcgacttctaacctccagaattgtgaaataataaattagtgttgtaagccactaagcatttactaatttgttagagccacagttggaagcaagtacgaagtttttgcaccaaacattgtcaactgcagtttagtacattccagtattacccttgacccatgcaattttaattctttcttgagttcactgcctattaattggtacctgctacatgccaggctgtctgagacagcatctttgcttttgcagagttgactatctaggggacttgctattgttttctgtaaactctaggagtaccaaattccaaatgtgcctctaggtggcacatagtagcctctcaagtacactggtgaagtgactcccacttttaattgatccaggagggcaggagagactacagagctcatggtaagggattaggctctcagccctaggcatctccgggctgggccacccaggcccccgggactgcagggcagggatcaggtttgccttgtgctggcctgggctctgcttgaagtcctatctgccctttcctcatcttcagggctcagcccacaggcctcctccaggaacacccctgcctaccccaggccacaggaagcattccctccaaggtctgcctttccccccggcagggactccgggccagctgctccatctcttgggctgcggttattttctctttactgtcggctcctgtctgtggagacaggcctgtgccaggcatacattcaggggctcagcaatgcctgtggtttgattggttgggtctagatccgaaggattgctatacgagggcttttgctttatccttttagggaagttcattctctctcgttgcttctcctcctccttttggagacatcactagaaaatctcagcagcaggagcccagtgcctacgccagcccatctttcacactgtagctgccagaatgttcattcccaaaccaaactctgacctagttcctcctccagtggaaaactactgaggatcccttcttctccccaccccatctatagctatggctttcagtgttaaaaagaaagaaataaatgaaagttatgtggacccttctttttcaataaagtatcgcatggaatgttcatcattaagcatctggactctggcatcagacagacctgggtccaaatgcaggctctgccacttacctgtataacctcaggcaagctgtctaacctcgccgtacctcacttttctcagctgtaaaatgggggtgtgatactgacgatccctagttcatgaggctgttgtggagatcaagtatggtacttagcagagtacctggcctggtatagctaccaaataaatgttagctaatgttactagagcacaagttaattttctaagttctaacttataacagttataaagcttatcagtgacaataatttggctgtttggatgaacaaaggatttttaaaaacagatttcactttttattaggttgctgcaaaggtaattgcgatctttgccatcttaatggtaaaaaccacaattacctttgcaccaacctaatagaacagttttagatttacaagaaattgtgggatagtgcagagagttcccataggccctgtacccagttcccctattgccaacattgtacattggtatggtacatttattataattaatgaaccaatgttaatacataatcatcaactaaagttcatactttattcaaaactccttagtttttccctaatagatttctttttctgttccagggttccaccagggaaggtaccatagtacattaggttgtcacgcctccctaggttcctcttggctataatagcttttttactttccttgtttttgatggcctcggcactttttaggagtactggtcaggtgttttgtaggatgcccctctactagaatttatctgatattcttctcatggttagacggaattgaacacagaaatgtaaagttagcagattatggatgaccactccagttttcccttggtctcagcatccatgaaattagaatcagatgtttatggggagtctaaaaacatggtttgaaaaatcactggagaagatcaagtctacactccctggtgtgacctacgaggtcttctcactccaagccctgcccacatcaccagcctgctttatcactccttcctgctgcaggcacccccagcttctcagcattcccctaataggtccgggcattgaggcatatcgactcatcccccaggaatgccttccctcctttctctgcctgcctagtttctttctaatctctatgcaaagactctaagatccagtttaacttatccttcctccctgatgcaattcccactttccttacagagactgacactgtccctagggttccctgggcacatctctctattgtctttctcagctctcatgtctgcctcttcctgtacactggaagcttcttaagagcaggagctgagtcataatcctctattcctcatgtccagcgtgagcctggcacacagtaggtgcttaagagatgcttaatgaatgactcttgatgttagagaaaggtgccatttctataccatctttaacacagagcatgttgccttcatcctaagaaaatggggtgccccagtggatgatggataccagagattaacccttgggtgggtcttttaaggccgttttctccctgccccagagggtgtgggaatgaggtgtgagtatggaaaggaccaccagggggctccgggatgcagttcaccagcccaggccgagaggaaggctcagtggtggcttcagcagcaagcctgggtctggcagaatcctcaaagaaagtgtgtcaaaagagaggtctgttttgctactgatgtgccaggctctgtagcaaggacaggatgtaccagcctgttctttaaacatgtgtgggcccctcactgtcctttgccccagaggtcccagcctacagagaaagggacaaaagatcctgagagccaagaaaataatatttgcaggaaaaatggtcttgttatatgcgcaagcagacctttacttcattcagacttcctaatttccctttccacgccagtgttaatagttctccttggatcgcaaactcttaatagatattcctaaggccaaaagtatcactgagaagttggagccaaaatctcagggcttttcttttgaattctataagaagaggggaaaacagctgagttaatctgaaataatgaagctggaattagaaattgctctggtcagtaacatccactgttttgtttttttgttgtgttattaagagtaataataacaatagctcttgtgcattgggtgccaactctgtgccaggcattgggatgcaggcgtctgcctgtgccaggcatttgtctttgggcatacaaggggaattaggccaggataatctctgcccattctgccacaaagatattatctccatttcatagatgaggaaattgaggcccgggaacattgcatgatttgttaaggctagaaatcagattctgtccagcttcaagatctgaaccctttccaatcacccaaacatgcctcaaaaggatataaaatagttgccaatcttaaaacatgactgtgctccaggggaagggaagggattatcacacgaggcagaaatgtataggcattacaagtacatccatcattaataataatgacaaaaggatgagaatatcttactgttttgggccatgggcttcctagcattcatgtaggcaaatgaaaatacagagggatgtctgctagaatgcgatatggtttgtattcaaaagattcttgtagtttactttaaaagcagtgttatgatggaacctgtacactcacacatttttaagaagcagactcctccttccaagggttttgacccagctgcacatgatcttacgtgcacctctcctctgctttaacctcagtagtcaggtgaggtgccccgtaggctccagggagctggcacaggcggctccttgtcctgaaggctctcttgcctctatttcccaaggtggggattctaaacagcagagcccagaaccaaacttggagaacactcgagcccccagctgaaagacattaatcacccatggacaggtttcttgaacaggagaaagtttgtaaccagagaacaaagcagtttctgcacaaaacagtaacttaaggaggatattcaaaaacctcttggacttttgtctcatgccatagcctaagtccctctcaaagctgcccacattctcaggaccagacgtgtaccctgcctttggctgggcccctgggattccagggccacacggcagccgtgcgtggcacatcttcaagttcacttctccaagctctgggactctccccgtgccagcacagaactattaattatttttctctgtcaaacctttgtcagcaacttcatcccaaaagaggaggtttattttcccttcggcagtgtttgtgactcttgtaaataagagataattacactccagtttttaaattaaaacaaaaagagctagagatgcccgttaggagtttacattttacaacagcccacttccttagtcaaagatccaacagacttagtttgctgagttttatgcagattctgagaagtttgagtggtttaaatgcgaaacttttgtgttagccgcctgaaatgccttcgcttttgcttcgagttagtattaaataatttttaaattctttcatctttcagcgctgctggaggatcttaacgctctaaaactgcaattaaaatgtgaacattaaggagttataaggttaaatgagagaatgtatcagaaagcgtttggagatgtttttattgcaccatgatctgacttggtagccggagaaatgcattcttgtcttatggctgctgaaaatttcatttttttttttttgtctctaagtttgtgcttggaaagtgaaaatatattcaaacgagtccttataaacatttgatcttgttttcatatgaagtgaaaagaattgtgaaaagtaattcaaaacatggaattagattcttacagcgttagttgcgtggagccatctgcagggctaggccaggagttctgtgggttatggccagccctggatcgatgtgaactaacatctaattagtgggcctggtggaagttggcaagcctttggacaagaaggctttggggaggtgaagacatctttcctccctaaggaggaatcatcccacagtctcaagggcagtgttcttcacagaatgtaagggtggacctagcgtcggctgtcaggaaccagcctgggcactggtgggctggcttaaccccttgttttccatcccatcccaacaccttgatgaagtgatgtgttaacaacaggaaaggcaatattgagaatgtcatgacttagggagagagtttatttgacatgtcagctgcaggctgtgcttacacagatgggcgttttgggactggaaatctgtgaatacccccaaaagacattatgaggctcatgggagcaaagatggcatgagaaacttgaaactaggattccagcatggcagaataagagtacacaaagtttcgtgtgtcatatgctaagctttctcctaggcctttcatttttgtaaatcagaggagaaagccgtatgttgacaaccctgcatttaagacataccaaccactttgacaatgaagtggtgtggccttgccctccccatcccctcccccaccccaacatgtgcttcaataaccaggcagcactccctgatgtcatcaatacttagatttattgggagggaccaggagagctttagtctatgagaaacaatggccagactttactctcaaggggaatcagcctttacatcatctgagcctaagatgttttctggactacaatatatattatcacagatcttaatttgagacatacatgttagaataatttcattttgaaatatggtggtagtaaaattcagcattaacatgagcagtcagtaattcaaattttatttgctctgatatcaaagggatatctttctgctcccaccagccaggaaaaagagagagagagagattaggcattttgctgagtactttttcagcccaattttatttaaagatgaagccttgtaattgatttgtttggtctctgaaacccacaagagtcccgcatagccccctggatcttggtgaaaaggcgtagcgccttctctacttagctgttggcactaatctatgcttgccttattgggggcagaaagtttgaaaacttagaactgtttataacctccatttgttttccctttcaacatcataatgctgtggtgaactggctgttttgggaaagaggttgaaagtggaatgattgagggggaattttcccccttggtgaaactgatggactagcacagttttagaaaaattttcatccgtagaataattttggccattatgaacataaatggctttgtcacccgttagcaggcagatagagcatgtgtttcacattattaattcgaggcaacgttagggctggttgaggcagcttttaagaaagcagagtctacacatccccatctttcatccagttccacctcaagagacagcattcaaactgtccctagcggtagaacagcccctctggtggaaatgctgtgtgacatgaatcttgccaaaaactaatggatcatttacaggaaataagaagttgaagagaaggatgagttagtagacttcaaagcaaactcatttccacagaacctaaataatgaataccaaaacctgaagatttcacagacagcttatatggctctctgtacagctggaaccttcgccgactccagcgccatctgccctgatgaagggtccctgctgcttcaggaaggaaggaagaaaaggaaagaaggaaggaaatcaggggagaaagagaaagaagcgagtggagagaaagaaggagaacaattttacaaagaaagggagaggaggagagaggaaagatagggaggaggcagagaaggaaggaagaaagcaatggagggagaaagaagggaagaggagggagggagggagaaaggaggggagggcacgagggcagagagatggaaggtgagagcatgagggctgatcacaaggtgggtcgttaagtctaattttgcacaaatgggttttgtatggccagtatcttgggacatctgtcttgtgggtctctagtaatctttagattactaaagtcaaaataaaattgtgtatcttttaaatgcccctgagtcactttgttggaactacttataatggagaactgtgtttgagaaggccaagggctggttcagactataagcacaattccaaggtctgtcactataaggaaacttgtatatcagtgaaatcgactgattagggagatttatgcatattacaaaaacattttgatccagcaattccacctttaggaatttattcttaataaatagttggacgaggttgtaaatcctgtgtagataacagcattgttcacacttgtgaaaaacttgaaataaactataagtctaatatgaaaagattggttaaataaattatggtgtatcatagtaaaatactgtaacattaaaaatataccgcagttctatattattttctggaataatttttatgctatattaactgaaactttttaaaaacagtatttatatatttgtaagggtatatatgtaaaaatatatatgtttatacttgcattgaataaagtctggaaatgtgtacctacagtattaacagtgactacatctggaaggtaggatttggagtgattttaatttttctgtctgcattttctaatttctaccatgaatatgtattacttgcctaatataaaaaacaatcagtaggagaggaggatttttcactctgcaagactgaaaaatgcaagaggatttatttaagtgtttttccacagagaagggcccaagttaagtttgtatttacagagtccctcccaatgttgggaagggaaaaaactttcccaaatgtcaaaatcctgtttctggatcttttttgtcctcagggccccccgggtgccaagccttccttcttgcttatggcctgacctgagttttcttctggagccaacagccccttctagctgggcagctcccaggggcgaggcatctctggccagggagcacctcctacaaggcaccctttcctccagattagagaccccagcagtgccagatgctgatgcagagtgcctgtaggccacctaaggctggcttggagtggggtggggaagagaagtcacttgagagaaaaaaacaaaaaacatctgaaactgcaagtcattggaaggttcctgctggcacccccactgggctcagataagaatcaggaaccgaattcctgccacatttcagaaattttctgaggaaatcagcatgggccaaggggcccaatgagagtctgaggtggaagtgggtcattggagcccaggccgcctacctgggcctaatactctgtgacagacactcccagtccctgggtgggtgatgtgagttttgttcccttagtttgggctgggtgatggtgcccagcaggccccgcccacaggcctctgtggcttcctgtttgggtcttgcccttccatctgcttgagggccgtagtggtgacctctggatccagcttcccactttgggcttgcgttctctttgttggatccagctggtctcatccctggggcaggatgggtgtgggaggaggacgaagacagttgggattctttagcgggtgggttgttggcttggagcagagcccagcttctcagcgtgcctgccacagcctcccccacccagttcatggtctgggccagcgtgatgactgcttgattctctatcaggcaactgcacctcactggagccaaattccatctttattctgctccccattaccaccccgccaccggctttgtgacctagactgatcactgaatgcctctgagcctctatgtcctcatctgtaaaatttagctgtgttgaaagtggaagtggggagttgaagactaaatgccacaacataggaaagcactttgaatgctgccttgcaccctgtaacaataataaccattattgctgtgataactgatgtgtattgaacaatactttgcaccaggaactcttagaaaccctttacatgtagtaatttacttaatcctcacaatggtttatgaggtaggtactaatcaatcccatttgcagatgagtaaattgaaccatgaagagattgaataacttgccgaagttattaagtggttgaatttatgaagtaaccaggctctgaccaaggagctgcttttttaaaattttttggttttaaaaaagtctttccagccatcttaaaaaaattgtagtaaaatacatataacttaaattcttaaccattttaagtgtacagttcagtagtataaagtgcattcacactgttttgtaaccaacctcctaaacccttttcatcttgcaaaactgaaaccctatacccattaaacaactccccattctccccaccccccaggccccagcagccaatatcctgttttatgtctcgatgaatctgagtactcttggtacctcctatgagtggaatcgtatgatatttgcctttttatgactgacttacttcactcagtataatgtccagagctatatctgtgttgtagcatgtgtcagaatattctttctgtttgaggctgaatgatattccattgtatgtgtataccacattttgtttatccattcatccattgtcggacacttgagttgcttccatcttttgactattgtgagtaatgctgctctggacatgggtgtacaactatatcttcaagactgttttcaattcttttgagtgtatgcagaagttaaattgctggatcttacaggtaattctatgtttaattttttgaggaacggccatactgttttccacagtagctgcaccattttacattccacagcagggcacaagggttccagtttcccaacatcctcaccaatacttattgttatttttgttattaatagtaaccatcctaatggatatgaagcagagtctagccctaccgtggttaatgtcaaactgaattcttcttacgttgttgctgaaggtgtggtggcaaaacctaggtaaatgctggcggaaacacttttaagattcatatatactgctgttcagaatgtctcccatcattatgaggaaaatatattatttttagcagatgttaaatcaactatattaattataagttctgttcagtaatgttccgaatacatacgtagctagttctcaaaatgcattccttgaagtctttgagtttccactaataaagaaaactaaggaaatcaggcattcatggctctagacaggaatgaagactttaggagaaaaaaagggttagttctgggagactcagcttctaatgtggacccattaaaaattcctaataggcatttattgtacacatctgttattccttttggaggcactaatttcagcaaagaatgtaggtttgtggttttttgaaaaacactagatcaaattattgtgtgtttaatttgaacgggaacttcatgaatgagatgtctcccaagtgcaccaagcaagagtgaggaaacgtaggtttaaaccttttgttctgtttggaagtgtaaacagtgtattcaaattcttaaatatagagaaaagatctagaacagagggacagtgaagctaatgtgtcttgagagattggagcagacacatggaaaatacctatacctaaaagcactgaggatgtttccacctaataataaggagtatggttctgtaagctcctggaagtaaggattgtcctttaggctcagatccagagcccaacacctgtttttagtggatgatgagaatgataataatagctaacatttattgattgcttactacatgccaaacactgttctaagcactttacaggtcttaaatcacttaatcttcttaccaatcttgtggggcaagaaccgtcattattctcaatttatagatgaaaaagatgaggcccagtgaagctgtttgcccatgttcacacagctagtaaatggcataactagcattcaagtccaggcggtagagtccagagcctgtcctcttcacaccaccccacccagcgagaatggaaggagttagctgccagaggtcttaaattcctggatccttcaatgatcactcaaacggtggtcaaccatctgtttatatcagcatgttaggactttttttttttttgtacttctcaatcagtaccggctctaaaggtgatactaccatgatttactacttggggtgtcttggtggtcggagcttgccattatggattgctaggcatgagatggacaaggtggtgggctggtaagaggggcaactaaggatctgacccagctacaaaaagttgcacagatgaggctatccaagcatggtacccaagagggattagaaatatctctgcccaaaactgaagtgtttacattatatacttaggaagtccaagtaaagacatgagactagactttaggttgtggggctctggtggtggccagtaagccatgagaatggatggactttcctagagagagtgtgcaggatggtaacctcaacaccatttatcagattcttcctctgaaagtctaaattccagaaaaatcccagcaacagattttttttctttaatctgccttttaaaatcttatacctttgaagtgattgcagagtacagttttgctgaagtggacttcacatggtcttaagatagccagaggggcctctgtcagctgcccacatggtggtatcacagctgtccaggccgtgctctgtggacagatcagtgatgataccatgggctgtcacaaaccaggctctcaccagcaatgctctagttgtagtgtttttagttattgatgtgtttcaggggccaagaatggccttaattcttgaattgcaattgtgcaaatatagtttgtacactccattccttaatccacataataaaaggaaaagccaaaaggatgcattcaacaaatattggggctgatcagatctttatctgattatgttcttttggagttaaactaagttctagaaatatggaacaggtcaggcccagaacattcttgattgagtagttcaagatcttttgatagaattcagagcctccatggtggctaagccagttattgctgctttaacttgacttctccccacatttggaggatattccagccaagaaaggactttgattcatagtcatcatcttctatgtacaatttgaaatgttttgcatttagggttcttatgcttttttcctaacttaaaattgttttgtatttacatttctatccataggtcaattcacatgatcacttaaagttttaaataatgtcatagaaatcctactgaattgctatattgaatttacttaacccatttctctgtggttggatatttagacagattccattttacttcttaataatatgctgttagaaacattgcttacattggttacatttctttctgtgggtctcttttttgagcatttcttcaagatatagtccctaaagaagaattaaggataaaaaatatggatggttttatagctctagttccatattgttagacaactgagagaaacactagagtaatgtacaatgcccctggcagtagttgagtgggcttgtcgtccaacagctctgcccagtattttaccattgtgtttcttattgtgttcaagtaggtaaacagttattttcattcatgtttctttaattgtgagactgaacaccttccctgtgttagcttatagggtcatttcccagtgtgtgtaatgcaactataaagtgcctggcacagggctgccacctgctagtgtccttctctttcctgctttccccctttactctttagccatttgtcaaatgaagtctcattactgatgacaatatatgtttatctcacactataagattttattattattttggattataaatatttatccattatatttatcataatttaaaattttggggggctccctttgtatttgttttgttacttttcttatttatttatttgatactgagtcttgctctgttgcccaggctggagtgtagtggcacaatctcagctcactgcaacctccacctcccggttcaagcaattctcgcgcctcagcctctgagtagctgggattacaggctcctgccaccatgcccaactaagttttgtatttctagtagagacgggctttcaccatgttggccaggctggtctcgaactcctgacctcaggtgatctgtccaccttggcctctcaaagtgctgggattacaggcgtgagccacctcgcctagccagatgttttgttacttttcattaaggagattttttttttttttttttgagacggggtcttgcttacccatgctggactgcagtggcgtgaacacagctcattatagccttgacctccagggctcaagccattcttccaccccagtctcctgagtagctaggaccacaggcgtgcgccaccatgcgtggctaatttttgtttttttttttttttttttggtagagacagggttttgccatgttggccgggctgaccttgaactcctgggctcaagcagtctgccttccttggccttccaaagtgcaaagagactttaaatagactttatgatattcgagttcacctacctcagtcttataatactatttagttttttaatcatgaatttctctctctgctatagctgggataaatatgctctcctttttttcttttaaatgctttccatgtttaattagttcattaaccaatttagaaagtactattgtatatggtgagttatggatataatatacttttcttcatattgatatcaggttgttccaccagcatttattaaatggtgattccgacatctattgtcgtgattcttagttttgttttgtttgccatgtcctcaggacttataagtgcttgaatccatctctggaatcactattttagtagagtctttgtcctggctttgattcagcaaaattcagttttgatgaagatcactttataatatgtcttaaaatttgattattacatcctcctgcaatcttctttggaattattgtgtatttatttttctttattaattttgccagtcatttatcacattctagagtattcttgcaggaatataattgttattatgttaatctattttttgttttatggattaatgttactggtattactctaaattttctaaatcaagagcaatggatataactttgtttctttaggtattcctttatttttcccattataattgtattatttttatctcactagatatttatctagatatataaattctcagatgttctttaatgttgtgaatagcaccatttttcattgccttttctaacttcatagcagtggtatgcatttggttaatcttgctttttctatttacacttttatatcatctgcaaaacaagtgatatgtccatttccatctttcctgtatttattctctatttatttttcatcgtgtcctgcagcatttcctattacctccaacatgagtactgagaggaacatcttatgcttctacctgtgtttgcaaagtgaagtctctaagactgtgccatcattacagtagctaatagccacttctggctattcaaatttaaataaatttaaaaataaaataaaaaattcagtccttcagtcacattagccacattgaagtctcaatagtcatccataactagttgctaccaatactagttgtccagttgtactggacagtgcggaaataaatatttccatcattgcagaaagtcttaatagatagcattgctctagaatttccacataaagaataacactcaagcccagatttacgtctataatcattgttttatcctaaggaataaatctcctcttctgattttgagttcttttgaagatttaatgttgaatgttattgatggcctcagcatccaccaaagaattcttacagtaaaaccctttttttctatcaaagttttgaactaccctaatcatttccctatgtgctagctctgtctttgtaggatagctcatacttgtttgtttttgaaacatttcccttttctgtgtgtaggatattatttgtgattaaactatatttatgaattaaatggcctgtaatccacatgctctgtctccccctctttcaattggtgttgtcctcaggtgtttcagatcaagatcttatttatataacatataatcttgtctgtattttgaaatcatttatgtaactggtatttgaacagttcgagatgttctgagaatccattaggggcttcctttagaagtgtgtagagaggacagaactttccctaacagtttctctgtcatttgtctgtgttttaaattttttattcaacataattagttcagcaagcactgctgaatgtaaaccacctgtgaaacactaggcaacatgctggaggataagacgaacacagttttggccatcagaaagaaatgagaatggtcatatcacctcttcattggattcctcaaggccttccctcaccccgcagtttccccaacatgaatcttaccaggtcagtcttctagttgcacccctaaccccaaaataccttgatctcctcattgcctcttcccaacacaaaagttctcttgcagagaatgccctttttcttttcacctctcactcatcccaaagttcctgtctttgtgattctccctgagtgatttctctctgctctcatcttaatgtttcccttaagtgtgccttcatcttggcaaataattattcatagccttgtcatattatctagttacctcctgtgttattatgtacatctcatatgtctaatatccctgtagggatggggcggagggagatctgaagtcttctatttcttttgtttagcaaacagagtccactatacagtgctaaatatatggcagacgttaagaaatacttattgaataagtgtgttgaggcgttaacaattcttacttcgttaccaggcagagccagtaaaatctgtggccaaggacacgttttattcgctttagtaaactattataacctatttggagataaaggcaaaagtttctacaaagaaccaaactcatcttccaagttcattaatcagccatccactcccattcattcaacagatgattgagtacctcccatgtgccaggtgttggggagacagggtcaagcaaagcaaacatggttcatggtgttcacagtaccgggggagacgtattaaacaagtcaaccgacaaataagtgtataacttcaaattttgttaagtactataaaggaatgacaatgacatggaccattaaagttagcctgggtggttgagcagggcctctgtcagattaggaagtgacatttaagctgagagctgaaggatgggtcactaaccatgtgaagctgggtgaagaagcctgtctgagggaacagcatatgcaaaggcactgaggtgtgaaagagcttagtaggcctgaaaggcaaccaggagccagtgtgtggctggagcatggtgagtaaggagggggagtggcatggggtgaggcaggccctgatcttgaagacccttatgatccagggcagagtatttgggttgaagtgggttttaagcagtttgatatatattttcagagatgtttcaaagtgcctaaagccagtttattgctccaagcaataaatatattctctcatttaatactgagagcatccagatgacgtatgtgcttttaattatgggattttaatatgctcattttcagtggaggaaaccaaggcccagagatgttaagcaactagcccagggtcacatcgtatgtttgtgaaaggggccagggtatcaccaggttgtcttgtgcctccagagcctaagctctgcccgctgcctgaccaccacaagattacttggccactgtgtggctggaggaattggtcaagtataggagcaggcgaaattaggaggctctttcagcagtccaggtaagaggccatagcttggaccaggggttgcagtgtgactggagaggaatggatattctgggggcagaatgaggatggggcagagaaagggaaatatgtgttgaaataaatagacatgatttatttggaccaaaaaaaggctttgaagtctcattttaaagaatttagaatctagaaaagaaacaaagtagtaagctaaagcaaacagcatgagaaagaaaataaaaatatgaacagaaatgaagtaaaaatcaggctaataagacagggttttaaattttaattaatatagtagagctactgaatgagaaaggaaatataattattataaaagaaatctgtcatatgtatggcatattatttataactcttgctgaattagctaacccagctgaaacagatacttagatagcatgagataatgaaattggtcaacaatttattgtcgtaaaatctgatatgcagtctcctgccctgcatgtggcctaccctttcacttgctcccctctcccttccctgcctgttgaagtctgaccagtcttcatgaccctgttcaaatcccttcctagcacagaaaaatgaaaatcattgacatgaatacatggctattttagcccaaatcaacagttatcagcgttaaggatggccttgaattagtggaggcagaggttaaattatggacagccttctctgttgatggaagcaagtgtgggcttaatcttctttagaaatgttttcatctacaacagacatttttttttaaagcaagttttgacacttttaaaggcatacaaaaaaacaattatcttgaaacttttgtcttatgggtcatcagcagggttgaataaggtcagaatgaagttatctgttggcaaattgaagttgtaagctttaggtaaaaacatcaaatacagctgctatgttcctaacttttactctcttgagaaaaggtgaatgacagtggttagaagtcagttgccctcaggttctcaaactgagagatgaggaagcctgttcccgatttctaggtaacacaactgcttctggtccaggcgtgtgtccccgaagcttgtatactgaccagggcggaaaagggcagcagaacctggagggcagctgacattgcccactgcatgcccatctccaggcctcccctcctcctgggagaagtctccccatttgtggagaacttcactattgggacagggctcactaccagcctgtgagacctcccttagagagtgagcagccattttaaatggtgccatgtgctttctgtgaggggactgggaaatttacagaacagtggcaaatgatgagcagagaagttgggcaaatgtggagtctctagccatgtgctgcattaggtattgccggattaccagtcttaggaaagtaatatggtttttctatatcgtgtgcaggccacttcagcttccttttccatatagagtctctcatatgaaaggagggaaggaaggaaagtaagaggaaagaagagaagacacagcagatctataactaaatgctaacagtagggcactcaatcattcatgcagacatgtatgcttcaacattactaagccaggacagggctggggcctgaggactgagatgaccaagacccagtctcaagtcactatctttgaccagttagccacatgttcacagataccgctgtatctagatagtatatgcagagtccctggcatagtatctggcacctatttggtcctcagtaaactctggccatcatggcattaccatcatctccatcatgatgagatattcatgcgtgtctgaatccctgatttggctcagtgtcgggtgcagaggtcgagatggtaagttggccaattgactagcggagcaaatacaattttttggtgctcaccccacgcaggcacctttcaaaggctcggagaaagcttctgagactgacctttgtctaaaacgagaaggaacataaatttaaaatgttataaattgaaaagccaatacaggggtatcatttgctaagtgaataaaaacagaaggagcttcaggaatttgggggaagggtaaattgtgtgggttggtaaaagcatgatgtgtattattaatctagaatcaaatcaggttcagagtttttgtttgttttgtttgagacacagtctctctctgttgcctaggctggagtgcagcagtgcgatcatagctcactgcagcctcgacctcctgggctcacgtgatcctcctgccccagcttcttcccaagtagctgggaccacaggtgcacatcaccatgcccagttaattttttaatttttggtagagacagggtctcacttcattgcccagactggtcttgaactcctcgcctcaaacagtcctcccacctctgcctccctgggattataggcatgagccaccatgcctggctcaaagttttaaaagaagtactaaccctttagccctttagcagtgagaaatagggagaacaaacccctccccgaggcctgcatttgcagcaccctcaataagttgcacgttggtaaatgtttaacaaccagctttccagtaaaaagtgtgtgtacaaatgcatatataagttaattataaacttcactgatataaaggatgtatagcacacagtttacaaataataataaaatatcaacactgtttattgtaaattccatatagccaatccattctcacagaatacttttgatactttgagctcttgtagccatagctaacctatggttagccatgatttgatgcgtggaatttcatcagtccactaaccttttcccaataaatttattgtcattaaatctgacatgtgatcactaaactatttttcatctttgtatctattaacccatttatgccggtggttgcaaatttttttgtgaaaaatcagaccttggcgatgaccttgagcagtaggatataaataactcccacaagcttagcgttccaataatggaacactaggcataactgggataaactgaaacctctttcagcttcagtactgagtataacttcattcaccaatggcatgagcaccttctttgctgatcgtataacagttttaaatactggaagaatattttcctttttttaatgttattcatgatataatgactacagacacttttaaattttacagactccctttaagtttaatctgcatcattgacattccttcatcattttcttaagtctagataatcaacagaatgagaaatcaaaccctgatttgcaatgttggttgatttccaagaagtaaatacccccactagggccaattttgtggtatccctgaacatggaattgggaagagcagcacaccattgtgtagtagtacttctgccatatagatgcagaacatcatctcaagaacgtagatcatcaatataagtgatgagttgtgagtattacctttctcagtataatttacttaattgcaactttgtattttaaattttaataataactgtatttaacaactggctccctgaatccctgaaaatttaacatttgagagctggtaggagccagttccaacacacccattgccctctttcctaacgagggtaaaagtctcctctttgggtgagtgagtacctttcgtcaccttgcccctcctggacacacaggtctttgttgctcacactgcctccagcagaaaacccacacacagaggctcctttctttcctgaatctcataccaagatgctgtggggggtttgacatggatcttgcctaagccttattactcacatgaatcatgacgtttaatgcatttactaagacctttccatctcacccttattttcccttatatcttaaaaaaaggaataagaaagagggcccatgcctggctataatagaggatagttatagacatatcacttgggcagctgtcaaattagttactctaaagtgttcaaaagttccctcctgatctcacctcctaaaagaaatccaaacgtgcttgacagggcggagaagtctaggactttcttttccctcaaccatgccacaacaacaaagagacacgattcctaatcgcaaaagcacaagcttttgtttgtgctaaccagcaaagcaaatgttcgagaaatttgacaaaaacaagctcctcctggctccaccctcagccttattttcctttcttaagcaatatccctttcacacagatgtggacagagtgccaactggaaggcgggaataacctgtctgcccctgctcccagggctgactcacagcagtttattttagcagtggttgataaatagctgatcccccaatacccctgccagtgtttcccatcctgtgtaggcagccttgtccccactggggcctgccagaccctcccataatctagcaacagcaagtgcttccagaccctgctgtggtatcagactggatagtgcctggatgttacgcattgttacatatctgtcacccctgcgtccattctttcaatcttggccttgagccacttaacaccctgtgcattcagcccctgcctgcaatccaaaccaggaggctcaggcccaccacgtggctgtgggacccatctgatttttggtttttcaatagagaagaacttagcagcttagaatgaggcaagagtctgcagaacccaaggccccttctctgaagttcttgccccacattttcagtcctgacatgttcccagatggcttcactcattcattcccacaccctaggtcttttaaatgggttaaaggacctgtgtgctctcacctgacctgaaaggccacctgtcccatgctagggcctaaccatctattggaccatctaaatgcagaccctgtgctcagctgggccttatgcctgtatctgcatggccctgaggccagtgccaccatgggccccccactccctgccaacttccttcactcatgttactctttttgccaccatcaacacttagccacactgccttgcttgccctttgggacttttttctcatctcgttctgtggcttctaaatctaagcaaccatttgaatctagcagttgttggaaattcccaactttcttactctggctgcagccttggtcctcacagaggtgaggatactagtttacactggggttgcttgtccattgaatcagaatcataaacgaaatgaaactcctttctccaaaagggaagagctctgcaaaggagctataatatgcccaatatctgattataaaatcaaaataaaattctttttacaattaacgtaaaatttttcctactttgctttgggttgggaaattactactatagttgagtagtgactcttttttcctcattttctttctcacctgtctcttgaaaaatattgctcacacatgttaaagaatttatattaaaagtgaattccaataaaaggcctattaaattagcctgattcattaactctttttgaaaataatgtgcatgtttaggacagtagtatctttcagtttttatttcatgagataaatgtgttgggaaatggagagagtacaaatagatgtgaatgtcattttatctaattgaagatgaatgctgaatttgggagctgtagaatttagtttaacttgccttgaaagagatttatgatcatgggatatgatgctttgtctcccaatggctctgccgttaaccgttcacctcttgtctttgtgaatccaaagaggtaacttgcaaggtggatggggcaagaaacaaggatgttgaagtttgtttggcaagtcaacagaaccaaaccaaaccaaaaaataactgcttatctgggcctgtgcaagttaaagtaatttgacaaagaaccacgttctgtcatgtgtacgttatttaggctcttgcgtcatttttttctgtatcaagattttcgagaatattttaaaaagtggagagctgttctagcacagttggtgctgcattgttgaagccaggcatagccattgtatttgaacctgttttctatcatgacctctgaaaatccattcccagaaaactgattgcttaggtcctgtggttacacccaaaggagatggtggctagaaatgagggctctgtcgtagccgtggtactgaaagatgcttccttgatggaatgttgccagacacgatttaaaaaattaaaaggtatattaaattgaattgttttgaatcgttttaatacccatagaagaagctaggaaaagctagagttcttaatgacctatttgaagaataaaatacacccgaacctctaggtcaaatgctaaattccttctgcaggtggaaaggctgcacctcacaagggaggccaagtttcatttttgcgacgaccttacccagctgaaactttcccggaatcttttatcattagctccccacccaaaggatgaaaaacaccatctgatttacagttttcccatctcttatttgagtttgcaactttcttggataacagatggccacaaaatgtgtaagcccaaataaaagcaaagcatgggcttcactggttcttcactggtatcagctgcttcttaaaattaaaattatgtaaatgataccttagttttaagtgagagaatcagcaatgaaggaagcaaccccagcacttgagagtatttcagtttgggttgtgtggaaggtttgttctgttttgttttgttttttgttttttgtttttttaagcttctaatgtttccttttaaagagaaataaaagaggcatttcatagaagcactttgcaagttgctcattcacaaagcttgcagtttcaccggcagccggcctagaatcagagagaatattaggattggcagagaccttagaggttgttgttttaactgacttgaagagggaggaaaagacttggagtaagagccccgaaaaaggccccggcctctctgggtttggcatctttcttacctcaaggagttaaaagtctgggcctgggcgtgatcagccagatggtctttaacagtaacatggttcatattgtttagattatcctgttgcaagtaccgtgcctcctttaccttttatggaataaagtgtggaaaattgaccacagatgtaagtaaccaagaatgacggggaagctgttgttaccaggcctctctgtttctctccaacacgcctgatcccacagataaaaataaggagaaaaatgtgaggctggccgagaatgagcttgccttacctcgatggctcaggtctgagcaccgcgagcactatgttctacgtgttcataaatccaaggttggccttaggacttgtgtgcaggctaccttcaaattctgattttccaagtgccctctggttaaaatatcataccacgtaagcagtttttccatcctgttttgaaaggcagtggggggcaaggcccacatactgacaccgaggagttttgcagccctgcgctccctgagggagagcagtgagtggcattttgcagcctgagaagtgtggataaattctgcattcccactgctttgatggctatctcagctgcaggtcccgcctgctgggacccccagtacttttcgtacttaccagggactctggcgcttggtccctatcaaacaggccttctctttcccgggtgagtttaacagcctccctcctgacctgtctcccagccttggagttcctcctcagcttttctggctgtcacagcccccaaccatgtgactttgctcccatggttcatggcttggatcattctatgtctgaacacatagtgccctctgggcttccccttcttgaccacagtcctccacctcctggtctcttctactctgtaactcccatgaagacttgctctcagcctctagcttctgggcctctatccttccagaccctcccaacccagcctggttatctgttgattattctagccacactcacagcatcctcagtggcccccactgccaatccccaaccccttttgttcttactgctcaaactgagcagtccccaacttgaatcaacccagaaggcatttttaccgagcctgctccaggtctgaagataatcacttagtctgcctaagtgacttggttacaaacccccagcttctaacataaccccagtcctcagtccgccaccccacacaccagtcccttctcaatcagcttctttcctgcccgtattcaccaaatgtcttgaaaactcacgtatagataaggtgctgcttttttgcttctattcatacaccaaactgccgtctgacttgtacacccattgaaactgttctggcaaagtttacctgggacttcccaatttccagactttctttcctaatcttacttgatctctctcttcagctgcctgcttcttgaagctctcctcttcctcagctgtgacaggtgttgctcaaggctcccccctctctctgatcacttgttccattttccccactgactctcccttttcttcttaaaaattattcctcccttagttcccatccttttccccttctcctgtcactccagccaagatcctgattccagaacatggggaaaagtacagagggttgaccattccaaagctgcttctgaaaatatccctgtcattcaacacagatgagatgtgaaacacacagatgggtgacagagcttccggtctatttctaagtcccaggaccgaagagttcttgtttttgtcatgatagcaagtgcttgtgtttgatgctccaaatagccaaacccgtggaattacaggggggtttgagctgcatgttgagtgtacaaactctcataggtcataaggaatgatgagtgggtggttcctaaactctggagaagagcttccatttcaaaagctgggctgtgcagtggaaacagtgtagggtttggagttacacattaaatttagaatccctctctcctctcaacagttgtctgattttggggcaagtgacttctcctggctatatctctgtttttttgttgttgttgttgttttgttctgttttgctttgttttgttttttgagatgaagtcttgctttgtcgcccaggctggagtgcagtggcgtgatctcggctcactgcaacctctgcttcccgggttcaagtttccggattcacctgcctcagcctcctgagtagctgggactacaggcgcgtaccaccacacacagctaattttttgtatttttagtagagatggggtttcactgtgttagccaggatggtctcgatctcctgaccttgtgatccacctgcctcagtctcccaaagtgctgggattacaggtatgagccacctcacccagcctctgtttttatttgtaaaatagatagcaatatctccctcttctgaggattagggataatgtgcatattaggaacatactatttgctagacttaattcggtaggatgattgagcccatatagtgaaattctcttagactaattataaacctgacaactcaccaaaaattttttattaacctgtctcatacactggtatcagagttgaagggagagaattagcagaactggttgctggtctcagactacggaaactacacacaacacaattagagcccattcagtaacagtctcccatcaaggtctcagtggccttgggaagtaagagtcctggagatggagagagatctgtgtgggccagagcagagggacatgtgacaagtggcctaggaggacttttggctgcctgtataaagtgagtaatgagtgataaaggcttctatgaaagttaggggaactaaaattgatgtcagaggccacagggagacattgagtattactgagggagaacaccaagaaacagtgttttgggaagatcagtttagcttccttttatatataaggcatttttgcttgggaggatgggggcaggaagggtattcagcaggttgttgctggaaccagaccctgatctgaagaagtgtggggttagattgggaaggaaaggatggaaatgcaaactatttcaaaagaaaaaatgattaaaggtactgatgataaatttggtattggagatgagagcaaaagtggcttaagaacaactccagagtttcaatgaaacttgaaatatggggatactatgaaaatgaaagggaaacttttttgtgtgttgaagtatacattacataaattttgctgttttcaccatctttaagtgcccagttcaatgtggtatcatcaccaccaagggagaaacttttacagcaatttgacattgttgcaacatctgagcatgggattggcatgctagtattttgtgttataatccaatattttatagtagtttattttattatatttttgcaaagtatcagtctgcaattatttggaaataaaaagaaaagaaactggtcctttacttcagagaacttaaggaaccctctcctagaagaacaagaaaggactgcagaaagaagaggtgaggtacaagaaggatatcctctccctgcctttgccaggcatgtgcctattcattctgtgaagcccaactcctgggtccctccttccaggaagccttctcttccctacatcctccccagcctcctaagcctcctatcacaagttaattagcctttgtggtgctattgtgccctggacgtatttctattgccagcatcatcacagtgtatgaactggccatcttggcagtcttctcactagaatatgagctctgtgagtaaagactatggcctcttcatctctatatccactttgtcttgcacatcttaggtgctcagtgaaggtttgttcacatgaattgaattaagagagcagacttagagagtggatatagggatgatgctatgttggggttgggggtgggaataaaagagcatcaaggctgtgcttagtgtccaggtctcctttgggaaggaatcagatggtgtggggaatacgctgaagctgaagacagaatcaggttgagcagcccatgtggggaatgtgcaggggaggcagagagagagtaaaaaggaaaggtggcagcttggtcggtgcttcccattcaccccgtgactttgtacctctgctgaagcattcatcatggagttgcatcaatatccaatcatcagatgtacttccaaccttgtcattcattgtcttagtctgtcttctggttctataaaagaataccatacataggccgggcgcagtggcttacgtctgtaatcccagcactttgggaggccgaggcgggtggatcacgatgtcaggagatcgagaccatcctggctaacacggtgcaaccctgtctctactaaaaatacaaaaaattagccgggcatggtggcgggcgcctgtagtcccagctacttgggaggctgaggcaggagaatggtgtgaacctgggaggcggagcttacagtgagcagagatcgcgccactacaccccagcctgggtgacagagcgagactgcatctcaaaaaaaaaaaaaaaaagaataccatacatagactggtttttggctcatggttgtggaggctaggaagtacaagattgaggggcttcatctggtgaggagcttcttgttactttatcctatgatgagagagcaagcaagcacaccagagacaggaaatcagcccaaactcatcctttttatcaggagtccactcccaggataactaatccactcctgcaataatggcatttatttcatcatgagggctgagccttcatggcctactcacctcttaaagtccccaccttttaatactgttacaatggcatttaaatttcaacatgagttttgaaggggacattcaaacatagcattcattaatttattcatttattcaataaatatccactaagggcctactttgtctccagcttcatgctagagacttgacttttattgttcctaacccctaaacacctccttaaagtaggtattattgttcccattcatagttgagactcagggaggtttagttatttgcccaaattaagatagtcagtggcagcattaggttttgaacccagggcttaaatccctcctgccttgtacagtgccacaaggttggcactcagtaaacatttgctggatcaattccaggaaaatttggaaaccaggatgggaagaaagaggctctttgggattaaaaattggcccagcagttcagaggaagattgaggcaaaatggtgttagggtaggtactgtagtgcctgggatggctcatgtcttcagaagggcctaatgatatgggaaagagaggatgcatgaataagactgtgtttgggatggacagtagactggtttgggaaagtgacagaggagaccactagttctgatcccaggggcactttaggaacagtaattcttttggagtccctctcatggtttctgagctgtgttcttttgattggatgcatctcactaggaatatgagggtgaatggggaaggggacaactccttggccagtggttctactaattcttcccccaaacgacactgcaggagagatgaaaagaaggcccagctatctctatagactttggtatagacactgtcccttcatttgccactgaccttccattacctcctgtggactctgcccgtttgattcagtcctccagcttgaatcaaagatggttgagacattattgaattaaccaaagttgttcttagtgataatgggagcatgaagtagatgtctagcctgactcactcatcacccccattctttgggaatgatggcacccagaggcccagctgaagggacaggcctgggttgccatgtttgagaccttgtttggatctctgactgaagaccagcaatccgtgtcactacctcgcagtaaactccttgatggttttcccatattggccctacctgtgttggcccatgctgctcctcccaccccacttcctatcctcctccctctgctttctctgccccagctgccctggccttcttgttccctacaggagcaaagtacatttacatttcaaagcctctgcacttcctgtttcttcttcctgaatgttccctatgtatttgcataactggctccttcactccagcctctgttcaaatcctccttatgcacaacccttcttagagaggcctatgaccacctgtttaaatatagcacttcctggttctctttattcccatcgccctattctgctttctcttacaacctgtcactgctggcgtagcatgcatgtttccttgtttgcctttccattgtttctctccttcactagaatataaactccctgtgagcaggatggcatcttgtttattgctgtatccccagcacctggaacaattcttgaccattgtatatgctcagttaacatttgttggatgaataaatggccaacgaccaactggccattcattccaaattctcagaatttgaagtaaggacacagtggcttttttggtcagtgattggtgctggccccgtgagttcagttagggttggggccagcagtcatatgtcatcacagataagtgtaggaagccggtcaagatcaaaagagaagctaagggggagagtccaggtggccggtggagaggttttgcttccttgggacttctctccttcccactggggcctggccacatttgggttcctgtgcccgtgaactggggctctgtattagttttctaatgctgcgtaacaaattatcacaaacttagcagcttaaaacaatccatgtattatatcccagttctataggtcagaagtccagcgggttcaactgggttctctgtttagaatctcacaaagctgacgtcaagttgttggctgggcagggtttttatctggtggccctggaaaagaatctgcttctaagctcattcaggttcttggcaaaatttgtttccttgcattgtaggactggagtccctattcccttgctggccttggccagggactgttcttacctccaaggggccactctcagctccttgccatagggcccctccatgtcagcaacagagaatcacctacaaaacgaatccctctcatactaagtctctccgacttcctcttctgctacctgcttttaaagggtaagaatgattaggttaggtttacgcagatcatctcctttagggtaactcaaatcaaaactagtacccatgattacatctacataatccctctatcaggtaacctaacatagcgcatgatatctcatcacattcacagtcccaggattggagcaggaaatcttaaggcacaggattttgcctaccactgtatttttaaacaatctcctttaattaattagcttaggggagggggattctgtttcttacaactaaagagtaatggcccataatccacagaggccccagccttgggggtggaggtggggctgaagttacaaactttgcgttcctgacctctgctaaattgtggttctttatttttcctctagaattgagttcagactatagagatgcaaaagattagaccatctgccatgcttcagatgccaaaaataatgaaaatttttgcctctatactctggtagaaaacttttttttttttaattgcttttccttgcagatcactctccaagtgagatcattggtgatcctgagccttttcccatgacttaattgaccaagagaagaccgcccagctaaatctcacagaatacattcgggggtaattggcttaaagcctccaggatcttgttaaaatgagtggttttggttaatccacaccataaagccgaaaagctattatgtatgtatatttttgtcctgaggtattatcaagaaattccacatagacgggaataaagtatggtttgagaatgaaaaaaaaattaaaacgcaagacataaactctatttcctacagatgtaaatcagagcaagttttaaagcctttttatgactcagagagaggtcaccaaccaaatctgctgagggaggcaggattaaacaaaaacgactatattttaatgatttttccccctgctgctgttagctctttcatttgcccaatgtaacacaattttccacaacgctgcaggaaattggagatagggaattgctatccagttgactgcctagctccacaaaatgtatagtaatagttgagtgtcaaaaaatagcatgtggtaagttggggggagttgaagggagaagcttgctttgtggaaaattgccgacaggtcgaaggattgtggggttagagagtcagagagactcagagttggaaggggccttgccccttgtagcctaccaatccaaactttacttgatgcgtggaccagttcagcagcatggaggcaggaagccatcagctctacttaatcatactcttcagagcaagtgagaagtagcgaggcagcaactatgactgaggataaggagtcctggacagggaggacctttgggcagtgcccgatgctgctgtccagctgaacaaacttcttacctcttttgagcctcagcatcaaatggagatcacaatacctacttagcaggattgctatagagttaaataagatgcatatgtaagctttgggaagcattaagcaaatgtaaggtatggtattcatactattaacaggaagaaagtgagactctaacttaggatggtggatggccagtgcctgaagaaaaggtatgtggagcccaagacaggtattgagagtgcagcaaaagactgcattttcaaggtcaatagctgtgacactaggagcttgaggctgctttaaagagggagatgtggaggagatgtagggcagaagtctcaggtacaagacaaaaagccctcattgcttggctgtccacaggtacattgactaagctcttaggggtgcagcctaagagcagagcccctatgatctattcaccaggcccactgagaatccaggcaccatgagaaccgaggggaaaagagcctccccacgaagcttcaggagggtagaaggcagaggctgctacacataaaataaatgacataagggcagtttccaaaagccatgggacaacgtgggatgctatatatcaaggtgttttgtaatgtttgctgacttgacttcctttttttttttttgagatggagtctcgctctgtcccccaggctggagtgcagggtgcgattttggctcactgcaagttccgcctcccgggttcacgccattctcctgcctcagtctcccgagtagctgggactacaggcacctgccactacgcccagctaattttttatatttttagtacagatggggtttcaccgtgttagccaggatggtcttgatctcctgatcttgtgatccgcccgcctgggcctcccaaagtgctgggattacaggcgtgagccaccatgcccggcgccccccttctttttttttttttttttttttgagatggagtctcgctctgtcgtcaggttggagtgcagtggtgcaatctcagctcactgcaaccttcgcatcccgggttgaagcgattcccttgcctcagcctcctgagtagctgggactacaagtgcgtgccaccaagcccagctaattttttgtatttcagtagagacggggtttcaccatgttggccaggatggtctcaatctcctgacctcatgatccgcccaccttggcctcccaaagtgctgggattacaggcgtgaggcaccacacctggccaacttgacttcttaaaagcatctgtcacacaccacttcttctcttgggtgacctgtttcccctgcaggtgtaggattcaaaggaactactgaactcttggcttttggcaataacagagttaagtatattcattcatgctttttaagtatattcattcatgcttttattttactgatactttctcaaccatgtttctaggctctggggattcagagatgcagcctagtggatatcagatgggaacatgaggtgcttggatggaaacaggtgtagcataatttttgttttcccttgcctgtacccttaggcaatatggccaccattgctgattcctgctctgaagactttgcttctgggcttgcttcttctcctctaccttcaagttctaggttgagccctgcttcttctccaaagccttaccagtcctgtcaccacttgcttgttgtctgtgctcccattttactgccttactatctcattcctgtttgcctcatgtcattttcagcgtgcctttgtagtactgaacctggctccatgaatgcttgttgagctgaatcttgaggtcctcacttcagacaccatgtggtggcttcagggaggcaggtttgcagcttcctacccaccccctaaccccccagcatccctttgctcatggtttcctcacagagaggggcatgttgaggttggccccaaatggtaaggatttggcagaagcggaatccagattgttaatgggaacacacaggaggacatcaggcagtgctgttggtaagaggtgggtcagtggaggcattgcaaaatcttccaaagagcaccaaaagcaaaattcaaggacccagaagaaatggatagcccataaagatgggtgttgagggccagaacaggcagcttagacaattaatactcactaattcatggtgatgactgaaccaatccttatgtataatactcagcccagtatatctttctttgcttttcttttttttttatagagatatagggtctcactctgttgcccaggctggagtgcagtgacaagatcaaaactcgctgcagcctggaactcctgggttcaagtgatctgctcacctcagcctcctgagtagctgggactacaggcatgcatcacctcacccagctattttttaaatttttttgttgttgcccagtctggtctcaaactcctggcctcaagtgatcctcccacctcagcctcccaaccagtttatcttaaatgcattatataatctctggtattctggttgcccctgaaggaagaagccactggttattactacatagatgaacccagaggcatgctgagacctcagcgttggccctaggggaaaagaaagcagctaggacagggtagaaccaagactggaattcaggatttcaggtcagcatgagcagctggattgctgtgcctggtggtctatctggagtgtagcaattctgctgtccataggtggagttgagagggcttgtcgtataaagaaggggctggcaaagtagccaagtaggcagtggtctaggggagggctgtacttctaggaggaactagatttttaacccttgagtgcacagagccaactgtaatggggtctggggaaaactaactctgattgtatatgtacttgttcactgaggcagcctgggtactgggtatatgaggaagggtccccgctggacaccatggcacactccaattgattaacataactacagtttaataaagggtttgttcacataggaatgggctaagtatactctatcctggggctgggaactgtggggagctgttattgctcctaagcctgaaacgggagggatgtgaatggttactaaattccaggatagagaaagtggtgtggggagggccacccaacagacaaggccaatgacctttgatcatggtgaccttacagcaggggaatcaggacataaataccctgattgtctctcccctctctcccagatttcttggggtacttcccattgatctaatgggagctgaggacagacagcaagtgtgcccactgaaacatggagaggggaacaaggtgggaaggcctggatctagaggggcaaataccaggctctttgtaacataactaattctggatccttccttctggtaggaatggctgtattgccattctgcctgccctcgtaaggttgggctcaggacttgggtgacattgaaccttaggctaaaaagctctattgcttagagttgataggggctgaaaaaagcgggacgtttaaaataacagccggctccatacatatgggggccatatgtccttaattttccaggaaagtctcaatttcaaatattctgtcccattttacccatgagaacactggcatttgtcagatcacatgttccaatttttgactcagaaaatatggtcagtgtatccctataccgcaacaaatgccagatggtttaaagagctaattttttaaatagtattcttatcccaattgttgaggaaagacaattttctgactattgaagcaattgaagaaattatcagtgacaagtttgacgggttcatttactttaaaaaaaaatacacacctttttttgtacaaagaaaatcaacaaaacaaaaaggtgaaaagagaagcaacagattggggaaataattgtaataaacatgacatctaaaaacataatatccaaacacttcgagggagttttagaaaaatctgagaggtcccaatcaagacttcattggacagatggtcaaaggttatgagtagacaattcacacagctgtacacaaatcctagggaggtaagttaataaattcaagttaaaacaactgtgagttaccactcccacctactacaatatcaaaaataaaaagacctacaaaatctaacatgggcagagatacacccatacactcaagaaggcattataattttttttccttcctagagaacagtgtgatgatatgcaaaaaagatcaccaaatcagtcctccactctgacccagcaattctacttttagaaatatatcctaaagtaataaaaacttacatggagagttttacctagactgcaacaacccaatggccaacaattgtgtgatgacttaaatatattaaaacaggctaggatcaatgaatattattaaaatatcaaataggttcactttgtaagtatgtggagagatacactttaaatattgacagaaatacaataatatagcagtaatgattgtcatcatgtgaaagctagccttgtccaattataaggatcagatgagtctaaattttgcagttcattgctttcctgtggtaaaagtgtattctgtggtttctggcccgttgtttcatgattgttggtttcgtacattctcaatgtagccaggttttccataaaaatagagaaaattaagaacatggctatgactcctataagtctataggttaagtctcagggtaaatgttggttgtgtctttagaaaaattcccatacaggatgagtaacttcttccaggcctgtgttatatgcttggctctctgtctcctctctatgtcctaaatgtgactgatgagcatgcccaggcacctggctgtaacaggtgatgaggttccatctatgtgttactcaaaccctgtaatgtagcagtttatacttgactgtaaaattgctcaggtcaacccatgtaaaggtcaatctcatgacacaaccctgccatgtctcactgtagggaaaagccagtataatctctagtgtattttttttggtggtatttttaaagccttaaatgctaatcttaaaagtgagggtggggtcaggagaggagataattcattatgcaaatgtgatgttttcaaataccttgccctgtgtccctttcataaacagcaccccatcagggctggtgtgtaactcaccatgggcaatccctggcatacctcatgtcttcagcagagagagagagggaccagagcgccttgccgagccccgagcccggtagatatggtcccagtcagtatgggtgcattgacttccttctgggaaatccaagtctcactcatgccttgcttgctgggacagcagctcccataaagttataatacttatttgtactcagctcccttgagagagtttggagaacacatttcatcttctgtgtgacctgaattttaatagtagaaaaaaactgggagaggatgctgagagcagtttgtatgaatactctgagtacagtcactaaccctgaaggtagatgcccaatatattatcaaaatttataaaaggaagaaagaaaaagataaaaacctcgtagggttccaggcacccatcaaaaagaccactcccagtgttggggaatgaacatgaggtttgaagtcagtaggacccctgttgagggccctgcctgatgctttgctggctctttgaacttaatcttctcatacagaaaatgttaatgatgatatatctacctcttgggtttgttatgagttaaaataattgtttaaagcaagaaatcaatgtctggtacaaaataaaccttcagcattagttctcctctctttccctcacctgtcaaggtatctttcatataggaggtgctcaatttataatgtgtataaattacaattgaatcacgtgcagggctgacatctgattaacctaccttacagtagagataaccaaaactcagagattttggtcgtgttgcagcatggccagttacctacaatggaatgaggaaggcggggggtcatagagatctgacccttctgccaggctaggattgcactaggattgctggcctgcacgctaatggggaagatgcagcctggccagcatgggtgcagccgtgatccttctgagattcaacagcaacacagaaggatccaagacaaagtagtaggatgtttccaagggcagatgagtgcggcagcagttggatgggatgatgctcagatgtccagaaaggcaggcttaggacacccaggagttgtagctccagacattgggtaagggtgcttggcaattctctgggatgaggtgctcagcagattcttggacagggattcatcaacagggaccaaggcagaacttcagttataagaacgtgagtaatggattagaactgtcgtttattggaatgaagcagtgccctgggatcagacagtgatgctgttgagcccgagtcagcctcaggtcaagatgtgtcttagaaaatgaggcagaactgagttacagctgaaggtcagctggtccctgtcatggggaggggatggaatgggatacaacagctggaagccagggatcattgtctatcttgaaagcagactcactactacttgggtaacatttagactcatttccagagatatcagcagacgttgctccaatgttctccaagttcttcagggatgacctaggttctctgtactctctcccttctctctgtctgttatctcttcccagcttatttaaaccactgtgagttgacatttagctaagaagctttatcagaattttagtgagaggaaggaactgtttgtaatggaaaataatattcactatattatagttgctttaatttgggtttaggcatgatgtttgttttgaaatttcaatctcaataaaaagatttttatgtttaccaaaaggggcatttatttatttatttatttatttatttttattttattttatattttttggagacagtctccccgtcgcccaggctggagggcagtggcgcaatctcggctcactgcaacctctgcctctccggctcaagtgattctcccgcctcagcctccctccacggtagctgggattacaggtgtgcaccaccatgcctggctaatttttgtatttttgtaaagacagggttttgccatgttggataggctggtttcaaactcctggcctcaagtgatccgcctgcctcaccctccctaagtgctgggattacatgtgtgtgagccacagcacctggcgggacatacatttaaaatggtcatgaagcaccatttaaggctctgtcttctaaggaaccttccctgtttctgtcaatgagttcccttcatggacttactgctgctcttttaccacaggttctagctccgcattcttctttcttcctctctgtatgtggtacttcccagctagatcagtagttctccatgggggtgactttgctcccaccagcctctcctccggggaacactaagcaatgtctggagatatttttggttgtcacaactgtgggagtgggggattgctactggcatttagtgggtaggggccagggatgctattagacattctacagtgtgcagaacagccccccacaacaagggattatcctgtccaaagatcaatagtgcctctgttgagaaactctgagctagattgtaagcatattatgagctgatgtattgtcttaggattctactccccagattcttgcaaaataataatcaccactagcgactaacattgatcagatagattcttaccatgtgccaggtattgttccaaacccttcctgcatatttactcatttaatctttttcacgaagaattgttgttatcccattttactcaaactgatcattatgggaaaattgtaacatgagaaaactgagacatgagagagttaagtaacttgcccaaggtcacacatctggtaacagctgaagctacacattagtactaagaataatagtagtaccagtagaatttttattaagtcaagatctttgtacatattgactcatttcatctttgccgccaccccatggaatagatattctctaaatctatttcagatatgcagaaactaggacacagtagaactttgcttgtatttattaatttgtgtatttcttagattaatgtctgttttccccactgcactgtaatccaaagaatgcaaggaccttgctgatctggtggatcttgtgttaaccccactattgagctctgggtctgccaatactacatatgctaagtgattaagggaaaagagaatgaagcctcagggtgttggatgcccatgtgtattagtcagggttctctagagggacagaactaataggatataagcatacatgaaagggagtttattaaggagaattgactcacactctcacaaggtaaagtctcacaataggctgtctgcaagttgaggagcaaggaagccagtggtgggtcagtctgagacccacggcattcagtctgtggccaaaggcctgagagcccctggcaaaccactcgtggaagtccaagagtccaaaaactgaagaactggagtctgatgtttgagggcaggaagcatccagcacaggagaaagatgaaggccggaagactcagcaagtctgctcttccatcttctcctacctgctttattctagctgtgctggcagctcatttagatggtgcccacccagactgagggcaggtctgcctctcctagtccactaactcaaaatgttaatctcctctggcaacaccctcacagacacacccagaaacaatatgttaccagctatctaggcatccttcagtccaatcaagttgatactctatgttaaccatcacaccctggaaggaccagttgaggcctagctgtggcttggtcagtgtgctgtgtttttcttgccctgatgctttcctgtggctctttctttccactagacctcaaaactgccccatgagaggatctggtccttatcactatacagggtccccaaactagtggaagtttattgagagttctctggtttctcctggggcttgtcaaaacaaggagagcatctcatctctagcagctaaaagctcatgagtatgttaaaccccagattttcaggcaccttcgaaagccttatgacttgctctcagaggagggaagggttttcctgctgctggatactcacgtccctacctaatgaaatttgatgacacatgaggctaggtagagatgcttttttttttttctgtctgatatctggatattttcagaacctagataattttatcctatttatatcaaacatgcaggtaactctagacttttatatctgtattatttctggggaggtataatatgattatgaatgacagtaattgacattacatgctttaattaaatttcctttgccatgaatcaaaaccttttagttcagtcctacagtgctatttctagatttctcttttacatactctaatgcattaggcagtaggtatgataaattcatttacaaagtctgcatcctatagattaaatgagataatgtgtgcaagaggctcagcctaacagttacataatagttattaatccaagaatgttagctaaatttgcatactctgtaccttttagccattggctccttgaagaatatcgcgcttcttagctgatcatcataaagccgatggttatggaaagagcccctttctcaaatgatcatgggtagcatagtaattacatctcgggattcctccttctagggcttttaggggatctgtggagacttagagttttgtccttttccaaaagggtgaagtaccccagatagtctcctgccaccaccaccctgcagggctactccagcagggtgcagatgaactggtcccggcacctgagcaatccatttagcccagggccagtgctgctcatctccctgccttatatgcaagcggaaacaggtatacggttccagggcctgcctccaggcagggcttagcattaagccaaccaagcagcaaacccaaagggccagaatgacagttattcaaaaatgagaaagttttcttcttttccttaatgcatgcctaagattacacacttgtgcttagaaaagtggatgtaaatgccctcctctcctgtggggagagcctgtcctatcataagagacaacctaaactagtagttagatcttcgtgatctagtttaagttatctcacctgataggacaggctctccccacaacaactgagaaaaagctttgagagcacagcatagccactctgtgtccagtgtggccttggggtcacccagctatacccacaatttacctctgcctttgtcagatccccatgaccttgagtctgtgagtcagctaagaaatttcagatcccccaggtgagactcttttctcagtagcccccagcatttgagtacccagcccagccttcacccctaccctgctctacaggtaacttataccccgaatgagcagaaacaagcaggcacttcagatttcaggttgccaagaggcgagaggcagaatcccgcttgctttgcagcaggtctgtgagtctccagtggcatcgtattaaattatataggcagccacttgtttgcaactgacgcactgagctgagagttgtgccgagcaggaggcattctcttcgggaagcatttgagaagatcctatagcttcacagacctccagttggtctgaaagcagaagggtagaaaccacagggagggggtcagctctgggcagaagatgccatgattgccatgaaatcctagaccatgggctgcggggcactttgccctcaaggtaggtcagagcctggacaaagttgaacgtgctgtggtgggagcgattctttgttgggggggcgccctggccacctcccagctcgtctctggggtttgagttgagatggtgagtgctcctcctcttgcatttgaagggtttttatatcatcctgacctgccttattgtggctctgttgttagaggtagctatggggggtaggtgggggtgtctgatatttagagataggagggaaggggtgaagatgaacaaagaaatgaaggagtaaaggacttgcggaagaaaagctctacctaagtttactgcttgctgttctgtgctcctacataatggtaggattctgaaacaatacaaagaagctttgggcctttgtgagctgtgagcctgctacttgcttttcctaagacctgacagtgagctccactccatagctggagtagagagggtgttgtcattctgattagtgacggtaataggaaaagtacaagtatcttactgtaagagctcctaatcagtgaaggctaataggcctttccaattctcccacatagtttggaataaatagattaaaacagaaactgaggtgggttttattgatgtgcacataagtttttggcaagattttccattcggcttccacccataggttaaacatggttttgaaaattcatatgtttgggttgatggctgagctgaaatgcctccctgtagattttgacaggttaaaggttacattggtttgggctcattgattgggttctgaaaacacacataactaataaaggaataaaaagggtggctctaagcaaccttcagccacagtggagcccaagggatggccatggtgagcgagccctcttggttcccctgaagacgtattgtgggggacacagcatctccctggggtcctttgtgctgtcatcacagattagcagccccttcctaacggatgaatgtataaaccacaaatccactcctttgccccttccaggaaggcatttgtattgaaggtcacagccagagaagacagtaacttggggggaaaacaggagactttgagggatccagaggtcacaagcaacccctggaggctcctcagcagagctggtgtttgcccttggatccaggaagtgggcggagcagatatgaagggaagaaggtggtgagaggaccctgggctgctactcatagaaaagagccctttcactgtttcacctacatttcagtggagaccagtgaagatggatattttctccaatattgactaaatagtataatttttttctttacacaaattgccacttaatgtaatttgttgactttccttaggggctttgatagactttcattatggattttgacagtaaagtcattatatattaaatatagtaatctgtgcttgctacattagttgaatatttttttcagatggacattattctgagtctgaaaagcttcttgctttgatctgcctccttatgttacaaaacaagcctgtgtgtcacttctgctttacccccgcaatccagttctaaagtatcatttaaaaaaaaaaaaaagaagaagaacttctgactgtggaaaacttctaacaattacaaaggtagatagtgtaatacactaccaatgcacccagcagccaacaatgatcaatccatggccaatcttggcttcattcacacttcccatctgaccctctgcccctgctggaagattattttattattttgaagtggttaccagatatatcattttagcatatatatttatagctcttaaaaataaggatcctttttaaaaaacacaactatattcatgtaaaaaaattaataattccttaacatgttcagctattcagtctcatagttttgattgtttcatcaggcatgagtcacatgcccaacttattatttattgtttttctggtttgttagaatcaagattgaaataaggcccatgcactgcagctggtggacatcctgtcataaaatatatttattaaagaaacctgtagagttttccacagtctagactttgctacttgtatcttgatggtgtcatgttcccctgacccctgcatttcccaaaaactgatgggtagatataggactgatggtggtgtgtctcttcagggaagatggggaagcattacttctggttgtctctctttttgtgatgttaggagctattgatgatcattgcctagataattaatccattagggatttccaagtggtaatactctcattcattaaacatttcctcattaagtatttgaccagccagagatacatttcgatttagaaaaacaggataaatgttagattatttccctttatttaccagttttcaaaatgagtgggtttcctagcatcctccagaggtgagtagcaatgtgttatatattgtttttctagtgtcattattaactcatggatttaaatatttttgatgtgttttggtccattgctgatatccttattgatgctcaaatttttctgtccttggccattggaagcctctttgatacaaccctatctagtagaaatctattgcttactggtttctagttccaggctcttctcatctattttttgttctatatatttttagatctaaaatcagccatttctccaaggagctctgattgcttttagtgggtaatagcattcatatttatttagagaccacagtccaggtgctgtgagaattgagcaccattttttttctgcttcttgccacctctgaaacttcatctcaacacagtttccactatcagcaccaccacccattacagcccccaggccatcaccataccatcttcatctttcctcaagtgtccagcttccagactccattaacacctgtaaaatattccttctccagtctgcctgggtactttcaccatgccacctgttccaaaatgtccttcaatgtcatgaagcattgtgtggggcttttctagtccctttttcaccttgctgtctctttgcatctgtttgaaacccaagacaaggagatagatgataatttcttaaagtctcctccagttttgtttttgagctctgctggcttgccaagtcattcttattccactaggtcatcactgggcagtccttccctccctcccagtatgtatgcgttgttggcatgtactgagaaaaggcagggaaagggtaaaccaagagttagaggatgcttacgaaggcatgcactactgtgctgggcatttcgtatgtgccatgtcatctacgcttcattataaacctgtgagctaagtatcatgattcccactttagagggggaacaagttaagtaatagtcagagctgggattaatccaagatctacctttctacagagcccaggctaattcaaactgtatcatcagggtagtgtacatcctatgaagacttctgcttgaatggatccattagggaacctgttcccagccatcctacagacttgcaaaactctgcttgtatcttgtggctccccattgctttcaggattaaactcatacttggtatgttctggcttgtatggccctgacttaactctctaagggcactccacagttccattaccctccagcaaaccttcccaaaaatgttccctgttctcatgtctccagcccttttgtatgtcttgttccctcttcacctggtgaactcctaatcccctttaagaagcaactgaagcatgtcctccctcttgaggccctccctgatttccactttcagatgacttaagtgatatccccaggctcccatagagtactatgctgtactctggggctggttcttactcatcccttttaccccaggacacagcacagggcctgacctgggaacattggtcagcaatgctgtcaaatgcacatttaaatgaatgagtctgtaccagctaccccacacttgctcacatgggtaaaatgttatcttctttgaaatggtttttatagtttcttatggcctttgccactctatgcttatattgtgcgtgtttatttttgtgtacgagctaaattatgcctagaagatgcaactggaatgaggctctcatcacattgccttgcccacagtcaagactgaataattatccattgaatcgaatcaaatggaaggttgtacaaaaggaagctatagtggaagtgtcaggcatgcaatcagcagaacgtcagacaggcagttaaagcatcttcgatttactacaatttcttttaataggttctctgtacagatttgctgtcaacatgaattgttggtttaggaaaaaaaaatcagggtgctgcaatgggtctgtgctgcacagtgactggcaatgttttgctgtttccaatgcagtagtccatggatttccagttgctgacagggcttagtcattcatgctaaagaggcctaagttataagcaaaaatgcttcacagtcagtgtcctgaacccctcctctcagaaccagcacttgctcaccctctctgcttcctccattgctgcctcagttcctcagccttccccattccagcttcttttcttaaagcccagaccctctgatgattaacgtcctggctctggtgtagaagggagagctgtgtatttgggctggaaggggaagactgctcagggccagcatcaacagaccactcatccattcagtaaatatgtatttagcatgtgttgtgtgtcaggtcctggcaggacagtggtgcacaaagcctcagtcctcttggaccactcaaaatagtggggggagacaggttgtccttcagatatgcacaattgcaaactgtggtgagtgagatagaagagtagagatctgtccacaaaagggtctggcactgcctttgccatgaagccctccctggtcccccctggcagtgtgaggctcacctaggggtgctccttcaccactggagctagaccagagtcggccctcagcccactgagactggggtcatgtgtgactgtgagctcctggggccagggttcattctttcctagaatagtgtgtggcatacagtaggtactcaatcattctgtaagactgggaggaaaggaatgagtacattttccaagtccccattccatcagatgaaggggtcactggctttccccagtgctgtgatcacgattgtattaacatgacgcacaagctccaaaacttcagccccgttcccaggaaggtgtctcttcccagaagagtcgtaaagcatgaaataatgaatggacagtcctcggcgcagggcctggccccaggagttttctcaggacagtgtcataccctactgagagtgagctgcccagccagcatggcctgcattttctcagaccagacctgagccaggctagggacaggactgacatcctgatcatctcagcagcatgggcttgccatagagttgggactgaggaaatgctgtttttgcatggcattggcctagtgtcatatatgaggaacaggattctgcaacctgctcattcttggttgcttcttccttggaggaaaagagcatgttctgttcccggatttgctcctaaaaatatactaactccccaccagtttcctgtgatttctctcctggggaaaggggagaaagactctggcccccagttctctgggtgggcacagcagatgcttgtgcaccccacatcctaccccctctgtggcagcccagggtggcagcttctcacacctccccttttctgtctcaaggctttggcttctgaagccccctcagcctgcactctgcacagcctggaagtgtggagagagagaactccctgggggtaacctcaactagtgggaaagtcgccttgagacactttctgcagtttctcagagagccccagtagggattaagccccagttacccccacatgaccagctcagaaactcacctttattgtctcttcttgggtctgtcatactttctttgttcttctttcctttcctgggatttctttcctgctttcaagcaactccaaactaagacattggagaaaggagacaactcactgttaggatcatcctgttagggatcttttcagggaagtccctgaagttttccggatgttggcttccttacccatgaaagagaaaggatatagcctgtgccagctgggcatggtggcttgagcctgtaatcccagcatttttgggcccaggggttcgagaccagcctgggcaacatggtgaaaccctgtctccacaacaaaaaatacaaaaattagctgggcatggtggaatatgcctatagtcccagctactcaggaggttaaggtgggaagatcacttaagcccaggaggtcaaggctgcagtgagctgtgatcatattactgcacgccagcttgggtaacagagagagaccctgtctcaaaaaaaaaagaaaaagagaagaaagaaaaaagaagaagaaagaaaatagcgtgtgccctaactctcatatagaactgtgcacgagttcccagaggccccacattccttgctggtctgcctgtgagcacccactcacccttcatagctgggaaatgacccaactgtccccttccaaaaactggaaactacctaaacgttcaacagttacggaatggttatgtacggtgtgtaccttcaatacagattgagaagccacttaaagtgatatttttatggcatatagaaatataacaagattatatgacatgaaaaaagcaggctatagaacccagtatgttttgaaactatatataaaacatagacacacttgtgagaaaatataacatgtaacagagtttaagcagtaggattattttctctttttaaaaatattttccaagttatcttaaagagcatgtttttcttttatagtcagaaaaaaaatcaaccattatttaaaacaaacaaaaacactgctcaaatatcacctcctttttaatctgtccttgcaggggctgagcctccatagaatgaccaggcaacccctagggcttagcttatgcaagattattctccattaaattttctcctggctttacgtgggaatgcagaagtgactgtgttcccatgccttcacaacaaatgtggtttgcaaaaatggtgtgatatgtattttcaggccttttttagagatatgcattgtgtttggggagcacttcctctgcctaacctaatggacgaaacattttcgtatagaaagcaaatgttgctacataaaactgggacaacatatagcatagtgttaaggatgtgagagctctgcagccagctggctcaggatcaaaccttggctccactttctagctgtgtggccttgttcagattatataacctctctgggcctcattttcctcatctgtaaaatgaggataataatagtacctactcattggattgttgcaaagattatatgagttaatacatgtaaaaaaccaagtgttatatcgatgcacctgatacaagggacatacaatgtgtgtgccctcaccatcatcatcatcgatgacaggagagagtttccacaaacagtgctcttcagggtaaaccaccgactcttcagacaaacccagaattaactcaccagcaaatcgatccaaccagaacacagcatgtctgtttgcttactagccccactgagagctgtttccaaggttacctcttaggaattcagtggactagtagttgatgtggcactttttaagcagcactgagccactgcaaaaataaatgactggctgttcaggattcataaataagaaggatatagacatgaaggtcaaagagccacagagaatgagatgaagagaggaaacttaactcaggtgatgcatgaagacgaaggccagtgagatgacaaggcttcaccaggtgcctttgcttagggttctgctgacagcctgtggctccaaaacgctcatctattgctgcctcaaccctggaagagtacgctgctctcaggacttggttcaggactgtgtgagggccctcatattgcattgcagtttgcgggatgcagcgtccccccctctcacattaaaacatcctccaggtacttaataagtgcttatcaggtacctggcactgtgctgggctccgagggccaacaaggtggctgccctttaggaaccaactagctctggaaggcaggtccttgtctttgtattcatagctcctgacccatctcctagcaccagagatgcccatacatgcttatgaatctgtgagataagtaatgccagctccaccctggctgtccttggtttaggtggcttattgtatctacatttcctatgtaattagccagcttaccaggtcaagttctatgttctccccaaggccgttacaaatgctcagggcatgtggacacacacagatgcacacccacgcacaaaggcatggcacttcttctctaagtaggagcagacttttaaaccaaggaaatggttctcattctcaatctaaaaagataacagggtatggcatggcaaaggacaaagaacagtgatgaatattgttccctgggccctgtatgcctgttttgtgtttaaatttaactcccatggcttacatgagacctcaaataatgtttcaactcaaattgtttcgactgcctgaagccatccaatggtgcttccatctccttccatgcctacgagcaattggaggacagccgcatcacatggttggctaaacagtgaataagtgcctaggggccatttgcttggcagacttccaactctgcagagcctatgaaacagaccaaaacaaagatgggtggaaactgtaggacttgggactatagatcctgctgtcagctcccatcacaacaccgcctctaagttctcttttttggctgtgctccaagggccatatgtcaacctcggtgactagactagctgtgtcaagtacaagagagtgtggtgagaccccaacattctgctgaggccaccaagagctggttcccatgtttacctgaagccacatattataaccactgaaacaagtatccttttagttaaatgtagtaaaacttctcttgtttaagggactgggttggggggtgcagattttgcattttcttctggcaatctcacatgggaaaaaagtgaacccatatgttgtagagaagggtattaagaacagaacttgttcccttaacagaaaaagctattgtaggcagaataatcactctcccaaagccatccatgccctaatccctaggatctgtaaatatgttactttatgtggcaaaggggaatttcagttgctaatcagctgatcctaaaatagggagattggcctggattattcaggtgggcttaataaaatcacaggaaacttaaaagtagaagaggagatttagagtatgcagtgagagggatttgagccttgcccccactgctggctttgagatggaggaaagggaccacagaccaaggaatgagggcagcctccagatgctagaaaaggaaagaaaatggattacccgctaagccagtagaaaggaacacagccctgctgacactttgactttagcccagtgagacccatgttggtcttctaacttacaggtctgcaaggataatacatttgtattgtgttatgccgcaaagtttgtgatttgctactacagcaatagagaactaatacaaaagcccatggtataaagacctccgtaggtgaccatggatagatgcaattccagagaaaagtcattgaaaagaccaccgaactttcagtgacacttgtactagtgagacagacccctttttaataaagtagaaatgaccctgccaggcatccctaagttaggaggaagctctgtcttctcctaaattttctcatctcagccctggaaacaaccaacaactttgagttctcaggtgctgtagtcatctttgggctttgcctcctgtccaaatgcttctacagagcttagtcagataagttactactatcttcttggtgatgggaggaaacattcgtgtctcataaaatcttggatttccacccccaacccttcatgaacactatatatttttaggatagttttagatctaccaaaaaaaaaaattgcaaagggagtacagagttttcgtatatcccacgcccacttttttttcttattaacatcttaaattagtatggtacaattcttaaaattaatggacagtagtgatatattattactaacttacagttagtgatatattacttttgttatattattgatattactatattttgtctaaagccatagtttattcagatttctttagcttgtacttaacatactctatctgttccacattacgttttgtcttcatgtctccttaggcttctcttggctgtgacagtttctcagacttggtttttttatgactttgacagttttgaggagtactggtcaagtattttttaggatgccctcctgttagaattgacattttttcattcttaggctatagttatgggtttctggaaggaaggtcacagaggtaaagtgccattttcatcacatcatatcaagggtacataacatcaacatggtttatgactgtggatattggtcttgttttcctggctgaggtggtgtttgtcacatttctccactgtaaagcctaacttttttcctccttcctatacagtactctttcaaaggaagtcactagacgcagcccacacataaagagtggggagttatgctccattctttcagaacagaggatctatgaaaatttgaaattctgcacagattagtttcttctcttccatgtgttaatttattcaattatttatatcactatggattcacagacatttattttatctgtgggcttcagattgttataatacaatttatatgataatccactttattataatccaatactactttattttgttattcaaatggttgcaactttggccagctctttcaatcagctcctgtgagcctctgacatccctccttttttttttttttttcctgagtacttccttcctttctggctccaagcttatctcatatattttctctgcagtcctagaatcagccatttttccaaggagccctggttacttttattggagaacaggactagaaacgaacatctgggctctatgtacattcattgctactggagtactgatgcatctaggccctctcagttaacacagtaaggaaatatatgtgtgtgcactaatttatagaaatacttagagagatatacacatatcttgtaaccatctgtatctatattaagttaaacataagtttttactgatgtctctaactccaatgcattaccacatggaccattctagctttctccccttgtttatctataacctcccactccagtgagaaaactggctcctaccatccaccatgcatttacttaattgttcaattccagcatacacatatagcagtatcagcactgttaacccataccctatgggaaacaactttatcaactagagtgccgtgcctaaatgcagttccttttgcctttggtcttatagagtcatctcatttccagagatacttaagttcgtaccattcccatcacccctttcattgaggtcatctcatacatttgtaatacagttagattctattgtcacaatctgcattccatccttgggtcctctaaccttctaaatgattttttaatttgcttacattaaggtttactccttgttagggtttgaatatttgtcgcctctgaaactcatgttcaaacttaatccccaatgtggcagtattgaaaggtggggcctttaagaggtgattgactcatgagcactctacctggattaatccagtagtccccaacctttttggcatcacggaccaatttcatggaagacagttttttccatggacatggggttgggtcggggttagtttcgggatgaaactgttccacctcagatcattaggcattaaattctcataaggagcacacaacctagatcacttgcatgcacaattcacaatagggtttgcgctcctatgagaatctaagccactgatctgacaggaggcagagctcaggtagtaatactcacctactgctcagctcctgctgtacagcctagttcctaacaggccatggaccagtactggtccacgttctagttcatatcctgggggttggggatgcctggattaatccattaatggattaatgagttatggaataggactggtggctttataagaagaggaagagagatgtgagctggcacactcagcccctttgccatgtgctgcctcaggaccctgcagagagtccccaccagcacaaaggccctcactagatgtggccctgcaacctgggacatcttagcctccataactgtaagaaatattttttttctttataagttacccagtttcagacattctgttataagcaacagaaaatggactaagacatttcttatactataaatatcatgtgtctgccattacagtatcatacagaacactttcactgccttaaaaatcttctgtactttgcctattcagcattttcccccatttatctttttactctctctagtttcgccttttccagaatgtcgtataattagaattgtatagcatgtagcctttttagaccaacttgtctaggaatatgcatttaaggttctttcatgtctcttcatggctttatagctcatttccttttatcactaaataataattttcatatagatgtactacagtttatctactcacctattagaggatatcttggttgcttgcagttttgggtgattatgaataaagctgctataaatattcacattcagggttttgtgtgaacatgttttcaaatcagttgggtaaatacctaggagcttgactgctggattatatggtaaaattatagttttgtaagaaaacaccaaagtggctcttactattttgcattcctaccagcaataaatgaaagttcctgttgctccacaccccttgccagtgtttagtgttgtcagttttttttggattatagccattctagttgatgtctagtgatatctcattggtgttttgtcattccctaatcacaaaggataatgaacaccctctcatatgcctctttgctatatgtacatcttctctggtgatatgcttattcagatcttttgcccattttgtagttgagtcagacttgcatacaagtcttatcagataggtattttgcaaatattttctctcagtctatgccttgtcttttcattctcttaacagtatcttttgtagagtagaaatatttatttatttagttgtttttttttttttgagacggagtcttgctctgttgcccaggctggagtgcagtggcctgatctcagctcactgcaacctctgcctcttgagttcaagcaattcttctgtctcagcctcccaagtagctgggactacaggcatgcgccaccatgcctggctaatttttgtatttttagtgagacggggtttcactatgttggccaggctggtctcaaactcctgaccttgtgatccgcccgcctcggccacccagagtgctgagattacaggcataagccaccacgcccggcctgtagagtagaagtattaataaagcccaactcaccaagttttctttcattgattatccttttggtgttgtatctaaaaactcattatccaaccgtaggtcacacagattttctgttttttttttctagaagttttatagtattgtgttttaacttaggtctgtgatcattttaacaattgatgattgtatgtttttagtagtcttgaagtatggtagtgttcgtcctccaacttcgttattcttccatattttgttggctactctaggtctctcgcctttttgtgtaaactttagaatcagtttgtcaatatccacaaaatagctttctgtgattttgactgagattaacattgaatctatagatgaagttggaaagaattgaaatcttaagttttccagtccatgaacactgaatatctcttcctttatttagatcatctgggttttataatcttctgcatatcagaagatatagtgtgcccattattttagatttatacccaagtattgcattttttgtgctactataaatgatactgtgtttttaattttaaatttcaaccattcagtgctagtatataggaagcaattgatttttgtaaattagccttgtatcctgcaaccttgccagaattgcttattctaggaattttaggggtgaggagcattggtgttttgtttgtttgttttatggttgattctttagaaatatcaccggcaaacaaagacaatttcttccttcccaatctgtataccttttattttcttctcttgtgttattgtactaagatttctagtataattttgaataggcatggtgagaggagacatccttgacttgttcccatttttaggggcaaagcatccaatttctcaacataatgtatgatgttaggctgtagggtttaatttttttgttgttgttgttgtagatgttctttcagattgatttttcacatagagaaacattgctgggacttgctgaccagacaatatagttgtctttagctgccaagagcttctgtataggccctggaactatttagaaattaagggagctttaataactttcaaggggactagaaattaataatcagagttctgataaggatctagagcagcctaaacatctcactggggcccactggccctgaaggagaaagaacatcctggttcttttcttgccctctctcagaatggttttttgcaagtacagatacagtgggcgtggttcagggaatgtggagaatagatgaattcaagaccctaacactctggaaccccgccctacttatctgctattccattcctcacccccttcccctgtgcacatttatattccctgtgctcagacataatcactactccctcaacacctgccctgtttttccacatcttgctatttttacacaagatgtgccttttgtagtgcacctgtgttggttgaaaatttacattttcaaggtccagttcaaatgttccctttttaggactccttcccagtcttctccatccaaagttagccttgttctacatgagccctgtggctctctccttacatctctgtcacctctgagtgtagcaccgtgtgcattgcatctgcgggcctacctttcccaccaccttgagcagactgaggcaggcctacgtcaaatccccaaacctgtatcaccagtgctggcatggggactgcttcaggggaggcacccagtaatgcttattggttgaatgaatgaaattactggccttgcatatttagagacctctgtctattctctccatgtttgcttttcccctggtattctttgagtccctagatgtattccggagtaaaagagatgccatagcatttcttttcttcatgaacaaaaatcagggggaaattaccattcattgcagacctactctattcacccattgactttagaatcctggtatccccatgttatcagttagggagtttgggctctgaggcctagaaaaatacctcttctaattggctcaaacagtaagggaatttattgtatctcctataacaagacatatgagcttgagtggttccaggggttgtggcttaatagtatcaacaagaaccccatctttctatattttttctctgccaacctcaacacactagcttcttccttgagcttactcactgcatggctacaaaatggctgcaacaaatccaggtataatatcctgacacaataatgattagaaggagaaggttgccttttcttccttgggcctttctttagaatgaaggaaagtgattccagaagcttctagaaattttctgtcacagttcattgaccagaattgacatgatgatgcttgagccaaccactgctacagggatcaagatcatcatgattcgtttaaaccaatagcggctttacctggaggcataggagggaggggtgtatactggaacaaaatgagggttctttcagcagggaaaacggataaatgttggggagcaaaccaccaatgtcagctatacccttgttatgtacagaattgttttataccgaagttcaaggaggttaacctacttacataaggttccacagctgataaaaatagaagtagggtacaaatccacacgccaaagcccatccaggtactttcttctgctcatgtggcctcagagtcagaccacatatccctggaaacaaaagccccttttctcacggtgagcacttcaggggttcaggcaatctccctgctttccctaccccgaccttcagctgggcatttgatctgtttattaagttatgacttaatggcgctgcgagacattcggacccagttttagattgttagaggaggttcagtggataaacatcagattcccattctgtgccgagaaaattcagttgtagctctttctctttcagtgcgtgaggattggcaaggggcttctgctgggtcctgctttggtttaatagaaatgaaacctccaaagcaggagggctgttttgggaaagtggccactaatggggccccatggggcaagggccaggcctgcactgggcagtttgcatattcacttttacaaacagttggctcagagtcagcagttaatggaatgggaatgatgttcctgtaccaaatcgtttcctgaaaaaaacatttccaattgcaaacatatcttggcctttcttcttggatttgttatgtctctgtgagtgaattaaagaggcagggcagaggggaatgtttctgactggggattcttcatctgaaaacatttttaacaatgatctacacagaaaaagagatcctgttcagacccacctttaggagtcctggcttcaaatattgcgtttctagtcacactttagagatgtttcaatacctctccatttacaaattggctcactttggctatacaacaagtcttgggacaggtgtgactttacttaccttataaaatgtaagctggaaatgctgccccagaaatgtgcgtgcatgcgtacgcacatgtgcgcacacacagtcaggctaaaatggaaatgtattttgtttttctgggaaaaaggtaaaatcctttgcatcccattctctgctttggcaaattctgcctcaactcataacctgtgcagttgaagggtggtcttgacagtttggattatgtattcagcaaatatttcttgagtgcttacaatgcttgaggtgttgttttaagtaataataatagttgcatgtatttacctagctcttaccagctgccaggcatgcttctgggtactttgcatatattaactcatttagtcttctcagcaacccttggaggtcggcaatattgctgtcactcccattttgcaggtgaggaatctaaggcatgagaggttgatgaacttgcccaaggccacagagctggtgagtggtagagtctggatatgaacgtaggcagcttggcttctaaccactgtgccctctggcctcatgggggatctaatagtgaacaaaagagaaatagtgccagtccttacaaaacttacattctggtgagggagagagttaacagccatataagtttttatttcagatcatgatgagaaaatagatcatgatgagaaaataaaacatgagagggaggtgggagggcgctaatcagagtctcatagaataaaacctcagctcctacctatgacctgagtatgatgggaagtcacaagaaagcttgaagtgggagaatgtatgatcctatttacatttttgtagaacattctcgctgcactgtgggaagtaggtgagagtgggggaaatgcaagcaaagcagtagaccagttagaaggtggttctgataggccaggcaaaagataacggtggctcaagtcaggatgatagagcagggagatggtgagaagtgtttggaattgggtcctggtttggaggcggagcccacaatacttgccagtgttttggacagatgcaaaaggtgaggaaaatgagaacttaagagtgattcctcggagcttggcgtgaaccatggtgtaaacagtggtgccatctactgaagaggataagaataaagaacaggttcattttagtgctggtatggtgggtatgagggtgttgagaatcacaagttctgtttggatgtgtacatttgagatctctattagtagacctaagaggagacattgaataagtgattagattcataagcttggagctccaggctggagatttaaatgtggacatggacattagttgaatgggatgacctaggacattatccacttactcttttaaaaattttattttttaactttaagttcaggggtacatgtttgttacataggcaaacttgtgtcctgggggcttgttgtatggattattttcccatcaactatagactggataaagaaaatgtggtacatatacaccatggaacactatgcagccatgaataaagaaaggatcatgtaatttgcagcgacgtggatggagctggaggccattatccttagcaaactaacaggagcagaaaaccaaatatggcatgtcctcacttaaatcatgagaacatacttgatgatcttgtgatggaacctttctacatccatgctgtctggtgttgtaggtaccagccacctgtggccattgagtacttgaaatgtggttggtgcagctacggagcggaatttttaattcactgaaatttaaatagctcaagtggctagtagctactgtattggacagtgccgatcagtgtagctacaggagagaaagtcccaggcaggagcaagttccttcattggccagtaagcctagccttgcagccacatttaaacatgactttatttccactgctcactccttgcgtagcaatgcttgttaacaaagtaatgaaaattgtgcttctttgtgagaaatagcctgagaaagaaagaaaactggtagttctaggggagatattagaagaaactatagaattttaaggaaacagttgtgcttagctggaaaacaaacacaatctgtacctacagaatcatttaagccagggatgtccaatcttttggcttccctgggccacattggaaggaggaggattgtcttaggccacacataaaatacactaaacactaatgatagctgatgagctattaaaaatctccagataatgtcataatgttttaagaaagtttatgaatttgtgttgggctgcattcaaagccatcctggaccacattgcagcccgtgagctgtgggttggacaagcttgatttaagctttgaaggtaccccttctgtgtttctgtcatgttttatggagaattctatgaaatagtcggtgtctgtgaatgtggagatcaaggtggtgactggctggtaccctatgtgaatgtcaaagacctgctgcaaaggtactaaataccagcctcgccatgcaagttgtgtctcttagggcgtagagagtgtttcactccctttgtttctcagtctccttccagtccaactgcagctatcagtgagtgtattgaggtgaaagaactctttgtaagtggctgccttgtgcttaggatttcttgcaagtctatgctggcaattggtgaggccagagtcaataaaaaaaataaaatggaaagatgggacgctgcttttattaaggttgattgcagctgctgtattagctctttaagaacctcttggtgaccaacgccttctgagaaaatggcctttctgtgcttaattggcaaaaagcaaggggatttaagtcactgcttttaggaggggtaatccaaggtcagcactcaccaaacgtctgtcacacaactggttttgtgggaggaattcttttgtactaaggctccatgtgggggctggtcacttggaggagcgtgggctggtaatctttggtagtttttacctgtttttgtttttctttctgaggaaggtggaattacagatttctaggatttgaagactgtaaaagagcttactgttcatccagtcaaactctattttcagctgaggaaatgggccaagagagatgaagtgcctggccccaggtcccacagctggttccatctcaagggataggaccagagctcagggaagggccagaactgaggtatttttgagcagtggctggggttgggtggaggtgggaaggcagataatcaggagagtacctcagggaagccaggagaggtgagaagtcagaggacggttgaacggaggatggaaatgccttacagcgtacatatagcctcaaacccatgaccccattcatcctgtcagcacacagtcgccgggcaccagacaggaagtcctggaagatgggacaggcaggaggtagagactcagaaagaagtcagtgcccacctcgcttccattcattccgaaatcttttctgagaggagggagatttctgtgcttttgagacctccctgcttccctgaggaaagcaagtgaagtgacagctggcagaggtgagattaaggggacaattaggtcctttcagccaggcgaggccatgaattgatcgtaggctgagtaacagctgtaatctacccttagtgggtttttttctcaatgtcaatatcgaacacccttgttacagagctccaaccccctgccgtccgtcagctgaaatgtgaccctgctcttccttttcttccagtgtccgagctgcaggaggagggaatgaacgccatcaacctgcccctcagcccaattccctttgagctggaccccgaggacacgatgctgggtaactgtgctcttgtctctgaattcgcttaagctttcccatgccagcacccccactgaattccttttctttttaaagaggagaatgaggtgcgaacaatggtggatccaaactcacgcagtgaccccaagcttcaagaactgatgaaggtaagaagaaatcaggagcggcttcaggtgcctcactgacccaccatgtgtccatatgccacctgctctgtgcaggtaccccacgagcccctgagagaaggtaaaaagtcatggcagcccctgcctcaggcagtgagttgtctagcagatggccatcgaaaacgtaaccgattgtttaagtgtgggatgtgacaaatgcccagtgagtggtgctggtcacagcaccagacagttcagtacaggtaagctcacgatggccaggattccagagtgcacaaaatgcttattttctcaaggaccctcaaaagcaggcagtggagcagtaattagtctcatccccattttccagatgacaaaatcaagtttcagaaaagccagatgctttgtttatggtcataaacaaggagctggaactcaagcagaaataaaggagatgaagtgacatactgtgcattacgtacctgcgcagtggctggcgtgcgcttgtcctttcaaaactgttcatttctcccctgcgtcttattccctgtcctatgttcctcctcttcagcttaaccaagctgcacttaagacaaaaggcactcatgagtgtcatcccagcactctgcggaggccaaggcgggcggatcacttgagctcaggagttcgagaccagcctgggcaatgcgatgaaacatcatctctactgaaagtacaaaaaattagctggtgggtggatcacttgaagcctgggcaacagggtgaaacaccatctctactaaaaatacaaaaagtagccaagtgtggtggcgcatgactgtaatcccagaccatctctactaaaaatacaaaaagtagccaagtgtggtggcgcatgactgtaatcccagctactcgggaggctgaggtgggaggatggcttgaacttgggaggcagaggttgcagtgagccatgaccacgccactgcactccagcctgaccctgtctcaaaaaaaaaaaaaaaatagcactggatgtcagagtgattcattcccccatgcaaatctgaatacacggttcccctgtgcaagacctctcagagtttctcatccaccacaggttgcagtcgactcctaagaggtggtgtttagactccttgctctagctgcctcttcaacctgagatcagccactacccagcaacacaaggatgccagaactgctgctcccagcagccgatgcgtgctcccagcgctccccaccgccaaagcctggctaatgcagtccactctgagtagaatgcctctcatgcccctcatctgaaagtctcagcacggctgcttgctccaggaagcttgctctaaactctagtgccatggctcaaccactccacggctgctataaccctatccttagttctgttgtcgtctccacgtaatattatagcttctcatgcacttctctgtctcctttactaaatggtgagcttcttggggttagagactgtcttttttttctatcattgtaccccaaggacctagcacagaatgtcacatatagcaggtatttaataaacattagaggatggaaggaggaaaggaagggtgggtggatgaatgggtaggaatttcaaagtcagccaggagtattcagaagtaaaatcaaacccatgtgagggttgggccatctcactagggactggaggactgagggcagtcatctcagaggagatgtgtaaatgtcccttctgtctgctgaagggagtctgtgccctgaccccagagtttaagagaaaggaggcagccttggctaggccgccatgcagccccttgctcccctggatcacaaccggagcctcacaggcagctgggctgtgcatgttgggtatctggcctttcctgatgcagtctgtgctgcatccatagatgactgcccctgcccagtgagaccctgagccctcacctttctgtgcaggaagaagatggaacagttgaggtgcaggctgtgcctgccgctgcacactctccggggtgctgggcctgtgtgggcaagggtagggggaaaggggctagccctgggcttgctcctatcagagggcgctcaccatgctagaatgggtatgctactacttgctcaggagacctctaagggtaaggacggtcagaatgggctccaaatggtttaggcttcaatgttgatctcccagacctagacctgcactcgggccctgtttgagagagtgaaggattggagatgcacataggcctgagccctggggtgctgaccaaaggcacagctacctccgtacttccagagggaggttcgattttctagatctaggctgctttgaccaccttgaaatcctactctttctggtcaactcctagtttaagagtcttcttaggagctgggcacagtggcatgtacctgtaatgccagctactttcagatgaaggtttgaggccagaagttcgaggctatagtgcactatgattgcacctgtgaatagccactgcattccagcctgggcaacatagcaagaccctgcctcaaaaggaaaaaaaaaaaagtctcctcaaacacaaggctttctggaagcctcccctcattcctgatctctcctgcccactcccagcctgttggggcctcttctctactctctcatagcaccatgtcctccccaccccaggatttgaactctttatgttataatcctttggttgaccggttttctgcccccataagcctctccaggacagaggctgggtcttactctactggatacagtgcagtgcctggtatacagtaggtattacagttgccatcctcttgccttgggacagcagaacaaaagcctccagactccaacatcagcccacccagggatggcaacgctgtctggctattgctgtgttataaaggcagcatacttatgctaaggcaaagacgtccaacacaaaggacgatgtccacttataagaaattggagaaatgtcaaaactgtagtggttcccccaggcctgtggtcagggatgaggattgagtacaaagggacctacggaagcatcctactggggagggaactgttctgtatctcgattgtggtggggattaaactactgtgcacaatgaccaagacatatcactgtatacttaactttttttttttttttagatagagtctcactctgttgcccaggctggagtgcagtggcacgatctcggcttactgcagccttgacctcccggttcaagcaattctcctacctcagccacccaagtagctgggattacaggcacctatcaccacgcctgactaatctttgtagttttagtagagacggggtttcaccatgttggccaggctggtctcaaactcctgacctcaagtgatctgcccgcctcgacctcccaaagtgttgggattacaggtgtgaaccaccacgcccagcctaaaattttttttatggccgtacactgtgagtgttgcttgccattagagtaaggaataataggggacatagatattaacagggacatggcactagcaggatatacatctgaaaattaagaaggccagtagggctcacacttacagctacctgtgcacacactgggttatgtggatagttctcctgcttttaaaatctgaagttcaaagcagggcacaatggaacactcccatagtctcagctatgcaggaggttgaggcaggaagatcacttgagcccaggagtttaagtccagcctaggcaacatagtgagaccccatctcaaataaaatgaaacttaaaatctaaagttaatttggattttaattgtttaggataagaaagctggtctgtaagaaaataccccataactcttttcttactattgcacattccctttctctctctctgtaggtattaattgactggattaatgatgtgttggttggagaaagaatcattgtgaaagacctagctgaagatttgtatgatggacaagtcctgcagaagcttttcggtaggagagttgagtgctgcaatggatgtgtgtttaattgcaggtggttggatcacctacttgtagctagaaggagttattctcagtttacagtggcttacctggaaatggattacaaatgtgtggagcatggaataacagctcagtgaaggctttagatgtcctcttggaatgtttcatatgaatgaattgtagagggagtctccatgactaggtgggcctgctccttctagcagccaagaatcatcagctagatgaaaagaccccactgtatattaataactagaaagcacgcctccgcctctccagaaaagcatgcctgtgtggcctctgtcggtatatttacatgcatgggcctgagtatgcatttttagacctctgtcaccttcagatgcatgtgtgtgtgttcctctgtcatctgtggacttgtgtgtgtgtgtattcctccctgggtcactttgcagctgttcatgtgaaaatgtaaggacaatggggagagaaaggagaattcaggggtaatcttagtgttgaaaggacaaattttagcttgaatggagttaaggtgtcccccactgctcctaatctaactgtggcccaaaccgtcccctcagattctcgacttcaatccttagctgccctctgggcacctctacctgaatctgctttagactgaattcatccacttttctaaagctgtttcatcccctctgagttcatagaatcctctcccttcctcctctgcccccatgtatacagggatcagcaagacccatttctacctctcctgaatacatcctctgccattttgacttctctgaactattgaaaaaacttccaaactcacttctttgcttcccatctcacctcctccaacctattccctacacagctagcagaggaaacttttaaaatcacaagtccagtcttgcctgtacttatttataactcttagtgcctctctcctgctggacaaagtccaaaccccttggcacaacattcaaagcattccatcatccgatgacccccagctgtctccttggtctcacccacacatgtggctcatccgtgtagtaatacgtgtaaagtgcttaggatagtgcctgacacatagtagatgctcgataaatgtctgtcatcattggttttactattttttttacataccattgctgcatttttatatatgccacacatattaacatgcctgtacctttgatcatgctagtccttctgcctctaaggcctgccttcctcctttacccaccaggggagaccattattgctcatccttctgatctctagaattaatcaaattaatcaaatgtgcctccctattatagcctttacagtactgtcacttttttttttttcttgagacagattctcgctgtcacccaggctggagtgcagtggcatgatcttggcttattgcagtctcgacctccagggttcaagtgaccctcctgccttagcctcctgagtagctgggactacagggcatgtaccatcatgcccagctaatttttgtattttttctggagacggggttttgccatgttgcccaggctggtctcaaactcctgggctcaagcaacccgcctcagcctcccaaagtactgtgattacagcagtgagccactgcgcctggccctatagtcacatttagaaaagatagtcatatacttttttttgtgttcctccccacacacacacaaatgtttctctctctgagggactatatatacacttgcacatatgtgcatatatgtataggtgtgtagatataaacgtgtacacacatatctgtatacatacatgtaagtatatatacatgccttattataagactttccatgtcatctgtagctgtttaggtaaatgtgtataggcttcccaagggcacgagccatgtcctatatatttatccaggcttctccagcaccatcaggttgtctagcatatgttgcctagcacttaatcaatgtatattgaggctgggcgcggtggctcatgcctgtaatcccagcattttgggaggccgaggcaggcagatcacctgaggtcaagagtttaagagcagcctggtcaacatggtgaaaccctgtctctactaaaaatacaaaaattagccgggcatggtggcgggtgcctataatcccagctactcgggacgctgaggcaggagaatcacttgaacctgggaggcagaggttgcagagagcggagatcacgccgttgcactctagcatgggggacagagtaagactccctctcaaaaaaaaaaaaaaaaaagtgtattgaatgaatgaatggctaatgtaatttctaggaagttaaactgatttggttctcagacatcagtattaatgagtgttaatatttaaaggcttgtaaactccaactgaatacagagaggaaatgaaaaagcttcggcacatgaagacatggctaagccgggagcctcaccacgcatctgtcccagtgactacagcttttaactcctccagcagacatctagtcaggatctgaaactgccaaaatgttctatgctaggctgtcaaagcaaggtagaacatggccacagagtaatggaacatggttgtggaggaatcttgcctccaggaatggttacaaaaccatccagcatcacatctatgcaaccccacgttaggcattgcgtacaagcagattagatcatttcacatttcacccttcatgctgaaaaggtgattcactatggaggtgatgcttcttttgtgaacttaagtttagaccctaatctcaaaggtctgaggcagggcatacacattcaaagcccataatgggtaggatactcaggtggagggaaccagtttgcggtaaaaaaaaaaaaaaaaaaaaaatgcatcaggagctcctgggagggatcagtctggaagcagagattttggggaatgttttggtttgttttctttttttaacgaccctgtgagtataaaggaggcagagttttgagtgagcactctgaccttacgttcccctctggctatttttcgtgtcactggtcatgttaacctcaatcacattgtcagggtggtatctgccagatttcttcattataaagtgactgtttttctctttttaattaattttttttaagtggggagagatactttgagaccacgtaaatatcctgtttctccttaaacttctccctctagtttttgcatccatttagaatgcatctgccgcaattcttatggtagtgttctagcagagatggtctcttctctgtattccttctgcatttattaactggaattctaaaaggaagagttgtcatttctatttatttatatcactatggacatatttattttatactttgggtttaatccagtactactttatcgttcacttttttgctcattggcctccagcttcggccattgggagctctttcaggttgcctcctggacacgttcaacaagctgcccatattttttttttttctgagcatttcctttgtttctcacatcataagatactccaagaccatcttatatttttcttactccagtcctgaaatcaatcacttctccaacgagccctgatttattttattagagaatggaatttagatatcaagatgtgggtatattagtggatgtttttaacttgttgtctgcagcataaataaccaaacatctgtacctaggtacagtgcccttacgtggtggtattaactaggcatgactgttcccagaaatccagcttctaatcgtactgggggttgagcttccttaatactgagttgtttgggcagcgagctggaggggtctgagtttgagattagtaaagtaactatgaaacactagcacttagaagatgatggaaatggcataggggcctctcgtagcccaggagcatacacatctgacatcaagaaaaggatacagggccaggcgtggtggctcacacctgtaatcccagcactttgggagactcaggcaggtggatcatctgaggtcaggagttcgagaccagcctgaccaacatggtgaaactccatctcttctaaatacaaaaaattagccgggcatggtggtgcatgctacttgcgaggctaagacaggagaatcacttgaacccaggaggcagaggttgcagcaagccgagatcgtgccattgcactccagcctgggcagcaagaacgaaaccctgtctcaaaaaaaaaaaaaaaagaaaaagaaaaaaaaaggacatggaatccaggaagccatgttgattacattgtggagcaaagacccagaacctagaggcagaagtgtgtgagaaggtgtggcagtgtattagtctgttctcacactgctcataaagatatacccaaggctgggtaatttaaaaaggaaagctggccgggtgtggtggctcacgcctgtaatcccaacactttgggaggccgaggcaggtggatcatgaggtcaggagttcgagaccagcctgaccaacatggtgaaacccccatctctactaaaaatacaaaaattagccaggcgtggtggtgggcacctgcaatcccagctacttgggaggctgaggcaggagaatcgcttgaacccaggaggcagaggttgcagtgagccaagatcataccattgcactccagcctgggtgacagagcaagtctccatctcaaaaaaaaaaaaaaggaaagaggtttaattgactcacggttccacatggctggtgaggccttgcaatcatggctgaaggcgaatgaagaacaaagtcatgtcttacatggcggcaggcagaaaagcttgtgcaggggaactcccatttataaaaccatcagatatcgtgagacttattcactaccccatgattcagttatgtccacctggccccacccttgacacatggggattattacaattcaaggtgagatttgggcaaggacacagccaaaccatattaggcagggacttcttggcagagagttgtatatgtttcgttgctgtggtgaaagcctgaacaggtgagcgtccttgagatgccatgtgactttggctggcaaggactggctgggtgttctccaattgtgagctcaatggggagcaatagcatgcctggctcacctctgtgtggccacatgccccttgctcacagcagtgtctgccttccttgcaggaaaatcacccttctcacaggccccaggcatttctggtagattctatcagaacagcctctccctagtcctttcttagctgcccaacccagctgccccattgctgcctgtattccctgggtcttcccacttgccctggcagcagatcttagtttaggttttcccaaaagcagacgccaagacaaggatgtgggtggaggaagcttatatagaaggtgaccttaaaacgtacaaataactgagtagggcacgtaagaggggaagagagaaatgccaaacacgagtatgttaatcagaacagcagctctgtttcaaccagggctcatagctgggccctctgagaaaccacgtaacaacacatctcagaatcacccttcccagtgcaaggtagcaagggcatttatcctatggctcctttccccctgtggttgagggtgacctgtgcaggaaataaaaacttccaggctgtgctcctgtggtgacagaggagagagccttggggccagagatggccatcagtgtgctaggagctgtctgtagctgcagatgaatgcaggtgggccaaggagctgggggaaggggcatcgctgtcatccagagagaccacagagacagcaaccccgctgtggggacactggccacttctctgcgctgttgatgttgctgccaataaaatattagctgccagcaacgctggcctgcctcttcatgacatacacttcatcctctcatgggagcagccctagccctttccaaacctcagagcagaggtttccgaaccccagaatgaggaggaagttccttcctaccccagccaaaaagtcacctcatttcttgtccaggattacccccttccagggtgattgatggaagaaagagccttaggtctcccagaatatactcttactccatggcatcaataagaagtcacagaatcatccaaagttgggacacatttccaaatacctcagttatacaggtatgtccatggtcacctggttatatttacattcacaacacctaggcagtaggcatgactgagtgagagatgggataagcgattccaggaagatgcctatacaacataattcatcacttcatttgaacatggcccactgcctgcttcttattgaggtttcctggcttgggatgtctatgtgaatttccttgtggtatgtttcatttgactgatccttatgtttgaacatgtacatgtgctgggaacagaaaaggcctattttcagagatgagagtcataagcttccagggctcttctttctggttttcacagtaacatgtgactgaaacaggatatcattcttcaggcttgagaccaaaagtttccctgtggcagtaaagttctgcaggagggtggttttgttttggtgtgtgtgtgtgtgtgtgtgtgtgtgtgtgtgtgtgtgtgtgtggttttctttttccctgatagaccctaaagagtgcattttacactgatcttaatcagtcagataataatatccactaggcaaaaaccatttggtgtgctatatgctaactgctgagttcaggaatataaaagtaaatgtgtcatatgctgtcttgtggaaactcacagcctggtagtatacaggtctgtaagagatcaagtaggagtttgggaaaggtttcaggaaagagggggtattttggtgtttgatttttgttgacttttttttttttttttttttttgagatagggcctcactctattgcctaggctggagtgcagtggcacaatcatagctcactgcagccttgacctccctgggctcaggagatcttcccatctcagcctcccaggtagctgggatcacaggtgtgtgccaccacacccaactaatttttgtgtgttttgtagagatggaatttcaccatgttgcccaagctggtcttaaactactgggctcaaatgattcacccaccttggcctcccaaagtggtgggattaaaggcgtgagccacctcacccagccagagggggcattttgaatggggccttacagaaaaagattctcaaccatatgaggaaggagaaagggcactttagccaagacaacaaaagagtttccaggaagcctctgttaattttggtgctaatggagggaaaatgctgtagagtccaggagccagtgggtagatgaccatcagggttgggtgactgggatatgaggctaacaaagaaaatgagacccagctcccaggtcgtggtttttagcaccatttccaacaggagaaaccaggacttcttggagaaatggctaattttagacctggggcagggaatgtagatgagcctagagcatcttgcagtaccaaaaagaagtgctaagaaaaaatatatatacagggccacacattgaaaatgtccaaaaccaacctgagggagctcccagtggccaaagctggaattatttgggggaaaaattaataatagcagtattggattataacccaaagtctaaatacccttaaattgatactgatataaataactgaacaaataagcaaatgggaacaaaaagacaactctgccttatagaatttcaaatactttgtgtagatataaccccttcaaaaaaggtggcaattaattccacaatccttgagtggctgaatttagtgacaggcttcccatggttagagtgtggaagtggggacagggtagggggagggtgtaatgaaagggtacttcacttctgtggtcttcctccccagcctacccatgagaaaaatataggaaaaatcaagcagtcctgaccatcacttctcaaaactgtcaaggtcatggtaaaaacaatgcaagtgtgaaaaaccatcacagaacagaggacgctaaggagacatgaagaaaagaagtggtatcctagaccgtttcctgaaacagaaaaagggcattagaaaaaacctagtgaatccagataagatatagagttaacagtcatgtactaatgccatacataaatagctgtgacatatgtacgatagtaatgtgagctgttaacaataggaggggaaactgagttcggagtgcataggaattgtctgtactgtttgtaacttttctataaatctaaaaaccattctaaaatgaaaagtctatttaaaataaagggctgggcgccgtggctcacacctgtaatctcagcactttgggaggccgaggtgggtggatcacctgaggtcgggagttcgagaccagcctgaccaacatggagaaactttgtttctactaaaaatacaaaattagccaggcatggtggcacatacctgtaatcccagctacttgggaggctgaggcaggagaatcgcttgaactcggcaggcggaggttgcagtgagccgagatcacatcactgtactccagcgtgcacaacaagagcgaaactctgtctcaaaaataaaaataaaaataaaataaaataaagctgggtgcggtggctcatgcctgtaatcccagcactttaggaggccgaggcaggcagatcacttgaggccaggaattcaagaccagcctgaccaacatgataaaacctcatttctactaaaaatacaaaaattagtggggcatggtggtgggcgcctgtaatcccagcttctcaggagactgaggcaggaggatcacttgagcccaggaggcagaggttgcagtgagctgagatcgtaccactgcactccagcctggaagacaaagtgagactctgtctcaaaacaataaataaaataaaggaagaagatgaagctcacattagaggaccatgaactaagagttttagactgtattgttttggtagcggcaactagtggtgccttatgagcaaaacaacacagtcagaaatggggctttaggaaataacataggagcagtatgggagatgctcagagagagtggaaggaactccagcagagcatctcctcatgagaaaaggatagtgtcaaatagaggagtgtcagtttggatggggaaaagcttgaagaggacctagagatgtagggagagtagctagagtaaaccaggctgattctatgtggtggatgttgaacaggtatgactccatgaaccccaggaggagatgcatcttgaagagtttgatcttgtttactttgagagtcacttttctatgccctaaaatgctgggctgaagtggcagctatgctaaaattgaagcaggaatgaagaaacaggagatctcagttccaatcttggtttcaccactaaaacatacctctgttactccgatcactctcctgtaaagtcaggaaggtggctttaaaaacctctatggctgagctattcaattcagcaaccaatagccatatgcagctgttaaaagcaattaaaatggaacattcattttctcagttacaccagctagatatcaagtgctcaatagccaaatgtagctagtagctaccacgttggacaattaaaaaaatgaacattgccatcataccagatagttctgctgaatagccctgcttgaagatcctcctcctataatctgattttaggattgttgatatatgctgctattcttaaactgaaagagttattttctcatctcaaactcaaaagttagatgaaagttttttattattattctttataaataatagagaagctctctaaaatgtcttactacatagaaaaaggcatggtagagaacgactgtgtgtgtgtgtgtcaagggacacatacaatgtttgtatgcatagaatatttctcgtaatagtcataataaactgtctctatgaatgggactagggaacttgggactgccatggaaaggagacagttttcacagcttgaattttctctgtttgtatattatcagtcttattgaaattggttgagtgcatatgtaaatttcaggagcaaaactgaattaacccatcagtagatatcaaataacatttgatacatatttgaacagtcatttcaagtaaaatagaaagaggaaactacttaaatatgataaagaccactaaataaaacctaactgaacatattaaatagtgaaatatcagagatgtggtattagggacaaatgagaaataatggctgttacaactattataagtgtttcagaggtcctaattaatatgataagaaaatagattttcatttttagcattatggctgatgactagatgttcagataaatcttattggtacctcatgctttaaaaatctggataagccttcaagaacatatttttgtatgggatggctaaactggtgtgaaaaggaaggaaattcttctgattccaagaacaagaaggaagtataaatctagtgggataagtgctaattcctaataacctatcattcctaatggcctatagcctgaagtttaaagggtcacacatacagggtcaggagacaaatcttgggtagagtctgagcaagaaagagggttggattcgagccccctgaatagagccatggtcttgaaagggcaactctttcaatgagtacaaaatttgtcccacagaaagaggcaataaggataaattatcttagccttggatgtgaacagaacaattaaaaagaagtctgcttcagataactcctcatcaaaagtctatactcacacagatttaaggctaggattcacagtacttatgtgactttaaaaaatctaaattgaaattttagttacaagttgtcccaggtcactagtgccccaagacagaagcaaacatatgtccttcttttaaagaggaaggaactctaaactcagaccacaaagaactcccagagttaaaattccaaggaatatgacctcaaaattagaaatcaccaaagacatgagcgtaagccaccatgagcactgtcaacagaaacaataatctgtagattcatcccacaaatactataaatattagaaactgttgagctatagactgggtatggtggctcatacctgtagccccagcactttgggaagccaaggtgggaggattgcttgagcccaggagttcgagactagcatgggcaatatggtgagaccccacctctatttaaaaaaaaaaaagaaaaagaaaaaaagtgttcagttatagaatataaaatgagtatgtttaatatgtcaaaataaatgtttttaaagacttaaaaatgataaaagaacaagaaactattaagactggaaggtagatatgaaaaacaaccaaatagaacttctagaaatgaaaaagtgtgaataataatgaaactagaaacctcaatggattagacacagctaaagaaggaattaatgaaccagaagacagcactagagaaattacccagaatccagtatagaaagacaacagaatagaaaacgagaaagagaatttgaaaacatagaggttagtctaagtagatgcaacatacatagctaactggaattctagaagaaaagaaaatggagtatagtaaatatttaaagaaaacataatgaatgagaattttctagaattgatgaaagacatgaatcctcagattcagggagctcagtgaatcccaaatagtataagtagtgacaaatctacacctacacattttacagtgaaacctaagaacactgaagacaaatgattaaaagcatagaggaaaaaatcaattatttataaaggaacaacagactgaaagctgtctttcacaaggaacaaaaaaagccaaaagatattaatactgaagatatcaaaatactttgatgtctttaaagtgctgacaaaaatgatcaacttataagttcatacacagccaaaaaaactgttaggagaggcggctttaaaaagttaggagaggcagccaggtgcagtggctcacgcctataatcccagcattttgggaggccaaggcagatggatcacaaggtcaggagatcgagaccatcctggctaacatggtgaaaccccgtctctatgaaaaatacaaaaaattagccgggtgtggtggtgggcacctgtagtcccagctactcgggaggctgaggcaggagaatggcgtgaaccagggaagcagagcttgccgtgagccgagatcgtgccactgcactccagcctgggtgacagagtgagactcagtctcaaaaaaaaaaaaaaaaagttaggagaggcggggctcagtgactcacgcctgtaatcccagcactttgggaggctgaggcgaatggatcacctgagctcaggagttcaagactagcctgatcaacatggtgaaaccccatttctactaaaaatacaaaaattagccaggcaatagtggcgcacacctgtaatctcagctacttgggaggctgaggcaggagaatcacttgaggtggaggttgcagtgagcagagatcgagccactgcactccagcctgggtgatagagtaagactatgtctcaaaaaaaaaaaaagagagagagagaaaataaaggcattttcaataaacacaaactgagagggtttattaccaatagacccccgcaaaggaatttctcaagaatgtaaaataggaaggaaaatgaaccccccaaaaatacctaaaatgcaatagtgaacaaagattatcatggtgggtagatcaaagccataattaaatgaatataaaataatcacaataatgtctaatttgttaattaaaacaagatagaatcagaatcccatacaaccgtagcacataaatcaggaattatgtaattggagtcaacgcgtgctgaggtctttgtattgtttagtatatgggtaaagataccaattagcttaagactttattaagttaaatatgaatgataaattttctatcataaatactgaaataatagaaacagagtatataacctccctactaatcatggggagaaaatggaatgagaaagaatgaaaacattaatccaaaaaaaaacaaggctggaagtgggagaagaatcggaaaacccactaaatagaaagttcagaataagttggtagaagtgaatccaagtatactggtaaactcaatatcagaccaaataacaaaacaaattcttgccaaatactatatacaagagatagttttgttttgttttgagacagggtcttgctctgttacccaggctggagtacagtggcacaatcacagccgactgtagcctctacctcccaggctcaaaagaaatcctcccatttcagccccccaggtagttaggactacaggtgtgtgccaccatgcccagctaagtatcttcttattttttgtacagacagggtctcgctatgttgcccaggctggtctccaactcctggcctcaagcagtcctcctgcctcagcttcccaaagtgctgggattacaggcataaagccaccacgcccagctgagatagttttaataaatgagggacacgcgaaggttgaaagaaaaagggtggaaataattatgtatacaggactaatttttttaaagctggggtaactattttacatcatacaaaatagactttaaggcaaaaggcattactacagagagtcactacatattaataagaaattaaagtcactaggaaaatatagaaattttaaacttatatgtacttttgtatatcaaatatttaaaaatttaaaatgataatcattacttcaagaatttgacaaacctatcacagtgctagtttttaacatacttctcttaataacatattaagaaaaaagttcatagagaatatttgaataatacagttaatcagctctaactaatctgtatatagcatatgataccctgcaaactgtattcttttcaactgctcatggaacacttaacgaaatttgactatgcccataaagcaaatctcaacaaattagcatacagaccaaattctctgactacaatgcaagtttctctcctaatatacttggagacaaaagtattttttaaacaactcaggaactgttcatactggaaagagtattttacatattttagttcttgaagggtggttacgttaatatagtgtggtatatatgacaattgtgtttgttagaacatctcagttctcccaccattcagggtaattgagtttattctgccttgtctttatgcgtcagaacttttgactactgtttcattgttttctatatataatctctccaaaagcaaatttgggtaataccttcaaaaacaactcaaagattcacaaaataatccacctgagaaaattttctaaatcacatcctatcaatttcaaaatcatgcctaatacttatgaagagttaaactagttatgaacaatttgtgtaactatggaaacatgagagaaacagtttcctggaagaataaaacttcagcaatagaaaactttatggagctagctgaaattagcccacaaaagaacattatctttaaatccttagtaatgttgagtaaattactattaagctatagaaatattatttgagggggcctcttatattttaagggttgaataccttaaagataaaggaggtggtaggaatagcagaagaagttcgcaaattaatcttttatttaaaatgttagaaaattaaaatatgtcacataagcctgcaaaatagagataatgatgttttatttgtatacccagagaatgctgaagactcaaaccgcaataggactaataaagggatttggtaagatgacaacatacaaggaaaaaatctgtaaggcaatagctttcatgtttaccagcagtaatcaattagtaatacatacacacacacacacacaagatgtttattgcaactttattacaaatacagaaaatgtgggttataacctggctgtatgtcaagttataagtcatataatgcaatatgcagttttgaaaaataatgagttatattcatatattgacctgaaaagacttatgatatatatatgagtggaaaaaagccaatagcaaaaatatatatatactataatctcattttcattaaaagagaaagagaaggctgagtgtggtggctcatgcctgtaatcccagcactttaggaggctgaggtgggtggatctcttgagtccaggagttcgagactagcctgaccaacataatgaaaccccatctctactaaaaatacaaaaattagctgggcgtggtggtgcatgcctgtaatcccagctacttaggaggctgagacaggagaatcacttgaacccgggaggcagaggttgcagtaagctgagattgtgccactgcactccagcttgggcaacataatgagactccatctcaaaaaaaaaaaaaaagagagaatattaacacacacacaataaggattacttcgatatatttttatgcaaatccatttaataccaatatcaatgcctaaactaaaatatcgaacagcaaaaattaaaagcaagaatataaacccaaagcataatgactaaaatggaaagaagtaaagcagaattacattttataaaacatttgcaacacaaaacaaagccacaaaaatgcttctcctaaataagaaataccagacgctaaaaaaaaaaaggaaaaaaattaattttaggaagaatgcactacaattttagtaccatagactagttaaatatattagtggaaacagaaaaacaatggatgcttcagtaagtaaggtgtgaaatccaataatggaaaacacatttctctatactcctaacacttctgacaccaaatatgtgggttttccacactaagcaattttccagttctctatggacagcaacagggtgtcctacaatttaattttgatactactgtcccaaacttagcacagccctcacaggttaagggctcagtgccacaagagtgtccccacttcagttggcattcgccaagttcagacctctggtacttctgaccgactagctataatagatcaggggtttccaaaaccctttcctcagatatgatcatttgctagaatggcacacagaactcaggaaggcacttaggtttactagtctattataaaggataaaactcaaaatcagccaaaaggaagagatgcatagggcatggtttgtgggagaggcacagagcttccatgctttctcatgtgcatgaccctccagcacctttatatatttaccaaccaggaagctctctgaacattttcggccagagtttttatgaagtgtcattaagtaggcataactgattaaatcactggccattgatagttgacctccagcttccttcccctttctcatgggtcgggggtatgaggctgaatgttccaatcctttaatcatatgcttggttctcctggcaatcagcttccccatcctcagagctttctaaaagttgcctcattaacataaactcagatgtaggtgaaaggggcttgttatgaataacaaaagatgttccttttaccttaatcatttcagagctttttcaggaactggggacaaaacccaaatattataaccatagatgccactatcatctttcagaaagttacaaggtttttagaagctctgtgctaggaagggagatcaaggaggcaagatgtatatttcttcttatgtcacaccatttaaaaaaaaaaagaatgaactagacaactgtgcaagaaaaagttattgacctagaaaacagactcagagacctaagctgaaaatctgttcaatgccagattttaaatatgaaaatgtatagacaatgatgcaacacagcagagctagcaaataagtggctcctcctcactcctctcctccccacccaaccctctctcacaacagtcatcagtaatctttgcctgcaatctttgcctctgagccaagataagaccagaaggttcttaacctagcattttgggcagcctctatccaatgcttgtagttgcaaagtaagattaaaataacttgcttctatagagacaattacatcatctgaaaataatgggaaaaagtgaaagaaaataacttgtcattttttcagtaggagaggatccaagataagaattcagcctaaaaatggataaggcacacacaaggtctcttcaagatgtaagaagaagacatttagatttattcttgttaaatccctgaactttagagataaaaatggcttaaacaactaaagagaacatttcaggccatcacaggtaagaatagcttgagattgtcctactgaggtgcttaaaaaaattcgcaaatccacagaacctgcataaattctccattgggcaactttatcttcaaagaatgactcaaggggcatttggcttagataaaccacagttacttaaaaataaattatgtaagcattagggaaaatattgatacatagtaaaatttaacttgtatagcagcccttaaaaattaggagaaaagatattttaaatgtgtgcagttctgtcaatcttaaattaattagaagtgattgggtgagttccagtggtaggcaaccaatttcctgttaaggagtccaaagttgtttttttctttgtaatagattaaaatatgaatttagattaacaaaatgattagactgagtttttccttttttttaagtattaaggtgttatgtcattgcataaaaaaaaactattgattttaaaacacaccattatataaaaaccactcagaaagagaaaaatcactttaagctattactcaatgctttcttgttgctgagaatttttattttatactttttgaaggtgctcatgtaggcttattgagacatgtaagtaatcatactgtgaagagctacaagcaagttcatgcccgtggagacaatgataactcttagaccttccacctagctggcagccattgtaggatgccagtaaaacacaacctgactttaaggatgttaaaatgtgaaaaatatgtgccttagaattgattaaatatgacacattaagtaagttaccttccaggtgggtttaaaaggaaagaaggtacttaaaacagataagtatgattggacctgaccagactgtactacaggaatgtacaaaatgccttgactaactctacagagaaggctttccagtcggagcacagagatgtccttggagaagatagaattgaaaagaaggagaaaactccagaatgatagagttcaaatatgacaggctaggttaaatgcccctgggatctggggattcaagtcatgatcatgaggctctcacagtactgatgctgctggtgccaccataaggtgatgaggggacagcagtgtccctctgctggtaggcatccagtatctattgttgcaagagtgcatgcatgcatgagtgcatgagagaccgaataactgagtaagtgcatgcagtagggttgtctggggcccagcataacagctgttctcttttcccttgtcaccctcagagaaactggagagtgagaagctaaatgtggctgaggtcacccagtcagagattgctcagaagcaaaaactgcagactgtcctggagaagatcaatgaaaccctgaaacttcctcccaggagcatcaagtggaatgtggattgtgagttgaacaaaggaaaggggcaccattaaacaatgcctgtggtccctgccatggggcttccccaagaagccatccataagcttggcaggcttcaggggagggggtcaaactcatttatctttgaacaagttgccccgcttcctcagaacttggaagaagttccatccatacccttggggaaaaataacagaatgtcaaaatctcacgttcctcttctgtaaaaggctttgcatagaaacctcacgtgaaatggggaagggaaggaaactcattcactgagctacttcttctaagtcccagcacagccttttgagaaagctgttgtctgcagcttggagaggcttgggaagctgaggtccccacattcacacagctgagaagcagggagcaaggattcagttctgtctattccaaagcccgcgcccttccaatcccccttcattttctagaaagagcaaagatatggctgagatcataggcactgaaacaagatgttaaaattcagctttttacaggtagcatagctcagagacctcagaaagcataaattattagtttataataattattagtttataaattattagttcatttactgctccaaaggcccggtgtctaatacagacttaatgagtccctatcagaattaatcaagggattaggtgaatctagcagtagcaactggattccaaagtttattgtaatagataaaaatatgaatttagattaataaaagattagattagactgtgttttgcctttaactattaaggggttaagtactatgctttattgcgtctaacttacacaacttaaaatcaacagccccctacaaaaaaaaatacttttcaaacttgggaaagcaaatggagtcttcacctctaaagttagaaacccagtaactgccagtcacaatccctccagcaggtctctaacatctgacgttggggctgagacaccaagtgcctcctcggcataattacacgtttttgtgcacagcatgatcagctgctttgcacagcagtgacgctgggaacagggcacagggcgttctttgcccgcagagggagacacctgagggcaggaggaggggaggccgtgccctgggccctagatgctatcaaggagaggggctctgtttcactgtgttccaggaatgctagtattgtcaatgggggagaacaaggcagggcagggaggttgatgactagtttgggaaatgtatctgcattttaaaaatccacaatagtcataaacattagagaagtcctctaatgaagactgctgtttagtttggtttgatcctatctcccgctcctttgaatagggaccacctccctgtacccctccaaaaaaaacaagtcaaacatatttaacttatcatggcacccaatttgggaaagtctgagatagaagaacagagtcttttattactattattatttttttgtagagacagagtctcacccttgcccaggctggagggcagtggtgcaatctcagctcactgcaacctacgcctcccaggttcaagcgattctcatgcctcagcctcccgagtagctgggattacaggcgtgtgccaccaagcccagctaatttcttttgtattttactagagacagggtttcaccatgttgcccaggctggtctcgaactcctgagctcaggcagtccacccgcctcggcctcccaaagtgctagaattacaggcacaagccactgtgcccagcctagaacagggtcttttaaagccacatcaagaacattgtctccagtggctttgaatgatttgtttggtttatgcttactttaatttcttacggggaaatgtgtgcaagaaaaatcatcactcgtattaccatgctaatctagcttttcatttgtttgttttcatttgtttcatttcactgtttcatttgttactagttacatcactgcatcattttgcttggtcaggtcatatacactttttttttttttttttttttgagatggagtctcgctctgttgcccaggctgaagtgaagtggcacaatcttggctcactgcaaccttcgcctcctgggttcaagcagttctcctgcctcagcctcctgagtagctgggattacagggatgccccaccacgcccacctaactttcgtatttttagtagagacaggaattcgccatggccaggctggtctcaaagtcctgacttcaggtgatccacccgccttggcctcccaaagtgccaggattacaggcgtgagccactgcacctggcccaagtcatatacatttttgtgttttgttatttttcgcttgatcttacatcacacgtattttctacattccctcgtggtctttgtagttaaaatttttgatagctgtttctatttcatagggtagatatcccactgttaacttaaaccctaggttgatgcctatccttttaggatgtttcccaacctatttctaatatcagatagcaccaaactgaatgtcttagcttgtgcctctttttgcttgaattactccctttagataaatttccagaactgagatggattactaggtcagagggaataattatctcatcttggtggctagctccctgtgatgccttggggcttttgaagagctgggcttatttacaaagtcatagtggcttgttccataaggaatgtggcaggctcagctcctgggggaaaagctctgtctcctctctcagttaccttccgtggatgtaaacctgaggacactgtggcgcctctccgctcaggatgagggtggtagggacaggctgctgagttaccaaggtccttgatctggggctttagggatttcttcctttttttttttttctaattcacaacagtaattttcattattgaaaatttacaaagtgcagataaatttaaatattaacgtttaacacatgtattatgcttattgtatgtcttgtattcttctaaacactttatgtattttaatctttgtaatcttcactcacccatctgaagtaagaattcttttattcccatgttacagatgggaaagtcagggcatagagaggttaagaaactatgaaggtaaacttcatgagggcagggacttttgtcttttcactgcccacctagagacaagaaccgtgaacattgtgctgtgttcttcaagttctgtgtgtgtctgtacgtgtgtaataagtagtgtataatattttatatatgtatatataaaaaacttttagcaaaaatgagatcaacctgtttatgttgtttggaagatgtatatattgacaaatcattaaatattcttctgtatgtcacttttaatactatataatgtgacattgtatggatctaccataatttacttaactgataatggattttcagattgttctccgttttcccactgatatcaatacagctggatgcattctccctgcttgtagccataatgacttctttaggataaatacctaagagtggtatgttagggccaaagggtgagagcatttttaaggtcatagtacataatgttaaattacctccagaaaaattacaccaatttctgtttccaccacaggacgtgtttggaagactatttctaactcagcagccctgttttaaatactgctttccagccctagagtgacactcttagccttgcagctgcggttcccggcttgcacagtgaggcctgggcgcttactcttatcccatatgttccctcctgacttgactgcgggcacatgttggcctcagcttctgttgagcacagggagaaaattcccaggagacgtgttgagaggcagcaatgatgagggtgcacaaatgttcaacagtgggtagaatctgttttaattggaaaaatggcatatttttgttctaaagaatatttgaaaataggcaaaaaggctgggcgctgtggctcacacctgtaatcccagcactttggaaggccaaggtgggtggatcacctgaggtcaggactttgagaccagcctggccaacatggcaaaaccccgtctctactaaaaaatacaaaaattagcccagcgtggtggcaggtgcctgtaatcccagctactcgggaggctgaggcaggagattcgcttgaacccaggaggcggagcttgcagtgagccaagattgcaccaatgcactccagcctgggtgacagagtgagactccatctcagaaaaaagaaaaaaagggggaaaaaaaacctatctggcggggcacggtggcccacacctgtaatcccagcactttgggaggccaaggtgggtggatcacctgaggtcaggagtttgataccagcctggccaacatggtgaaactccctctttactaaaagcacaaaaattgccaggtatggtggcatgcacctataatcccagctacttgggaggctgagtcaggagaatcacttgaacccaggaggaggtgtttgcagtgagacgagatctagtcattgcactccaacctgggcgacgagcaaaaatccatctcaaaaaaaaaaaaacaatctttccactctagcataactattttcatttgttttaatatattcctttccaaatgttggccacaagcacatgtttgtgtgtgtatatgtagatatacatacatatgtatatgcttttatgtatgcatatatccataaatgtatatttatagctatgtatattacacacatatacacatgtgtatatagatatatacacatatacacatatatatagctatactatcttaactatgattttcaatgcatgcaaactattcattatgtgtatataccataacttcttaaagcagtggttattcaactatggttggtccaaaactagggatttgcaaggagaaactctagcatcaccaaggagaagacaagaagtcatgggtaggctgcagttaggactccagaatcctcactttaagcggagcagttgtacttttttcatcagttttaactatcaacttttagaacaaaggatttctgtgcttcatatttaaaagtttgaaaaatgctgatctaaaccatcctcttgttattggacatagtgttttccagggttttaaaacatcatagtatattacacagtaacatctttgtacacgtagcgtagtatgtatgtgtgtgagactatagactatttctttctaaaaaaaatcccaggaggatagagcattcattgaatgagtctgacatctatatgatgcttatggtatagctctgcattgctcactaagacaatggagatggtgtacaatgtcaccagggtataagaacaacttacttgatcacaacttttctagcattatattttgccattaaaggggagaggggtagcaaatgttcttacaaccctcagtgacgccaggtggtgggccggtagttctgatgagaagagcaaacctggatttgcctctgatggtgaccacaccatgtcagtgggtcacagtgggtcagtgccacatcaggatctttttttgaggctgtaagtctgggtaaaacttagttaacaaggcccgaaagcccaaaattgaaaccttctggaaggctaggagttcagagcagttcagcttctgtttgtggtgatggtgagctgctgttcataatcagtagaaaaccttctttgaagtagcagtgataaccagaaaccctaatgagttacaaaggaatgtctgaatcattctcttttcttagtgatttctcaaagcttctgctaaatcagactcactgatcccagggaagacagaatgacatcctaataatgggcctagtgcatgcgaagtacacaaaataggcattttttttttgttattcccttaaatgccccctgtaatgaagagccgtgaagctggtaggactgtgaaggcaggcaaaatatctgatgaatcttccctttgatgagaaagaaagggaataaagctggcatgttttagttgcctaggtgccaggtaatttcacataaggtataataaaaaaaaaaaatcagccattcctggccacctgttgtgttccaggagcatcagagagaaaactcccaggagacatgtcgagaggcaggaatgataggggcacacaaatgttcaacagtggctagaatttgttttaattgaaaagatggcagatttttattctaaagaatattttgaaataggaaaaaaattaagactatccactctagtgtaactattttcattttttttttttaatgaaggcttttggggaatctttacaacctgtacatccacataggttctgttacctccatttgtaaagatgagcaaattaaggctcagaggccttcggtggcctaccctacccaaggccatgtagccagtaaataagtggtagattataaagttagaattcaggctccagtctgcctgaccctctgtgcacctcactgagtctttttctcctcatctagtgagaaaactacaacccagtgtgaccctgccttctctggtgtaaatggcttgactttgagcacatgactcagcagctttggcagccccctggctcagtaacatcccgtcccagctgctccttaaagggcattgcctacagtgaccatagtgacactcaagccaagtaacatagccctttgaatgtctctctcatggcttcttccagggatcttaaagccctgaaccaaggaagagacctagtgttcctgactcaatgtttatttattaagggcgtgctttatgtgcagtcttgagacaagggtagtagtgataatccagagttcatggttaagtgggaagggagagggagtgcagagcagacatgcttatggtgattggagtggagtgggcagggacatgggaccgggagagagctgatctgagctcagagctcagcagttgtcaggatcctcatgggaacctgggattagagaggtgccacattggaaatctggcaataatatgacccaagaaggagccccatgggacctggcaaagaactgagggggccaggcatggtggcacatccctgtagtcccagctactccacagaggccaaggcgggaggattgcttgagcctaggagttcgaggctgcagtgagctaggattgtaccactgcactccagcctgagcaacagagcaagaccctgcttcaaaaaaaaagaaagatttgagggggcccagagtgaggcctgtgatgaccacaggtgtcccctgaccctcaggcatggtataaagggacattgggtggatatattaggctgttcatgcatagccattaagaaaggcttgaggctgggtaatttataaataaaagaggtttaaactggccggcatctgcctggcttccagggaggcctcagggaccttttactcatggcaggaggcaaagtgggaacaggcacttcatatgacaaaagcaggagcaagagagagagtgggctgcaggaaggtgccatatacttttcaaccaccagatcacatgtgagagctcgagtgtacttatcaccaagggaatggcactaagccattcatgagggatccacccccacaatccaaatacctcccaccaggccccacctccaacaccggggattacatttcagcatgagatttgggcagggacaaatatccaaactctatcagtggggtactactacactttgaacatctgcttatattgcctagaacctggaagaagatgctgtaatttttcaatcttctttcatttcagctgttcatgccaagagcctggtggccatcttacacctgctcgttgctctgtctcagtatttccgcgcaccaattcgactcccagaccatgtttccatccaagtggttgtggtccaggtaagacaggtaacactacaaacatctgtgtctttaaagagtcgtggaggtcgagttcctatggtgcgtcgagtaggtcattagaaggatggctgcatgaatgttgagtgagcctgggtgtgcagtatattgggaggcactgaatgagctttctgttgcatgttggcttcccctggtaagtgtacacaagatggaagagcgtgtgcttgtgtatagatagctttgtgtggggtatgtgcctatggtttatgtgtttttgtctgagttttctgtgtaatgtgtagatgagggtgtgcggtatgtatgtgagctgtgtgtcatggggtcaggaggaaaggtatgtgggtgtgtgtgtgtgtgtgtgagtttgtgtacaggagtgtacaggtgccctgcaaaccatggagaaccataatattttggttaaacaaatgatacttaggtatggggagaacgatatctgtgcatataagggaatgtgtgtgtacatgtgcatgtgtttgagagagaccccaactggccatgtctgtagtgaaggtactgccactgttcacccactcacagaagcacagctgggatctcaagtcatcttttccagattgttggatggaatttccattcacatatggctgtgtaatttccacaatgagggtgtgctctctccctgtgactatctcactccgctcctaaccccattaaatacccaaattcaattttattttccaactttatacccatttagcaaaaggtcatccttttgtttgcttgttcctgttcttttccaaataaacatgcagcaaaggagagctctccatctaagcagctccctggcgatccaggctctggaatagggaatgataacagtggctctgccatcccttgataagaaaaagccttgagggctggtagactttgccctgtcagaccaggccagtttccaagacaaaaggactttgagttgaacttccaaggatcagctgtcaacaggaggagacaaggaaatggtcctcctaatcaactgatcagttgtcccccagtgaaaaactatttattccacacctctgggtacttaactccactaagcattaagaaggtataacaggaatatgacacctcggccctgcctgctgaggagataggactacaagtaagaagcagagagggctcataggaaatgggaatgtgtgtggctcagataccgagtgccactggccaaaaggtcctaaatgtcctcgttattgagctcttcacttgtctcaaacatggcactaagcattttatgtctgctatggatatgtggccaactcagactactctggttcaagcatcttcctagtgagtccaggtcatctctgtcatgttatttttaccaatcaatgatgtgtgaatgcaattctttatgtttttaaaaactacaattagggaggcagagatgaataggtggacatcgtccccataggtgggagcacagaggatttttaggtacatgtcactatacatttgtcaaaatccatagaatggacagcaccaagagtgaaccctaatgtcagttatagactttgggtgatagtgacagtatcaattataagctcatcggttgttaaaagtgtatcattctggtgtaggatattgaaagtgggtgaggacaagtatgtgtcagggcagggaatatataggaaatctctggaaatgtctgtaccttcctctcaattttgctgtgaacctcagactgctctggaaaatatagtctgtttttttttaatcatggttcctgaaacagttcatgaaagagtactttaaaagtgaccacatatcactaacattgaaatttttaaaaattattttcataagtaaacatactgctgttatattcatttataatagctctcttatcactagaggagataaatacttttatgtaaattgcccttctttatcttctcttttgtgacaaatccagtccagttctttgtgcatgaatttgttgaacatcttaagacttttcttatcagctagaataaacagccctctaacagaaataataaaatctgcctgctggaattactacagactgaatgatgactgaaaatgtgagcaggagagagggggcttctattttgaaacagtggtcattgcaagcctgtgtctcctgccttattttgagctcaattataggccatcagaagcctgttgtcagtttaatttctcctgtaggctgttttgttagcatgagggagaaaagaggacatgttccataaaatggcattaatgcacatcaggttttatggggtgtttttgctttatcaagttgaacaggcacagaagcaagactcagaattggtggtgagtcacagactgaaccacagggagaactctttagggaacaaataatgggtggaggtgaatcaggatgctgtgtgaggggttattgaacccagatttcttttccattctatgcagaagcatttaattttgcagaaagttggagatgaggttttacgtctatgaatggccatgcaggacaaggacacagattccattaaccccacatgaaaacacagcctgtgttgaaactgcatgtggaaagaagtcctgatttatcttcacctggtcctctttaaatgatagatttttttttttcttttacctccttttttgttttgattagtccattcttaatctaagccagatagactcttggtcttatccagttcttcctttcttctgtaaaagtattttgcaaggactctgggttctgtggaactttgggcaggaggctcgagaaggcagggctcagatgagccacccaagttcagaggctccttccttcttcacgctcatctcagccttggggaagatgcatttgcttggtcaatcgcttgctatgtcacagcatcctccaggtgtctggtgctggtggtggagggacgtagtagaatgaatctccctcctcacacccatcagaaagtcttcctgcaccccaacattacctccttcgtcagctcccatgcccacacagtgctttttaaaccctccaaactggcactcagagctgccccctgactgatggcagctgccctcccctggatggcctctggaacacatttgtgcgtcctgcctctgcctcttggctggggccattcctcccattgaaataaccccttctcagtgtccagctccagggccccctccccttggaaggtttctctgaccattctagctaaaagtgcttgctcctggcctgcattcagcactttctgccgagggtgaccacgtaatctattattcataacacttttgagatgaaagggaatcttactaatatgctgggacatcagggataaaccaggactgttttggggaaaccattctcaggtgtctacttcttctatcccgattgactttagctcctcaagggcagaaactatatcatatactccatagtatttgttctaactccagcacagggccttgtacatagagggcactgattaatgaaataaacaagaaagaggataagttgatgggagaagtgtggacagatggatggatggatggatggacggacggacggacgagtttctaacatgcttaaccttttctcagagaataagctagttacctgagtgaggacttactacttatttaaaagctcccatatttatcagttaaaaaaaaaaaaaaaaaaaaaaaccaaaaaaaaaaaccctctgcctcttgtctgaattcctagttggcctcagttcctccacccagccccccagttaaatgtgtttctcagcttccctctgtggccccagctggagggcagacacaccctggccttcatttccatttggtttattgtggattactccaggaggcaaacagtttgcttccagcagcatgtcttccaataaagaaaggaaagattcaccatccaagaaacagcctacttgtttggactaaacactaattgcacttgcgtcctaatggttcagtccagtccctgaaaatcaggacctcctttcacttccagcattatcttatcttgggtgcatttcttaaacaccagtaactttctcattatcaggaatgctcatcagtgtttctgtatttttctaaagcatagttttctcttctcctcccaacccctttccccacccccatttcagaaacgagaaggaatcctccagtctcggcaaatccaagaggaaataactggtaacacagagtatgtcaacaccattgttgccagcgattctgtaatggaacacagatgtttctctgaaattcatccatttgctgatatttagttttcatttattgggattgcaggagggattagacttcagccaatgattatagtttagccttttccatgcattcaaaacatgcctctcaatgcttaaggtacaaacttgggtggggaagtagggagacggaattagcagtgattgaaaacttctaattttgtgccactccaggaaaaagtgtgcccaaaaaaagccaacccagcatgaaatcgtcatgccataaacactgggttgaatttaaattgttaaccttcaaaaggacgtttttcttccttttctgaatctgatttgggcatgtgccatgacccagaaagcctctctaccttagatttgtcttttggtttggggtggttttttttttttttttttcatttatttttagaaattgggatatcagaacctatcaaaattttgccatggggaacaggagttttctcctcaagcagaaaaaaaattcatagtgtggggtgagtttgtgatcccgagaactgcaccctggccccatgcaaagtcaggcagttagctttcagcattccctgctccccagacttttctctgagtcccccttgaacaagagcagcatagtgcaaagagcagaggctgctaagccaacccaacttgagttcaaatacaggctctgccacttactcaccaggtgagtcccttaacctctctgacctcagttgccccacccagagaggtaggaaagatttactgtggtcacagctgtgacttcgttcccttgccctctgtagctgctgttccatcttttctccagcacagctgacccgtacctgccaagcccatccagtctctaggaggttcctgccctctgcccagccatgactgacaggagtctggggcactgcccgtctagatcacattgtgtacatggcttaacaaggactaaggggcgtgggcattccaggccgagactaggggccagagatgtaaagtggcctttcccaagatgccctgtttatggcctatagagaccccatcaagcagcctctgtatcacctcagaggccagtcttggtagctgaagggtcaactgatctatagggcacaccttggccttggttctgtgagggatgggaggagccaggcctgttgggaaaggagaattcctcactgtcccaccgcccaccacccctcccctatgctgggcttgcctgtgcccactatttcacctctgggaaagaagacgacagagcagagaggagcatggcctgggagaaactcccaaaccagggagtgtgaagtttcagattattgaacaatctctcggatgcatgttatgctttctatggtccctctctctgccacaaagacataaacatggatgcaatgtcctaataatgacaacacagtacaatttatgggacactttcctatctattgatattgatagtaaacacatgaagccatgattacaccccctaaaaccccacagcccaagggtgaggaaggagactgtgcccttggtttatccagcacttaactccaagttcattattctttccagtgcactacttgcaagtgctcacttagtgggtgacaggtgtgctgatggataaaccaatataataatcattatgagaaccaaaagtgtatttggaaaaaagtgttttgagcatttactacatactaggaattatgctaaaatatttctagatattaaatcatttaataatcacaacatctgatttaagtatttaccataattatcttcattttagagatgagagacctggtgcccagaaaggttcattagcttgcccaaagtcactgtatgagttttttttccacacttctgataaagacatacccaaaactgggaatgaaaaatggtgaaaaatggtttaactggacttacagttccacatggccggggaggcctcagaatcatggcaggaggcaaaaggctcttcttacatggtggtggcagagaaaatgaggaagaagcaaaagaggaaatcctgataaacccatgggatctcatgagaattattcattatcatgagaatagtatgggaaagaccagtccccatgattcaattacctccccctgggtccctcccacaacacgtaggaattctgggagatacagttcaagttgagatttggggagggacacagccaaaccatatcagtcacacagcaaaaaaatcactcagtgcaatttaaacctcaatgatgtgtctttaaagcttgtgctcttgatactatgctgcttctctgctatgagtgtggttccagttcctgcactctttgagaaaacctaccctgggtcaatggcaggtacatcttggtgggtactacagggtggacaggagagagacaaagctgacctgcccacagcaacctaggcagtaaaattctgcattgaggggttgcttgagctcactcgtaagaattctaagattttctggttggaaatcttcagcccctgagtccaatattctttaactgcaggcaataatatgactttatttaaggcaaaaagtgatcctttaggcatcactatgccaggctttgcattacaccactatatgggtgtaactggggggaaaatgggtggtaatgtggtaaagtctcaataattggaggccgtgcagaataaaatgccaatggaaggaggctttttgagctcctcaaccaagggcaggtgggtggcaggcagcatggggtgggcttccagcagtgatggagtgtcctttcagaggactggcctcttataagggacaagagaagagtcacactattttctttctctttttcctccagggctctttccgggaggcatggtaagtcacataagattgtcctctggcactggtggctgcactggggctttagttaattccgcagcagctgggaggaacaggctctcagcttgtcacctggatatacgtcttcaccagcctgggtgacatggccaattgggttgggagggacagcttactggcgggaagaagactacctacacctgcacagttgtcttgaaagttatcaggccatcattgaccttgccatttacaaagcacttttgtagctattgatgttcacagtaaacacatgaagccacgattacaccccctgggaccccacagcccaagggtgaaggaggagattatgatcttggtttatccagcacttaactccgagtttattattcttgccagtgcactacttgcaagtgcttatttagtgggtgataggtgtgcagatggataaacaacaatcaaaaagaaccaaaagtgtcctcagaaaaaaacgttttgagcatttactatgtcctaggaagtatgctaaaatatttctaggtattaaatcatctaatgctcataacatcccactgaaatatttactgtaattatcctcattttagagatgagagacctgtagcccagaaagattcattagcttgcccgaggtgtctggatgggtcctgggcattttcagggcagttctgctctaattgtctcgtggaaataaaggaagacatgcatgaacacaaggactgtcccctgtccccactctgtccttctagagactgtcttctctttcttccctcatcacagctcttatctcttccatttatcacgactgggtttgtttgtttatgaagtccatgaatgttagggatcaccatccccttcctggtagtctcagatttacccactggtgccagagttggaaaaggcaggcctcagggcctcgcaccctcccagccccaggttcaccttggagacccttctcctttcctgagtcagatcccttccactgtgtcacctctcagttctgagaacacggaggctgcagcaaggagaatccctgcagggagcatggctttgctattttctatgatcctgatatttactgtgggtaatattttgaaatatttcaatcatgctaaaaattattcacttcaggagaacatgtcagagtttacagagcacgcacatgcttgttctcacacttcatcctcatgacaaacctgagggagggttatttttaaaatgacattttatagaagaggaaactaaggcacaaagagttgaagtggcctagatcacttaagaggaagagctcatatcccatcctggagctccctggctcccagccctcttctctgtgccctctgccagcttgtttgtcatgggtctcctgtttttgaaaattggggggtgaaattatttaatatttggataacattctccctctacagaggttcagaaacacctgaacaatagctacgttaggatataatggaatacaatgaagggaaatgactaatcccgggtcacactacctaaaagagccctgagcctgccccaatccaataatgtacacatgcacggacacagacacaggctcccagggtgagaatcaccccaaatcttagccccaaatcacattccagagttcccggcacagtctataccccagaggcttcccatcggtagttgaccttgtgaccttgagaggcgcgtggctctgggacccaaggtgggcttccctgccagggatcagctcttgtgctccacattgtgtttccctctttttcagaacgtgatgcctttgacaccttgttcgaccatgccccagacaagctgaatgtggtgaaaaaggtgggaaaggggtgcctgggatggacagagggaagcgagatgcaacagaacattgggaaaacccatccctgcagcttgcgagcttcctgccagaactggtggcatcacctaacctctgcacacacagggctttcccccttgccatccatgtacctgtctgttcctcactggatgttgcacctgggccttttcccctccatcagcatgaacagcctgtcttcccacccaggctaaccccagcaatctcagccttccccactcctcacagaattccctgtctccctggcctaggcacctgtgccgaagaagggacaggaaggagagatccagtggaatcattttatttcagttcccccacccagacactggctcagacactccacctatcattctgcctcttgggacctccttgttccttacacgccctgagttgtatgggactgcaaagtcgagcctgtggccctccctgtgcactcaatggcctttgcagagagagctcctgggcccagggctcttggctgggcctgatcctctgctttcaccctcacccttgccctcacgggagtcacggagcagccacaggctcctgcactagtgcgagtccccagcttagggcctgctttgcttctcttttagacactcatcactttcgtgaacaagcacctgaataaactgaacctggaggtcacagaactggaaacccaggtgggtgacagaccccagcacaggtagaggcagggccctgccctacagcccctgttccaagtggcccaccacacttggccaggagggctttcccagctgagggggatgagggcatgggaatctgtcctactctgaggggtggactgagtctctgtggattttttccaactttttattatgaaaattacaagaatgaatactcatatacccttcactgggatgcaccgattgttaatatttggccacacctctctctctttctctgcacccctaaatgcttgagcatatgtctctcaagaacaagcacattctcttaggtaaccacaacacaattatcaaaggcaggcagttttaacataatacattaatctgtttagattgaatcatatgaaattgctgacattcgactgtttttgttttctgttttgttttgttttttgagatagagtttcactcttgttgcccaggctggagtgcagtggcaagatctcggctcactgcaacctctgcctcccaggttcaagcgattctcctgcctcagcctgccaggtagctgggattacaggcatgcgccaccaagcccggctaattttttgtatttagtagagacggggtttcaccatgttggtcaggctggtctcaaactcagacctcaggtgatccacccaccttggcctcccaaagtgctgggactataggcatgagccaccgcacccagctgactgttcttaacctactaaaatggcaacatcatgtggttagaaaaaacactctgttcagattttgccagttgtccagtttgctcacatgctgcatttacttgtcatgtctctttagtctctttttaacgtagaacaactcctcggcctttcttgttgtggcactgacactttttgaagtgttcaggccagttggtttatagactgtcttttctgcacatattagattcaggtcatgcattttcattaacagcacgtcccaagtaaggctgtgttcttcccggggcatcccaggaggaggcactctgtccattagtcccactgctagtgataacttggattatttggttaggatggtgttcaccggatttccctattataaagttatttttcctctctttatacttaactaatctttattggggagatattttgagcctgatgaatcctgtttccccacctcctttcattcttggtgagcttctgccttatacttctctttcagtcatctgggtacctccttttattttaaagacaaatgccagcctgtcgctgagctccacctgagtgtgtctagactgtgtgaaatgagcttcatgtactcttgtaggaaataaggaatgttctggaaaagtgacgcttccttgagtgagctagaatgggccctggaatgatcagctccgttttcaagggcagggagtgctatgacaggggtcactgccaagcactttgggtctctacagttttatctactattcctaccaagtcagtggaaccagccatgggaggtgaggagcagtctaagcctggcactcagagctgtgaatgaccccaaccctaacccaaggtcacccctgagctcacagattggattcttttactcctaactccttctcaccacagcttgaatgaagcccagttgctcagctcccaccagaagggccttgattttgacagactctggggtctgctctcccgtgtccacctagggtgagtcatgctcaggccgttcccacctgagttgcaggcctgatggatagaagctgggaggagctacccttttgtttttgagacagggtcttactcctgtcatgcaggctagagtgcagtggcacgatcacggcttactgcatcctcaacttcccaggctcaggtgatcctcccaccccagtctcctgagcagctgggactacaggcatgcaccaacatacccggttaatttttttgtatttttagtacagacagggtttcaccatgttgcccaggccagtctggaactcctgagctcaagcgatccgcctgcctcagcctcccaaagtgctgcgattacaggcatgagccaccgcactcggccagaagctgcctttaaggcaagcgcaagctcagggtcttgtgcccttaatgacggctgagccgcaggccggctagctggctacctggaaagctctctgagcagactctgggctcctaaggtgattccaagaaatgtggccttctctaaaccccagcagctatatacactcataaacatttggtggcccagcctcctttgaaagggttctagaatgtcggatgtgcatctgacctctatgtctttgctaggccatcccccctacctggaaccccctactcctcccaaggtccatcatccccggcctccacaagcctgtcctgagccctcagtgtatgctcacttcacccagccctaagcagaagaccagcagcctccgcacttagctgagggactctcctgtcccttgggcctggtttcccaacccatctggcctcttctgcctaggaagggaccgggctgcaagcctcctgccagggccctcagcacatagttctgcttttgccagcaagagcaagtaagtcatgtcctgattgctttgttgttttcccagacagtaatagcaacatttaatatttattcaatgctacatgcctagcagtttacaggccctctctgcatatttaactggcttagtcctcacgataactctgtgacatagatactattctattaccatccctgttttacagataagacatatgagtacagagaagtgacataacttgcccaaggcatatagctagtaggtgagagagctggaatttgcacctgggaggcctggccccagagcccacattcataacagctgcactctgctgctgtaatactgaagagagatgggagaaagaatgcccagccctgtgtgacactagtcctttctctgttcagaaagcacagatctccccaggaacctcatgccattcaccttggacatcacctccccctcctccctctgtcccactctagccaatcctgctcatcctcagctctccactcaggctctgtcccctccagaagactcctctgatgccttcagtgcttgtgggcgacctttctcaacctcactcaggccagcgagcttccttccatcagagcagctgtgccttgcccccacaccagtttccctattagactgtgtactcctccagggcaggagccacactgaccaccccccaccccccaccccccaccatgctctggtccccatgcctagaccaggagttggtacacagcctctgttcagtaaatgctgggtcagctgagatcagggcctgggcttgtggctcctgtgccagccagacgtggggcagagcagacctccttgtctcgggccactgcccctacccccgagctagcagcctggctggggtggtaggcttcaggtggcatagcacagaagttgatgggccccctggatggggattggctgggaggctcaggggccagtgccatcacctggctcttcctccagtttgcagatggggtgtacctggtgctgctcatggggctcctggagggctactttgtgcccctgcacagcttcttcctgaccccggacagctttgaacagaaggtaaggagaagggacatcaagggaggccccctagcccacatcccctgactcatgtgcccacacccatgctggggctatccagaaaaaaggcagaagcttcccctctgctcaacgtcttcagtgcctggaggtgggacccattataagagctgagctgggaaggagctacctgcagaccactgggcatccctgactgcctttcccttgccctgaagcctggcccgggtcccctgccctgtgtccctgtcaagtgccccagcccagcctcctctctccccagagatgacaaggaaagtgactgtgaagctggtcagccctgaggctcatgcttagcctggttctgatggcctctcgtaggctgccacatcctgctcgctacacaaaggcatttgaccagaaagcctgctctgcctgttgaacatgtcctgccatctgattcttccagacgtgtgcactgacacccccaatttgaagtcctggcagtttacacaggaacacagtaggatatgaagggagttttgtgcttctccaggagtgcttctcccaacagcaagctaggatcagctagctcacgctccaggtggcctgcccattttggtagccatatttctccttgaaattagttcagcctctgtccctctggctacagtgctgggctccttcacttcccagggccaggtcctggggctcctgggtgtgcaatggtacatgctgtctgcatctctcttgccaggtcttgaatgtctcctttgcctttgagctcatgcaagatggagggttggaaaagccaaaaccgcggccagaaggtactttgctctttcctgggtttgtgacaacagagtgagaccctctccctgcacatgagtactcagattttgtagcagagggaagcattttctgaagccttcgttgctggggaaggtgggactcggtgcagctgctcagtcccagagaccctttgtgagctgccagctgcacagccaggggaagaaaagaatctgaaatcccacacatgccatgcgtgggatcgcggggatcagggaccgagcagaactgctgctgcaggaactgccctgtgcccaatttccaggttttcctgtccctgcacagggtgctgacctgccaaagagctgtgtccccgccagtcggggtgaaggtgcagcgcagacagttctgggctgagcaaaactgcttctctccttacagatgcggagctctgcctgctcagactctgtctgaggacaggccatgatttgtggggtttgggttgtaaatataagtctgaggggaaatgcagaagggacaagtgcttctgcagcccctgcatactcctgctaggagtgcacacgtgcattcgtgagcagaggaggcacgcttctcttagtagtcttggtacggatgattgctttctgccccttactgactgaagtattccatttcaccagagctggcaggtcaccactgtgttgcagataatctcctgcatatgtcccctgggaacactgagaatgccatctgtggcccttttgctcgcacttttctggtagtttataggcaagtggatgagtaggaatggtgggctctcatgcccccttcctgcctctgctctgagctcctctatccaaacccccacctagtgggggccatgccctggtctagtgggcttgagaccctgtagaccatgatataacaagaggggtaagaccttcctgaacctcaaggcacgtgtagccaaccagggaagagaaaagttggagccagttagcaaaatgaaatgacagtcatgggaactgttacgaaagaggtacaaggaagagtctgtgaggactgaggaggtgataccacttctgtcttgggggaggaacagtttgatggagacagtggggctcaaccataaggaccaggtagggctttggtgtatggagactgggagagaagtgtgtgcatgccagacagaatgacagcatgagcaaaagtccccccggggaagaatggggaccctgtctcatgactccttccagactcgttatctattgactctagccaacaaaggtcaactcctgttctcatttattaccaccttgtcctaagcccctggtcaactgagacctgggggaggacctctagcaaggctggtgtccccctggggctctctctttggcaaggccactccagccttcctaatgccattaggaatggactcttcttgttctgtgggcagatgatgagcaccctgcttctgggaggacagacacagtgagaaagttccgaccatcattttgcttccactttcttcaaccacttaatatgaaacttcctggttacagattggaagtacttctgctattttagaattgggatatttctttcccttgggacagataattttcccaatataaatcaatctatgggaatattttggaatataggtgatatttttatgcaattattaagttgctgaatgtgaaactaacagactgatgtggatggaaaaacacgtgttttatttgttatgacacagggcattatgcccatgctgcaaatttccagtacgtaaaggggaatggaaatagcattttatgaaattgtactttgaaagaagtgaatcccagcattccgtctggtttttatgcttctacctggaaagtgagatttggaagtaaatgatgcagacatttcaaagggtgccaatgtgggtaattctttgagggcatttcaaaatcaaactggttgtggtggaggcatttttcatggcaacatgtttttaaggtcaggaaaatgcattctctgctgtgctgtttaacactcaaagctctgttgtgccttgaaatcccctagaaactgggtttgtatctgagatgacttgctgcccaggcttcatgaccgtttagtgcctgagttagtgtaagccaagggttagcatcaagttcctaaccagtggagcagtcgaaataatggccaggcatggaagctcacacctgtaatcccaacactttgggaggccaaggtgggcagacggcttgagctcaggagtttgagaccagcctgggcaacatagtgagaccccacctgtacaaaaaatacaaaaaaattagccaggtgtagtggtgcatgcctgtggtcccagctcctcgggaggctgaggtggaagggatcgcttgagcctgggaggcggaagttgcaccactgcactccagcctgggcaacaaagtgagaccctgtctcaaagaaaggaaaaaaggaaagaaaaagaaatattgtcatgcagctggcagctttttatttagggcatcgtgccacatgtcttcaaatgcacatgtccaccctgttatcacctttcaagtagactcatcatcaattatggttaagactccagaataacaggcaggcagggactcagaagacatctagtaccaggcaggattgaagtctgtaggactaaatatctaaaatttaaggagtctcatacctgggaccagatggcaagcaatgctgaaaaaccaagcaggttatggcagcttagttccaggtgatcacttcatttggggaagacttggtcagtggctgataacatggaaaatgttcaactcccccattcccctaggagatagtgtacagaagccaatggtgacaaacatttaaaactctaatcataccaagtgttagcaaggatgtagagcaacagaaactgctggtgttctaaattgctagaaccattttatttttattcagtccctatttagccgaaagtagaaaacagtttgttctcatctaacatagttgaagatttgtaatacgctataaaataatgtggtagacaccccctgccaaaataatgtggtctccacccctggccaaaaacgtccaggtcctaatcctcggtacctgttcatgtgttatcttacatggcaaaagggactttgcagatgtgattaaatttagggtcttgagatgatgacattatctaggtggtcccaatgtcatcacaggggtccttattataagtcgaagtgggaggcaggagtgtgagggtgatgtagcataagaaaggctcacccaaccattgctggctttggggatggaagaggtctatgagccagagaatgcaggcaaccccagagggttagaacatgagtaactaactgccttatggccacctaacttattccatcccccacttggaaagaacaagtgtaacgatctccatttcgagcctccagaaaaaaatgcagctgtgctgacaccgtgattttatctcagtgagatggatttggggcttttgatttctagaattcagagataatacatttatgttgtttttaggccaccaaatgtgtgctaatttactacagcagtaataggaagttagcacactccttgacttagcaattccattcataggtacgtatgtccatacaccaggagacaagcccaagaatacccatgatagcataggctggagtgtacatcccagtagactagctacataaattgaagcatattcatatcatggattataatacaaccatgacaataaaaaagactgaactgagaagtcagggcaggaacttctagttactgtagcctgaagagatcagtgactattctctgcaaaaaagcaagtgtaaaactggacaaaaatcatcaaaacaatgattttgaagcactgaaaacctaccagaggtagacaacaaatcaagagctttattctttttttttttttttttcttgagacggagtttcgctctccaggctggagtgcaatggcgtggtctcggctcactggaaccttcccctcccaggttcaagagattctcctgcctcagcctcccaagtagctgggattacaggctgccaccaccacacccagctaatttttgtatttttagtagagacggggtttcaccatgttggccaggctggtcttgaactcctgatctcaggtgatccgcctgcctcggcttcccaaagtgctgggattacaggcgtgagccaccctgcccggccaagaagctttatccttgaacaattatagaattatagttggataattatagctatacctcagtaaaactgttaaaaaaaaaaaaacagacagctcatgtaacaacatagatgaatcctgtgaaatacaaaaagaggcaacatttgaagctactgttcaagggcacgtatgttgatgctaggactggtaagaaaagcaaggaagtaatcataagtgtcagcacagtggttatatttggggaatgagagagggaatgtagaagggggaggggatgcttctaggatactgacaatgttctatttttgacgggcaggagttcattttcaaatatttaaaacagtacatatatgttgcatgggtttttttctggatgtatgtcatatttaaaaaaaatttttaatgacttaaaagtttttaaaaataaataaagcaaatggcaaactcaccaccagatagggcagtaggtcaccacgaaaaggagcatctgtacagcatggatcctgccccggtggggaatagagagcaggtagagatgcgagacaggatgagatagaggcgcagggaggtcggctgggggctagagcataagtaaccacctagtggccacctaactgattccagcccccaccagctgccagccctgagccagcaggggcctcccaccttggtcaaggggttcagagaccgtgggggaaggcttcggagaagggccttcagcagtgccttgggatgaaggaaactgtggtgtcacaaatggccacagagggccttgtccctttgtgcaaagacagtttctgctgggaagagagttcctctctttcctttggcctctgcatcctttagagattcatgaactcattttcgatggtcctctcctgatagaaagagtcactaatacctctgggggggaggagcaaacaatgagccctttccccttggccagaagctgttttatctctagagccacctcttccttggccccaggctgtcagacagcctctgttctggtgtatctgaccagaagccccatagtcctggctgtctgcctccagagaggggccctgggccagcacacagaggctatcagaactgaactgagttgctaatcacacaatttatgagaacagggctttgacgtggctctgtttatacagcatgaagttacaatatattcccaggaatccacagcccttctcctggctgagatagtccagtctccttttggcctactagtctgcctgggactacctgggggcccaggtcttggctttcttgataagaacaggtgataagtgataggcagtgtctctgactgctgtctcccctattcacccggcccatctgttggcgttagtggtgaaggtggtgaagaagcaactcagttttccaaggagcagggcttagtccacgtgaatgatgcaggcattgtgcagtgcacagactgcacggctatacatagcagctctgctaatgggcaaagatgggaaaacagaaagaaaactaccatttaggggacccttaatatattctgggtgtttttcataaaggtattgcccaattttaccagtgagaaaactgattcagagaatttaagtgactgccagggtcacacagctgtagtggagatggacttcaaacttctgtgaacataaaaatgtcacttagtaaccattaaaatggccagtttaaaacattctcccatattggacattttctttttctagcaacctcagaactcacccacctttcaaaagggaaaacaaatccccctgcctctatcagtatctgtccttcaccaggcccccaaattcctcctttgcgacccgtgctcatgcctccacttctgatctgcccgtgctgttattaacattttacctccacctgctcttggccttgctctctcccaagtcacctgctgggcctatgttccctgggaactcttttcagtccttaacctcctcgccctcttgggagcgcgtggccctcttgtccaccctctctggaatttttttccttggcttccaagacggtgggcaaccattcattcatggatctgttaatatccttggagggtccatgctctctgtgttcaaggaacctacagtccaggacagaggcagatgttaatcaataagcatacaagtcactgatttacacctggagtgagtactatgaaggaagcatgtgggagttttgagaacataaaacaggacccctgcgcccaggcgggggtcaggaaggcctccctccaggagcctgtgctttgagctgaggtctgcaggaggacctagagccagctatttgggaagagtgatctagatgttgtaacagcataggcggaggccaagcatggcccatggggagggtagtgaaaggaagccacagtgactgtgatacatagtgagggaggcagtgtggtaccaaatgagagtgggaaggtaggcaggtcgggtcaggttacgccttacaaagccacaatttaggattttggaccttctaagggaaatagttgtatggccatacaagctgtgagctacacagctccaagaggccctgtttaccttgcagtccatgacagtggtgccctggaagtgtgaatgatgtgccttggagttgtgcagtgtacatcctgcacagccatgcctggaggcctatcatagtctggctccagtaggtagaatggtttggaaagggtaaggggagcttattaggagcctgttgcaggagctccaggcccactttaccttcccctttacacccaactcccttggcaagctcacctttgcccctctctgcctttctagcagttcctccctggagtaacttcctggtatttgacttgagtagaatttaagaaacactcaacaccaagcagtcaggggaggacaggaattggcctagagggcatgggattccatctggcagaaggtgattcagggtgggactcctggctcagcattagcaaggcaaggtagcaggactcagcctcaggccagggccccagttagaggctcagatatgtgatgaagcaccatgggagcagaaacagaatctgggagctccaggccactccaggcctctccatgggtctctggaagcccctggtctatcagtaggagaccttgggcccagccagggtggagcagggttggtctataaccaggataaggcctggagggagcaggcaggaggggccttggggtggggggaacctaaggaggttcccccaagccctgggccctaggcctggagcttggggcctgagcatgccaggctgtggcagttccagttgcaagaatcccaaggctaaatacagagtgatataacggactttagagactgagaatggcacaggcaggagcgggcacagggataaaggaactaatacatgttaggtacaatgtgcagtacttgggtgatgggcacactaaaatctcagaattcactgctatataattcattcatgtaacagaaaaccactgtaccccaaaagctattgaaataaaaaataaaatctttttttttaaaagtcccaaggctaagacctgggagcccctggctccccactctgcctactcttgaaggatccctgtgggtattgaccagagcattgctagaatcctgacaccttcccccaccccttctttcccagtggcttggtgtaatttctcccatctttgaatcccagggcatttattaccttctcttaatcacctacttcatctgacctcccatacagttgttttttaatcatttttattgtgaaaaatatcacatatacagaaaggtgcatgaaacataaatgtacaggttagtgaacttttaccaagcgagccagcacgcagccaccacccaggacaaagaaaaaagtaatgccggctcccaagagctcccttcaacttgccctgcatcctttttgaacataacctctcccttctccctaaaggtaaccactattctgagtccagtcatcaaggttttgccttgtttttgcttttctttataattttattacctaagtatgcattcctcaatagtagacggagttccatttttttgtttgttttctcttctcccactcttcaaaggttggctttctaggagagtgacagcagagggacaagagcagagagggggtcttgttgggggagggaggaaggtagaggagccagcagagggttagaggaacagccagagaaggtggtgaccagtaaatagatggatgaagggaggaagggctaagcacagtgtgtcagtgagtcatagctagcctgccagctgccagtttccagcctctagcctacaaaatcatgcaagctctgtaacttggaattcaaggcctttcgggatccagccccatacaccccaacctctctagccatgctggcctattgggaattctccagcatagctgggtttagtaagatacactaaactttccacatggaattctttgcccacttctgtacctggaaagctcctattgcaaaggaaggaaggcaaagagggaggatgggaagatccgggggcacggaagaagggaggaatagagggagggaaggaggatgggaggatcagaggaaaggagggagggagggaggaagtgagcgagagagggaatggtagcatagaagctgaggaacctccagctgaagttttagcacctcaaacccttctgccatgctgtattcttaatcggaacctgtctgtcccccatgacgcctatttcctgagtactccttgcaagtcccccttctctgctaggcaagcttctgtgaggcagcttgagtcctaatgcaccccctggtcttccactgcagccccaggccttcccctccttttcaccacccatggttggttctatgatggaggttggaggcagtgggcaaagagcccctgggacaggtggggattgtggggagggtcaggccttcttatctggagatgctgtgccccagcacctctaccctcactgccccctgctctgaattctcgctgcccactctacccatctgccccgaacatgctgggtacatgggattgggtggtgggtggaagggaggggcagtgtatgccagctttggaacatgtggccccatggaaacaattggtgttttttgttttctacgcagacatagtcaactgtgacctgaaatctacactacgagtgttgtacaacctcttcaccaagtaccgtaacgtggagtgaggggctgccctgggcccaccactgcccaagagttcttgctgttggcgtactggaccctcctccgaactgccttaccctgcttattcctgtctcttgcactgtgctctcccacaagtccagctgcaacccagagatagtggaaactgaaattaggaaggaaatcatcaataactcagtgggctgacccatccctcccaggcgctggggaccaacctagcaatgaaggttgggaaggttgttcccttcccggtgccaggtccagatttccctccatgatttgggaaccagcttaggcaaaagagtccccacaagatgaaaataaagatcctagttaccattcaaaggatgctaactgtgtgtcaggccccacactaagtgctctgctctgatatactcaaggccattaatcttcaggactcccattgacgtaggtgtttcattccccttttacagatgaggaaactaaggcttggaggttaaatgacttgccagaagttggaatttttttcctctttgaacataacctctcccttctccctaaaggtaaccactattctgagtccaatcatcaaggttttgcttttctttttagctaagtatgcattcctcaatagtagacagtacaacatgtttataacaagccaattacattatgttctttgcatgttctaaagttgtgtatgtgtgtgcacatctgagcacgtgcacatgtacacctgagccaaaaacacgagaacccactgatctcaccactggggcaagctaggtcagagcttagtgattcacactgaaattggcaaattggatttaacccaattaatagtgtgtgtgtggcaggagtcatgtccctcacatcctttgtacaaatgaaaattactcttaattccttcagatttataataactctgtactttggtttcagggtgacatttgggaaggattttgtttagaattaatggagtggcacattttgcagcctttttgcttgattgcatgtaatggaaatgccctatattttcctgcaaaataagtactaaattcattatcgttaagcaaatgtacaatatgctcaggcaccgcagagagctgggcacgggcccatgtgagcatcactttggaagtagggctcttcaacagggacccttgaactttaaagaaaggaacttctttttgccttctaattgatcatttagactattctggctaagtctgcccacatgtaattaccggctaattcaagcgaggaaaaatgtaagtcatttagaccaaagccaagcagtttctttgcgtgggttactcaagggcttgtggttacttgtatctcctctatgtgaacttgactttgaaagacagagctctagtgtgccagcctgctaagtcctgtaagaatagggaagggcggaggggggtgggcagtgactaggggacgagaagcatggggaaaatatttgcactctaaacatacagagatagaggtggggcttgtggtacttaacacttgtagccatcaactgactgagaccttgggctaaataatcaattgtgctgatattacatctcgttatggaatgttcctaaatatgccaggtagacaccagcccaagtaccctcctccagaagtctgtgactaccttgtcactactttaggcccattccacaaagcccatctctggtttgagaattcattttgatctgtatctacaccacccaaagttaggcctcctataatgtccaaaacattcctttcagcctttttatttcttactgtactgtctcttactgtactgtctatctgcagtaattgaggacccataaaatttagataactacatgtctttgctcttagaattgtcactcagcataatgagcatttaacatacaaaggcaatgtactgttttgtgttgatctatgtaaaagaatacaattcttttttacataattagtgaaattttattttttattaggaaacactaaatagtgtaatatttcttttgcttttaaaaaaattcctggtagcaaatcaagataaataattgcttcattttcttgagcaatactgaagcaggatgaagtaagaggaatgcattcatttaaacatgctttgctttatgaattttgtctcttttttggtctctttttcttatattcaagttacaaatgtacaagtatccttactaagagtgctccttttgtattttacatatatacagtatgaaaatacattggaacactaggaaagtttttaaataacagttctaatttatcagaaaattgtgttttgggattgagttctttgtctcagcccagaatcccaggtcctgggcctggttttctaatgctgtcatctcagttcgatattttactttagaacctggaatctcctacttaatatatgaccatgactttgaaaggcaaaagaggaatcaagaataaataaaacaaacttaatcttcatctttaaaaaaaagaaaaaagaaaccaaaatgagaatcaacacttcataggctcactgggttttcttttcttttctgttaatttaaactcagttatttttaatgcttaatacatacatggtgcaaaatttaaaaagcgcaaataggtatctagtggaaaacctaagcctccctctctcctccggcacccattacctctccctggaggcaactgttttgatccatttcttacacacactgccagagatactctaggcatgtaaagcacaaacatacatataaaatctgcgggcttcaaaaaatataagtaggatgtcatctatactgtcatacactttgttttttatcacttaatgttatatcttggatattgtattaccctgggtattaaaaagaactcctttcacattttaaaat

SEQ ID NO: 38238 - DNA, 107700 bp, Homo sapiens
gcgctaggtagagcgccgggacctgtgacagggctggtagcagcgcagaggaaaggcggcttttagccaggtaagggccttctctctccacaaccggagagtgcgggaagaccccggcttctctccacaccctctttctccttcgacttttggggcggggggagtgcaaggagtgtgagtccctccccctcgagataaggggtcgagggacgctgatcctccgttctttcctcacttctggggcctgcgctgggtggggagtgcttatgtcgggctgagcctttgctgcccaagggcgggagctgcaaataccccgtcctctcccaccgagaacactgcattctaactgtatactttctggtgtggtggaggaaggtgacaattcattaaaactccaaataccctccttccagggaaatactgtaatattcaactgttctttttccttcattttcagccattccctctcttttcgattttttctcccttccattacgccagctgaactctgtttaagacacttacacccttttgaggaatgttgagaatatagcagtccttgcagccgatgtgtcatccccgaatcgctatcgtgtatatatcgctggcacttgcccccgacatatgttggtgttaatgtaaggtaattgtacacccctggctacacatactaaagcttgaagttgtagctgctaggaacgaaccatctggcacccttcctagcctccttactgatgcttgcaagaacggtttagctgatcctggtgagagatatttgaactactattgtcttgcacctaattccagctttcaaaagtctgccttggacgggcgcagtggctcacgcctataatcccaacactttgggaaactgaggcgggaggatcgcttgagcccaggtgtttgagaccagccaaggcaacttagcgagacccttgtctctacaaaaaaataaataaataaataaaaataaaagataagtctgcctaatccagatctgcctaatccagatggttcaattgacttgacttttcaggttagtcaaaggtaattagggagttatcagtttttaaggcaatgcccattttggggagaggttttcttttgcattaagtattctttcttttgctcttgatttaaatggtttaacacagtaccttttatctgcttggttaccaatactattcacaaatgctaaatatttcaggagccatgaaataacaccaatcctttcttctgaggtatgatgtagacacaaaagaacatgacccctaacaacatgttctaagttcctgtagaggtataacctgggtgcaggatgatcacgttttagatagatcttcaaaaaattatagagttggcgtgaaagaaggcaaaaaaaagtgtgtgttcatatatgttttcttgttttgcattgatagaacaacatataatgtactaggtaattagtttaggaacttatttcattctttggacaaaatattgagtgcctttcatgtcagtcctactgtagattcaaagtgccaaacgtctttaccctaaaagaacttaaaatcaaatgggttagacagatccacatacaatttatggtattagtgaggtcatttctatactagaggtcagcccagggtactgtaggagcatagggaatataggtgttttgttttgttttttaattctctcttctgcttttccttaaaaacaaaaacctctgagtaataatgagtgattctcttcaatctatgtatttgtatcactttcatatttcttaccctctcttcctccaattctatggcctatggaaaatgggattagaccctgttgttaatgtggcatttagtaaatagttggatctgtttccactgttctgtattgggctgggaagtgttgttatcaggtagtccctgggaagagaacagtatattggcaacattagcaaaggagtgccattttgtaaaaattacctcattgtataactttctttaacttggtacactcaagctttgttccagactctggttaaaggtggggctaaatttcaacctaataattctaaaagaaagcttcagaagctaaaacaattcacatcttggtgacaggggatactttttcctgctaagatgccctcaaaatgtttttctctttctttttttcttgggtggggaagacagggtagataggtgggtggggaaaaatgtttttaagtataattttgactagtgtttcttcaggtttcaaattcttatattttctctggtatttttcaccagttaactgcaattaacttagagccctcgtaccaaaaaaatttatcaaagacacacacacagacacaaaagaatattgagagtgtgggagttcattagacatctttggcataatagggcacctaaccacaaattggaagaatttattatttaaattgacagtgaaactagtttcaggcattcttaattccatacactattagatagatgacttttagattagaattgtaccctttctgcagataggaaaatgtataacgagtcctaagttagtaatttccattagaaaaggcaattgttttttaagtttgctattgtctttcactgtatgttttttgatagaaacttaaggtacttcattttagattgcatacagtaatctccaggtgaggttacttaacacagcctcttcaggttactaacaaaccagtggttgtaaatgaagtagtttctacttaatgattatggagttgagagtctatggtggatgataaggtaggaccatactgatgagtttattctgaagctgggtgcagagtcctcaagactcagtcaaattattgtgctactgaagacctcttttcataaaaaggatggagtttgacctaacaagcaatccattattcagcatgtcagatgatttcttgacacgtgaaaactttctagagacttcctgtgtccactcataagaagttaacatgataccatgaaaattttacattcttttgatgttcttttaaataatttcttaatactactaccctgggccgggcgcggtggctcacgcctgtaatcccagcactttgggaggccgaggcgggaggatcacgaggtcaggagatcgagaccatcctagctaacatggtgaaacccagtctctactaaaaatacaaaaacaaaattagccgggcgtggtggcaggcgcctgtagtcctagctactcgggaggctgaggcgggagaatggcgtgaacccgggaggcggagcttgcagtgagcggagatcgcgccactgcactccagcctgcgtgacagagtgagactccgtctcaaaaaaaaaaaaaaaaaaaaaaaaaaaatactactaccctgaaactaagaactttcatctttaggggaaaaaaagatgcaacttttttgtacttctgataacaagtgtggatctattttcccccttaattattctgtaacagagtttatgatatggaaaactttacagtccttcaaatatgttttgtcttgcacaaagtattgccatttttgtttcattacccataaattagtcccaatatccgctttacttagttttagatttccacaatcttttttttctccataaactgaaattcaagctaatgccccgggacttcttttatttcatagtcagttttactaaacaggtaacatttgctcagctttggcgtctgagcaaaaatttggcttccagcactacaggaaagctgtctgtccatgcatagtatccagtggtttctgtctaacggtccttaccccttggcaataactgaccaagtgaacaacttgtctagttcttcctttcatttgcttttcttgacatgactactatctggttctccattttctaatctaaccacttactcccatgatccattaactcagtctttttgccccttaaatgccgggttcaccatagccctgctcagcttcctattctcactatactttctccctttataatctgatttctttccatgacttccactatcacctccatgtaagtggcctgaaaatttatctttttaaaaaacttctttcatattgtatatataattgttttattttcatatatgccaacacatttaaaaataaaaattatagatatttatattattataaaataaaaattatatatgtttattatagaaaatgtggaaaaaacaggccgggtgtgatggctcatgcctgtaatcccagcactttgggaggctgaggcgggtgatcacttgaggtcaggagttcgagaccagcctggccaacatagtgaaaccccatctctactaaaaatacaaaaattagctgggcatggtggcgcatgcctgtagtcccagctactaaggaggctgaagcaggagaatcccttgaacccaggaggcagaggttgcagagagccaagctcatgccactgcactccagcctgggtgacaaagcaagactccatatcaaaaaaaaaaaaagaaaagaaaagaaaaaaagaaaatgtggaaaaaacaaattataaagaagacaaaataacccatattccataatctgttccagagagatctatcatttgatatatttcctttcagtggttttgttttctttgatatacacacactcacataaacacaaaggtaattgaactcatactgttgcagtagatatagttttgtgtctgctttttttgctttatattatttttcatagcatcaaaaatttttgaaaacatttaaatggatatttaatctccattgtaatctatttaataatttattatattgaggttgcataatttatttgtgttttggttttacattaaatgaaaacaattgagaacaaatttatgcataaatctttgtgcaaatgactcattatttccttaggttagattcccagaggttgaattaccaggtcaaggagtgtgaaaatttaaaaatactaaacctgctcccaaattgctttttgtaaagattagactaattaacattctcaactgcagtgattgtgagtgcccatcttagtgcggccttggtaacattgaatattattattatgatgatttttgagatggagtctcgctctgtcgcccaggctggagtgcagtggcacgatctctgctcactgcaagctccacgtcccgggttcatgccattctcctgcctcagactcctgagtagctgggactacaggtgcccgccaccacacctggctatttttttttttatttttagtagagatggggtttcaccgtgttagccaggatggtctcaatctcctgaccttgtgatccgcccacctcggcctcccaaagtgctgggattacaggcatgagccacctcgcccagcccgtctggctaatttttgtgttttttagtagagacagggtttcaccctgttgatcaggctgacctcaagcccctgacctcaggagatctgcccacctcggcctcccaaagtgctgggattacagcatgagccaccgcgcccggcccgaatattattttttaatctttactaatttgataggcagaaatgaattaatttgtatttctttgctagtgagagagaacatttttcatacattcatttctgtttcttctgtgaattatgtctgggttaatcccactcccatttttatttgggcgttaacattttaattatgttggttttttgtttggtattcttttatttggagcgttttgtgggggaagcacaggcttttattagaccaaatagagtgaatggagtgacaaagtggaaagtatacagaagttggaattgtggtgttataaatgcccattgttttgaggggccagagcttgtgatcaatgaagcagtactgcagaatggaaagggtgctatttgagagtcaggattcccaacttaatgttgtcatcaaccaatcaggtgatcttggacaagtcattgattcattgactcagagcctcatctgtaaaatgagagggttgggcttttgatccccaagactggacaacctctgtgctgaaaggatgcctttggagctactactgttcactagacattctggaattactttctgtctcatctctaacctttcacctaattttagatatatagagcctgaggaaagactggatgcagtaaaggcagtgtccaccggagtagcaaggggagcctggggacagcttaatttgtttgtgccctttaactttcaggaaaatagaagtataaaaaaaaaattgaatggggttcttgctgtgggggttgggggaagaaaagaaaaaaaaagaagtcaaaaagattggtatttttttaggcactcccatagactgacacttggaaactggtaagataaaatcacagaagccctgctgacctgtgccacaaaactcgattatctacaatgtatgtgaaaaatgtctcattttgtgactagagggtgtacgtctccaaggcaagttatttaacaacttcttctacttcatacagaaccattcttagtgtttttctttgagattggtataaactcttctaagaatattaattttttgtcctgtggtcaaatatttaaccagtttgccttttaattttgtatatagtatattattacttatctatagatttttttttttttgagacagtgtgtcactcagtcacccaggctggagtgcagtggcacaatctcggctcactctagcctcctcctccagggttcaagtgattctcatgcctcagcctcccaagtagctgggattacaggcacatgccaccacgcctagctaatttttgtatttttagtagagacagggtttctccatattggccaggctggtcttgaactcctgacccaggtaatctgcccgcctcggccttccaaagtgttacaattacaggcgtgagccaccacacccagcctggatttttaaatttgagatttcttctggtgctgtgatgtttagaaggccttcaccatccagagattggttaaatactcactttcatttccttctgatttttaccgttttacactttatatttaattctttaatttgtattgaacttactttgaagtaccaaaccaatatgtttaatgcctttgtatatctgagttccagatctgtatttccagctacctgttaggctatgtggatagtccctgtacgccatgcatctgcgtacacccagattcactaaggagaaagcttgaggttgtacttaccactttaatacttttctccacccacatttgatcaatccccaagtttggctgattctgccccaggggtgataagagttctttaatcagtcttctaattcagattccccttttagttttttgccagagtccttgagtccttgagtaatccttagagttggcttcagtttttcccttgcagaaaagttatcagagttgtcataaaaaaaaaaagcactgattttcaaaatatggttcctttaattgcctgtgttagaattacctggcagtggttaaaaaggtagagtctcaggtcccacctagacctgcagatcagtgtgtctgagggatgggcctgggaacctgaagtttatcaagtacctcaagagatttatatacaaacttaaggggagacaatgcctaagtaaattcagtctagctttctgacatgctcttcaagacacccacacccccactctgacagcctattcttttaggcttatctcccacaacacgacccacccacctggcactgtgaccctacaataattctctgtttcctggacctgcccagttctttcctgcctctgtgcctttgctcatgcagttaccacagcctcatgctcctccccttccccaccctcttgttgaaatccttttccttaagagcccaaatcaaatgctacctttttaaatttttttaataaaaaaaagccttttctaatttcttctacttgaatcagtggctgcctccccagtctttatacttaacacttgatttttgcttcatttcttaccttacttaatgttgtcactatttataaattattgcttccttgtaagattacaagccttttaggtatgagaacctttcccttccttttcattttgtggccattatgcacatataaacaattaagaactcattttattttattattttgagacacagtttcattctgtcccaggttggagtgcaatggcgcaatctcagctcactgcaacccccacctcctgggttcaggtgattctcatgcctcagacctccggagtagctgggactacaggcacgcgccaccacgcctggctaattttgttttttttttgtattattagtagagacagggtttcaccatgttggccaggctggtctagaactcctggcctcaagtgatctgcccacctcagcttcccaaagtgctgggattataggcatgagccaccgcacctggccaaagtactcatttagtacatgaaatatatctgatcttgcaaacacacttttatataataatgtttggctttgtatcacacatagaataaaattaaaatcctttagcattgttattaatccgtatttaatctgactactactcatctctgtgtcatcgcatgcttctcacttacttcctagctgtattattccttcctcagggcctttgcatttgctttcctctacctggaaaactcccccatctattgtcttcaccttgctggctgcatatgttctccccatcattcaggtttcagttcaaatgtcattcactcaatgaggccttccctgatcactgcctaaagaagctgttcgtgtccctgttcctaccacaactccagttactctttttgtatttccttcacaccactaatcacagtctttaattgtccggcttctccagtggaatggaaatttcatgagagtagagaccatgtctgtcttttttttttttgagatggagcctcactctgtcacccagggtggagtggaatggcacgatcttgactcactgcaacctccaactcccaggttcaagagtctcctgcttcagcctcccaagtagctgggactccaggcacctgccaccacacccagctaaattttttatttttggtagcgacaggatttcaccatgttggccaggatggtctgcatctctcgacctcattatccgcctgccttggcctctcaaagtgctgggattacaggcgtgagccatcgcgctcggccttgtctgtcatttttaacattatatcttcagcacttggaatactgccaaagacttggtaaatgctaaataaatatttgttgaatgaatgaataagccttgaagatggacttttcatttggacaagtcttgttttgttttgcaatccaaagtgttgtattttttttaactggacaacagctgaggtcggtccatctgggttcaaatcaggtagcagtctctgaggagttcggaaggtagcaggacaaaagtttggatactgtgacaaccaggattaagttccatctgagtgcaagttttctaaggtgtttccaggatccaggccactattttcctaccactatagccatctacttcccagattgttactctggattatactagtctatcaactcctattacattttcaaaagccagtgtggcaaaactaaaacccaattactggaatccacaaacaaccagaagttttcttctgttttcattctctaggagaaaaattagaaagctatctagaatcttcaagaaaaaatgaaatgattttcattatacttactattaacacatgctctgaaatgtgttactgtttagacacactgtttagacagtgtactgattagaaagattttcagcaacagctttaaacaaaaggtttcttattaacatctagttgaaccagacattataatgaattagttctaatttctatttcttttcattggttagtcttttttaattccattttttttcttaatgctggcttgaagttttatttaaaataatgctttgtagagtagctgacagttttcaaagtacttttgcttttatcctttcatttagtcctcataagcatcctgtgtgaatcaatacctgtttttgagatgaagaaattgaggcccaaagacagtgatgatctttcccctgccaactgaaagaccactacccagcaaatgcctctcaataactattttctacagtcccgaattaaatgtagcttttagaagctaatcattaaaattcaattgaaacagtaacattaatatgtttataaccaggccaggtgtggtggctcacgcctgtaatcccagcactttaggaggccaaggctggcggatcacttgaggtcaggagttcgagaccagcctggctaacatggcaaaactccgtctctactaaaattacaaaaattagcctgggagagagagtaaggctccctcttaaaaaaaaatgtttataaccaattctttttttttttttttgagacagagtcttgctctgttgtccaggctagagtgcagtggtgtgatctctgctcactgcaagctccacctcctgggttcacgccattctcctgccttagcctcccgagtagctgggactacaggcgcccgccacaacgcccggctaattttttgtattttttttagtagagaaggggtttcaccatgttagccaggatggtctcgatctcctgacctcgtgatctgcctgcctcggcctcccaaagtgctgggattacaggggtgaaccaccacgcccggccctataaccaattcttaataagatacctagcactggtccagataagtagccaaattttatcacttgtgtggcggtgtgatttggtacatctttatgtgatcagcctcagtgatgcttgtcctttattaaggcattgttacgtggtagctgctcagattttttttttttttttttgagacggagtttcgctcttgttgcccaggctggaatgcaatggcacgagctcggctcactgcaacctccacctcccgggttcaagcaattctcctgcctcagcctcccgagtagctggaattacaggcatgcaccaccatgcctggctaatttttttgtatttttggtacagacggcgtttctccatgttggtcaggctgatctcgaactcccgacctcaggtgatccgcccgcctcggtctcccaaagtgctgggattataggaatgagccaccgtgcccggccagcttctcttttaaagaaaggaaggattaaagaacttgcctagagaagagtcactttttagtaaatccattttaattctcctgcttgaaggtattggttaaactgatctgaactgactcttcagattgagcaagtcctgaaaaacagcacatcatctaaaatttcagataagaatggaagccaggcccttcctggaaatgtccagaagtgaaactaagaagccctgtatttggagaaaacttgattagttattaaggacaaagggctgctttaagaaggttatatctttaacagaaggagccttcctaaaataagcgtatgtgtttcttttgctttgagattgtaaagaaggctccttaatgaactattttgccttaattaagcatgtaattggcaagacttatgagcatgtagtttctcggcagattttcagttatgtaggtgggcctttgctgagatgtgtggcaattcagtactagtgtaacactgtttttcattcatataacagatatttattgagcccctacatgttccaggcactggtattcagtacatctgatgttaaagtatggaaaggtacaaaggttaaaggagaaatatgctgttcagaggaagtctgtgctttgtcgtgatggtcttggtcaattgtaaatttccacattctttttctaattagctatgtttttctctactctttaccttaaatttgaagctagtgacttaatgatctgtttttctacttactgaaagagatttttcttactatgtgtgaaaaaaaactactggaaaaataagaaaacctcacttcgttggattatgtttgcccttagaataagttaatgatcagctgggacggggagggaaagaaccaaatgagcaaataacaaattttattaattgggagagaggtggagttagacttgaatttgatctggtaattttttaatttaaagggaaaaaaaaaagattaggaaagttcttgggtggttcttcatgacctacaaattttagaccaaagtcagttgtttttgtttttcaagatagagtcttgccctgtcgccgaggctggagtgcagtggcatagtcacggctcactgcagcctcaaactcctgggctcaagtgatcctcccaccttagcctcccaaagtgctgggattacaggcgtaagccacagcacctggcccaaagtcagttttttgtttgtttgtttgttttgagacggagtctcgctctgtcgcccaggctggagtgcagtggcacgatctcggctcactgcaagctccgcctcctgggttcatgccattctcctgcctcagcctcccgagtaattgggaccataggcacccgccaccacgcccggctaattttttgtgtttttagtagagacggggtttcactgtgttagccaggatggtcttgatctcctgacctcgtcatccgcccacctcggcctcccaaagtgctgggattacaggtgcccaaagtcagttttcaaaggctgtaactggggttactcttttttacctgtctaaataagatatgtgaagattaccacaattatgtaaaaaactaatttggggttcataagcacaagaagataagatattcacacaaatgaataaggtaatagaagccctgtgggaaggttatagttatgttctcttcaacatagagttctttttttttttttttttttttttttgagataaggtctcactctgttgcccaggctggagtgcagtggcgtgatctggattcactgcaacctccacctccaaggctgaagcaatcctcccacctcagccttctgagtagctgggattacaggctcaagccaccacacctggctaacttatttgtttgtactttttgtagagatggggttttgccatttttcccaggctggtcttgaactcctgaactcaagcaatctatcctccttggtctcccagagtgctgggattacaggcgtgagccactgtgcctggcccaacttagagttcttacagaggtgttgatgcgttgataacacctaaaattttatcccttttttttttttttttttttttttttgacagagtttcactcttgttgcccaggctagagtacaatggcgcgatctcggctcatcgcaacttctgccacccgggttcaagagattctcctgcctcagccttcccgagtagctggaattacaggcacgtgctaccacacctggctaattttgtatttttagtagagacggggtttctccacgttggtcaggctggtcttgaactcccgacctcaggtgatccgcccacctcggcctcccagagtgctgagattacagtcataagccaccgtgcctagcctttttaaattttttttttttttttttttttatttgacggagttttgctcttgttgcccaggttggagtgcaatggtgtgatctcagttcactgcaacccccgcctcccaggttcaagcgattctcttgccttagcctcccaagtagttgggattacagacatgtgccaccacacccggctaattttttgtatttttagtagagacggggtttctccatgttggtcagctggtctcaaacttgtgacctcaggtgatcctcccgcctcggcctcccaaagtgctgagattacaggcatgagccactgcgcccgctcctaaaattttatccttaagagagataacttttaccgatttagactttatggtgcagagaaatggtgtcaggtctttgatcagatctggtgttcctggtagtaaccatcagtttctcagatattattacattagagatattctctttttattggtgatttaacagaaataagctgaccctgaaatatcatgtacgctagaactgcttttctggtttattttccgtgctgcagatcattttgtttccaggccaacctcctaaaaaatgaaaagagctaacatttatttaacttctttgggcctcagtttcttcatctgaatattattcaataatacacttacataaagtgagtcggtaataattctgagtgtgttactgtgaagattaaataagttatatatgcaaaacaattaagacagtatctgacacatggtaaatggtcaataaatgttaggtatttttattaccaccactgctatcattattaagtacttattttagcaatgtgctaagagaacattttagtgatgatgaaactaaggcttagagtaattttcctcatgttacccagtaagtgtgtggtagactcaatatgtagacttgagccaaaaggagccttgggtagagttggcttagatgtggaataggctggggcatctggcccagcctttaatattcctagtttcaagactcttaaaggataagaccggtccagacagcccctaaataccgggaagatgtggtttgtaatatgtcattagaacatggacattatggtctgtgggattgtttcaaatcctagctctatcagttattagctctgtgaccttgagcaagttattgaacatttctagagccttagtttcttcctctgtaaaatgagaataataaatatttgctgacccagtgtggtggctcatgcctataatcccagcactttgggaggccaaggtgggaggatcgcttgagcccaggagttcaagacgagcctgggcaacatagcaagaccctgtctcttacaataataataataataataataattgcttcatggcagtgtaagaattaagtgaataagatcaaatggaatgagataacatgtaaagcacctggcatatggccagtactcaataaccaatcctcaggcttatgcttaaggggttcaaacttgtacctgattctgacattatctgtctagatggtgagcgtttagggtctgggtctgcaaaaattaacatgtttggactccatatgagaggttcagattccataggtgatcctgatactcagagtaccacccttatctgaaagcactagactgggtggtggagggtagcagcagtgatcctctctcaatgcctgggctgtcagtgtccgtcaggcttcttacagggttgtgctctgcttagaatattaatgagcagtcaggggtgggtgtcctgcaaaagggaaccccgcagaaacgaggcactcatctgtatagtcaagcggcatttttgtttggaaagaatattaatgagatctggataagaatcagacaccaggaaaggacagctgctgtgagaggcaaatccaattgtacaaggagttacacatgatattcagaaagtccttgtataatttaaaaaaaagtaagttgtagagataataaacaatttataaatgtcgttaaaaaaataaatgtggccgggcacggtggcttacacctgtaaccccagcagttagggaggcagaagtgagagataggttgaggctaggagtttgaggccagcctgggcaacatagtgagacctcattcttcaccaaaagaaaaaataggcaggctgggtgtggtggctcatgcctgtaatcccagcactttgggaggccgaggcaggtggatcacaaggtcaagagatcaaaaccatcctggccaacatggtgaaaccccgcctctactaaaaatacaaaaattcactgggtgtggtggcatgcacctgtagtcccaactactcaggaggctgaggcaggagaattgcttgaacccaggaagtggaggttgtagtgagccaaaattgcaccactgcactccagcctggcgacagagcgagactctgtctcaaaaaaaaaaagtaaatgtggccagggggcacggtgattcacacctgtaatcccagcactttgggaggccaaggagggtggatcatctgaggtcagaagttcgagaccagcctggccaacatggtgaaaccctatctctaaaaaaaaatacaaaaattagctgggcgtgaccgggtgcggtggctcacgtctgtaatcccagcactttgggaggccaaggcaggtggatcacgaggtcagcagatcgagaccatcctggctaacacggtgaaaccccatctctactaaaaatacatataaaattagccggacattgtgggggatgcctgtagtcccagctacttgggaggctgaggcagaagaatggcgtgaacccgggagatggagcttgcagtgagccgagattgcgcaactgcactccagcctgggcgacagagctagactccgtctcaaaaaataataataaaaataaaaaaattagctgggcatggtggcacgccccggtaatcccagctactcaggaggctaaggcaggagaatcactggaacccaggaggcagaggctgcagtgagccaagatcaggccactgcactccagcctgggtgacagagtgagactctgtctcagaataaaaaaaaagtaaatgtattgagtggccaacacatatttgaaaatatgctcaacctcactcatgattaaaggagtgaaaactaaaacaataatgtaccattttcacacatctatcagattggaaaaaataaaaataatgcttattactgacaagaatgtggagaaagattcaaatataaatggatgtgacttttttgagggaaatctcagaatatctatttaaaaatttaatgcataggccttttaaactagaaatgctccttctaggaatttatgccgtagatgcaccccgccccaggtaggcaatagtacaagcatgtttgttccattcttattcataacagtgaagaagcaaaagcaacctacatgatcatccacaggggccttgttaaataggttttaaactattacagaatgaaatattatgaggtactgaaagattgagatagatctgtatgccctgaggtgggaagatgttcaagaggaaataaataattgctgaacagcacattaacatgaaaccattgtatttctaaaacatgtttgtatttatgcatgttgtgtgtcaatttctctgtgcctcagttttctcatctgtaaaataggcatcctgatggtacctacctcatgacttgttgcaagggtaaactgagataacatatgtagagtgcttagtacagtgactgacacatagtgctttgtggtggcaattattattgtataggtaataacagaaagtttatgctccagactttgacagaggttacctttgagaagtagaattggtttggggggagggcagacaagagctggcagggacttctacttcttacattgtgtatttccatagcattgtttatatggagcaggcccatccctggccagtcactgaccgaggagcctagacagtgaaggaagtggcagctctgtaggctcaacaagtaggcttgttgagacctgcagaagaaggttccccatgggaaggaggaggataaggaagggtggtgctgtgtggagatgggaaggatgtttgtggattccaccatggctactgaagttttttttttgaaaaccacctgacctaattaaagatttaaaaaatttacattgcacaagaaccttacaaagcccagcttgtatttggacttatcctttttataattcactaagttatatttatactaaaaaagtgatttgtgtttaatttgacttttgaataaaaactacagaaaataattggtcaaagtgctcaaaacaaacattttaaaaaatgggtagtttttctaataattatgaaataaaaatattgatattttaaagaaacaatttctcttcaactaatgttactacttccattatatagtgatgagcaattttttttttttttgagatggaattttgttcttgttgcccaggctggtgtgcaatggtgtgatcttggctcaccgcaacctccaccttcctggttcaagcaattctcctgcctcagcctcccaagtagctgggattacaggcatgcgccaccacgcccggctaattttgtatttttagtagagatggggtttctccatgttggtcagactggtctcgaactcctgacctcaggtgatctgcccaccttggcctcccaaagtgctgggattacaggcatgagccaccaccctggccagccatgttttaaataatgacagcaactttcaagctaaaaagtcaaacagctgaagcaaatgtaacatttttgatttttttttttttttgagacggtctcactctgttgcccaggctggaatgcagtggcaccatcacagctcactgcagcctcaatctcctaggctcaggcaatcttcccacttcagcctgtcaagtagctggaaccacaggcacccaccaccacacccggctaattattaaaattttttgtagagatggagtctcaccatcatgcccaggctgatcttgaactctggactcaagtgatcctcccacctcagcctcccgaagtgttaggattacaggtgtgagccactgtgcctggccatgaattatttttaatcacagccttattgatctaaaccttgttaagtcaatatgacacataaagtaagctaaacccaaataggagttctagtatctgaacctttagaataatgtttattgaatgtggcttagactctgaagcatgcgaagactgacaagatctgcctctgacctcaagcaatgtgctgggcactgttttacatttattgtctcctttagtttaaaacaaccccgtaaggcagatttatcatcttccttttacatagaaggaaagtaaagtacagagaggttgccatgcatctggtaaacactagaatgggaattggaaccagctgctatttccattctactgtcctgcctccagagggtcatggggtaagggtgggcaaggtgagccctgggggggccacatgagaattctcagggacctcagtgatcatctgtcatcgagtctaatgattttcaagccattgtttaaaaattataaagttttattgaaaaattatataccatacaattcacctatttaaaatgctcagttcagcggttttaatatggtcacacagttgtgcagccatcaccataatcaattttacaacattttatcaccttccagagaaaattcatacccatcagcagtcagttccttgtcttcctactgccagtcccaggcaaccactaattctttttctgtctctatagattttcctgttctggacctttcatataaatgtaatcatacagtaaatggtcttttgtggctggctcctgtcacttagcttaatattttcagggttcatccatgttgtagcatgtgtcagcactacattactctttatagccgaataatattcccttgtatgggcataccacattttgttcatcctttcatcagttgacgaacatttgtgtacaagttctgtgtggacatgtgttttcatttctcttgagtatatatatatatatacatactttatatatatatatatactttatatatatatatatatatactctctatatatatatatatatactctctctatatatatatagacacacacacacacacacacacacacacagaggaatggaattgctggatcccatggtaactctgtgtttaatcttttgaggaaccaccagactgttttccaaagtggctgcaccattttacattcccaccagcagtgtataacggttccagtttctccacgtcctcgctaacacttgtcaaactatattttaactataccccacaataagaaatattttacattcctactcagtttatacacatacaaataactgaaacaaaaactttagaaaaaacctacctatactatgtctgatgcactttgacattttcgattgcattctgttctttttcatcaaaacaaacatgttgcttctgatcgctcaagttgcttttacaactcactaattgtgacctgcagctagaaaaacactaggctattttaaccccttcattttgcacaagaagaaagaggacccagagaagtggcttgttcatggccataccactaattagtggcagattcaaaatgagagcacaagcctgttggctccctgctttaactttgacctctcagtaaattatagttgcccttttattcggtagataaaaataaaatagtttctattttttaagcttcttatctttctcaagcagcattttaaattcagcaacagacctggctagaggaaaaaaaagaatgagaataactcaattttattatcacgagtcattgttttaacacaatgattttgtgccgtctggacagaaaagtactaggtgaacctagatgatgggcatcaaattaggcagattgaattaatcagtgcagtgtctcagattcatttttgtccaaacctcagtgtacttttaaagagcagccattttccttacactgtcaaatttgaatggcaacatgaaattgaagtgggcaatataagaaatattttatgttgctgtctttccatttttcttagaatacatgtaggtcttaaaccctttacttacttatttttgagtcagagtcttgctctgttgcccaggctggagtgcaatggtgtgatcatggcccactgcagccttgacctcctgggctcaagtgatcctcctgtttcagccaagtagcaaggatcacaggcatgcaccaccatgcccagttaatttttattttattttattttattttattttattttattttattttattttactttattttttggcagagaacaggtctcgccatattgcctaggctggtctggaacttctgaccttaagcggtcctgtctcctcagcctcccaaagtgctaagattacaggcatgagccactgtgcccagccttaaaccctttaattcagtgttttccagcatttgatgagggaacctctgacactagagttgcttcaacgttcttcttattaaaatgtgggttttttgagcccttctccagacctaatgaatcagaatcatgggatgggacctgaaaaatcagtattgtatacaagtttcctaagtgattctatgtacactcaaatttgtgaccaactgaattaagtgtttttccccctttatttctcatcttccttttggtttctaaaattactatttggctttgttacctgtagagccaaatagtaattcattagcatttataagaaaacacctaaattatctcagtagaaggagttaactaaaacaatattgatgggtttcagttttattctaccttagtagaatactggagaccatttttttgatggctatctccactggtttcccataccttggaatgatttattttggaataaacatatacaacctactctattgtttgatttcttttccccagaaacactagtctctaaaaatagctgaatccaaaaaattatttcagatgcctgggatccctctcttcattaacaaatacttgagtgccccccatgtgtcaggcactgttctgcaagttaaaatacagtgtgattttaaaaaattacagtgtgagccaggcacagtgactcacacctgtaatcccagcactttgggaggttgagctgggaggatcgcttgagcccaggagttcgaggctgcaataattatgatcacaccactgcgttccagcctgggagataagagtgagaccttgtctcagaaaaaaaattaccatctgatcaggtagggataggtctaatactttgagaacttatagggaaccttttagcccaagcttgaggggtcagggaaggcatctggaacaaagtgtcacccaagctgggacccatagcagaaggccagggaggctcaagcattttcagacagagggtagcagtgtcctcggggggagtagtgtgctcagagaatggcttgcatcaagaaataacttgagcatacctaaagatgtgaggaaaagcttgtgcaaaatccatatgtgcaaagctttgtccaattttattcaagctgcatttatagagttccttctatttagaaagcaatacactatcacgcctctaatcccagcacttggggaggttgtggtgggcagatcacgaggtcaggagatggagaccatcctggctaacacggtgaaacccatctctactgaaaaatacaaaaaattagctgggcgtggtggtgggcacctgtagtcccagctactcgggaggctaaggcaggagaatgacgtgaacccgggaggcggagcttgcagtgagcccagatcacgccactgccctccagcctgggcgacagagcgagactccatctcaaaaaaaaaaaaaaaaaaaaaaaaaaaatatactagatggcagaaaagcaaaagacaaaaaaagcagggagaggggtaaaatagcatttactgataagtaaataagtaaataaatgacttccttttttttttttttttttggggcaagttattaaacttgcccaagatcactcagctagtgttcgtggtgagagatctcaacagctaaattctaatccatgccccatgcccttagcctcttgctattttctttccaaaatgtgtccctgtgttaggcattttatatagaatttttgactagctagggtaggtaatggtatatgcctcagagaagtaaagaaacttgcacatgtcaccacagttagaggcccagtgagaacctgtaagttctccttttaacttcaaactttgtgtacattttgttatactatgttatgtgttattttatttgatagaagcaaaaattcatataccaattctttggagaaaaatgatttgtaattaaatgaacttaatttgaagagtagaggttaagaaaggataatacatatgatttgggttatgttacgttgcatattggacatatgaaactatccagcatggagtagaaattctaggactgggctgggcgtggtggctcacgcctctaatcccagcactttgggaggccgaggcgggtggctcactagaggtcaggagttcgagaccagcctggccaacatggtgaaacctcgtctctactaaaaatacaaaaacttagccgggtatggtggtgagcacctgtaatcccagctattcggaaggctgaggcaggagaatcacttgaacccaggaggcggaagttgcagtgagccaagattgcgacattgcactccagcatgggcaacaagagtgaaactctgtctaaaaaaaaaaaaaaaaaagaaactctaggagtggaagccaggaaagttaggccttaggatccagctttgggaatcatgtggaataagtgacttttgatgagttgagagtaagtgagctcgctcagagaagggagagagactgactctttattgattcctgggagtaagagtggaggtaggaaaagaggattctgcaagaaaagagaaaagtggaatttattctcaattacacagcctcatttttgttgcttttgctctgggtcttagtgtttttgaaggcacaaaatatcctttaaaaggcgataaagagatcaaatattattgaagtgagtctgtcctgatgtaaacatttacattcttgttgacccctgggaatttggtcaatgttacaattgtgctattgtctagattcatgtttctacacatacctgaagctcttccaagaacagtagcagtgattattctaacatgcctgcagacttgtctatcatcatgtttctgaataatagagtagtgagctttttatttataacatttgatgttatttagtggttccatttttttatattgtgagtttatatgagagtttgaataagctaaaattactgggtaattcacagttctgaaaaatatatgcttcctcataactagtcttgggactgcaggataagcattcagtttctgtactaattgtgtttcagataaaacttaaagctatgtgtaattttatggaaggcgtatttatagagttctttctatttagaaagcaatgtattaaatactagatgtcagaaggttaaaagacaaagtagatctgtcttctgacttcaaatatcttgctattgagtaggaattatgaaattattataaggcagggggattgacttatgctgattaggaatagggctagggcagtttggaaaagggccatgtgtgttctttcacttgagtcttttaaggtgaataggttgagtacgggataacatttcaaatggagtgaaaaaaatatacggtgtatcatgggaggagaagctggttatggcataattttagagattctagatctgttttcagaaatcaaagttctgtggggttaggctttttactatcagagaaagaagttataaataagccaagagggaatactagaatgaaccttgtgatgctagactggagtcagaaatatcagtatgaatttatagtttataaaatttttatagggctgggcgcggtgactcacacctgtaatcccagcactttggggggccgaggtgggcagatcacgaggtcaagagatcgagaccatcctggccaacatggtgaaaccctgtctctactaaaaatacaaaaattactcgggtgtggtggcgcatgcctgcggtcccagctactcagaaggctgaggcaggagagtggcttgaagccgggaggcagaggttgcagtgagccgagatcgcaccactgcactccagcctggtgacagagtgagactccatctcagaaaaaaaaaaaaaaaaaaaaaaaaagtataggtagatatagagctaaataaagaaatgtgtgcctataggccaggcacagtggctcacacctataatcccagcactttgggaggctgaggcgtgaggatcacttaggcccaggagtttgacaccagcctggacaatacggggagactctgtctctacaaaaaaatttaaaatattagccaggcgcggtggcatgtgtctagtcccagctacttggcaggctgaggtgggaggatcatttgtgctcaggaggtaggctgcagtgagctgtgattgcaccactgcagtccagcctgggtgacagtggattctgtcacacacacacacacacacacaaaaagcagtgtgtatacatgggccagtatacatacatataattcttggttttgtccactaagacgcctagaagcagtgacatctcagtggcaatgagcataactagtagtgcccagatgctaacttctcccataaaagaaaacagggctccttggggaaatagttgattccagggctgaggcatggtaaatacaagacgagcctggaacatcttgcagtgctagaaagtaaggaagtgctaaaaacaaaacaaacaaaaaacagggcaagttgagagaacactggagccaagccaaaaactccaagagctggaacaatttaagcaataaaataaggatagtattggattataatacagggaataaagtaactatctatgaaaccatcctaatataaataaatggttgggctggacgtggtggctcatgcctgtaatcctagcactttggagggccgaagcaggaagatcatcttgtggcatactgccaaggttactacttgagaccatcactatgacagttactactgttactacttgagaccatcattataagactgaactaagggtgtggaaagcagaaatgaaaacttaaaagtaactattttaaaggaaggggtcagaggaagaaaaagagagttccctgcttctagtgagcaaaggcagcccactgagcttccacagccctttgtatttattgggtagaaagagcagggaggaggaggtaacgattggtcagctgcttaattgatcacaggttcatattactgttaacaggtatcaattatgcctaatcacaagaaacactgctggtgtgactgccctcagcattccttctgggtggcagatgcaatttgtcagtttgccaacattctgcattcatgagaacagtttgctgtttactcatatagcctccagtggtatactgagttgatcacgaccctcactctttcggccttcaacatcatctgagctcaggaatttgagaccagcctggacaacatagggagacttcatctctatgtaaatggttctaagtaatgtaaaatcttctaagtaaatggttgaataaatgagggagaacaaatcttcgttatagaagaatttcaattaataaatgtagaaaggatgacagtaacagaaaatcaccattagaataccagtaataattgccataagcaagacacacccatgaatgctaaaattaatgggaaaaagtttaaggagaaacagagtcaaagttctccctcataatatttatgaattacaaagggaaaacaaataataactttacagaggagaaacctgatataccacattaaccatgtgatcaaggctaatgtcgtgagtaataagacatcacatcaacatcacgtaccctctgatatgatgcactgtgaagggaacatcaactctggattattcctttcaaacatttataatctcaatctaatctgagaaaatatcatgttttttaaaaaaacttttttttgttttgtcttttgagtattgcaagatgttccaggctgatcttgtatttgcccttccccagctctggaatcaaccgcttctccaaggagtcttgattctattttattggagaaaccaagaaacccaaattgaggaacattctacataatatctgaccaatactttcaacaatatcgaggtcatgaaagacaaggaaaagcagagtaactgtcatagattggggtagacttaggaagacacgacaactaaatgcagtgtatgatcctgaaacagaaataagacgttaattaaaaaactggtggaatttcaataaagtctatagttaatagtattgtaccagtgctcatttcttagttttgctaattgtactatggtaatataagataaagctaggtgaaatgtatatgggaactcttgtactgtttttgcaactcttatgtatgaaattgtttcagaataaaaggtgagtgctcacttcagtcatacatatactaaagttgaaatgatacagagaagattagcatggtccctgtgtgaagttaacacacaaatttgtgaagcagtccatgtttaaaaaaaaaagtttaaaaaaaaaaggttaaagaactattaacttccagccaggcacggtggctcacgcctgtaatcccagcactttggaaggccgaggcgggcggatcatgaggtcaggagttcaagaccagcctgaccaacatggtgaaaccccatctctactaaaaatacaaaaaaaaaaattagccgagtgtggtggcacatgcctgtaatcacagctacccaggaggctgaggcaggacaattgcttgaacctgggaggcggaggttgcagtgagccgagattgcgccactgcactctagcctgggcgacagagtgagactccatctcaaaaaaaaaataaataactattaacttccaaaaaatgttcaagaatgtgaatttagtcactatttttgtacagaaatataaatttagaaatgtaattttctgaaaaaacattatgtagcaatgtatttcatgttgcttttatttaaaattccctttgcaacttgaagttttttagtttttttttttcttttaattgctcccttttacctgatgacattcaaattgggaagagaggttggtagaaaaactaaaactctacaatctatttcttaaaaataatgtttttcttttctttctttcctttcttttctttcttttctttacttttttttttcttttcttttctttttttttttttgacagggtctggctctatagtccaggttgagtacagtggtgtgatcacggctcactgcaaccttaacctctaggctcaagtgacccacctcagcctcttgagtagctgggaccacagacacaccaccatggccagatagttttctgtattttttctttgtagagacagggtttcaccatgttgcccaggctggtctcaaactcctgagctcatgtgatctgcctgcctcggcctcccaaagtgctgggattacaggcatgagccaccacatgtggcccattttttcttcataagtgagtttgtagtttttactttgttctaattttttgaggctatgttcaggaagccatacagcttgaataagtaaccatctcaggagaaaaaaaagagaggaggccactgagatcggatatataagaacaggattttattagtggcttggggagggctggttgcagggccagctcatttattttttggtttggtttggtggtttttttttgttttgttttttttggttttgttttgagacagagtcttgtgctgttgcccaggctggagtgcagtgacacaatttttcttctgcctcaccctcccgagtagctggaattacaggcatgcaccaccacgcctggctaatttttgtatttttagtagagacagggttttaccatgttggccaggctggcctcgaactcctgaacttaagtgatccactcacctaagcctcccagagtgctgggattacaggcataagccaccgcgcccggctgtttttgtccaagcctggtttctgagagacagtttccttggtcaggagagtctgtaaatgaatttattagaataggtttcttggagcagttaccggcctcaccgtaagcaacagcttgaggaagcagatacctggggcagatttcccagtgagtcactcttcaacttttcaaggacctttgttcgagagatctttatctccaagctacagcttaccctaccctaggacaatttagtggcccatctcaagctacctggtttgataaaagaacattgatcctgggagttagaactctagctctaatactaaccagctggtgactttggaaaatgattggagctttatgcatctcagtttcctcactgtaaaaaaggggatttggttacttgatttccaagctactttcttaatgaaaaaaatctgccatttgtatctgaaactgaaggcatcttccttctcagcaaactgttcccctttctatgtataccatttatttgtcatgcaacgatccttctagtctctgaagctaaaaatctgtgtttatttttgttatatgtttcctttaactcttgcagccaactgtcttccaatccagcagttcttccttcacagttcatgtggtagtagaatgcatatgactgaagagaatgggttttggagtctgaaagtctgaaaatggaactcatatctgagagagactgtgtgggtggggagagataatatacctttcttttttttttttttttttttgagacagagtctcgctctgtcgcccaggctggagtgcaatggcatgatctcgactcactgcaacctctgcttcccgggttcaagcagttgtcctgcctcagcctcccaagtagctgggattacaggcgcctgccaccatgcctggctaattttttgtatgtttagtaaagacaggattttgctacattggccagactgggtccggaactcctgacctcaggtgatccgcctgcctcagcctcccaaagtgctgggattacaggcgtgagccaccatgctggccccaataccacacctttaatgcaggccaatgaaagccagttactacaatggagggtattccaagtgagcccaggataacttttaagtttccctgaaagcaggaatgattatctctgatattcaccactctgggaagatactcaccactattctcttactgaaaaataatttgtatgggttttcagctaggtggttcagggatttttctagctggttttctacattggctaaaagtggcggttttaatcattcttcattaattgtagttgaaagaaaatggactttggaatcaaacagaatatgcgtttgaatcccagctctgctactttatagctaagtgatctttgtaaagttaatatgtctgaatctcaatttcgttaccataaatataagacaataaaaccaatcctgtagaatgattgtgaggattgagatatatgcaaagcataaagttagtgtcttaaaatcttccaagagtcggatttctaactttagctttgaatttgtagtttcctattgtatatcatttggatttctcttgctgacatgtatgtctcaacatgtgtaaatcaacactcatcattttccctcttctttctatatttactgtctctgttaatggaatcaacagccttccatcattcgggtttgatgatgccagctttgattctcttttaccctaagttcattttattctaagaactgtcaatttctctcttcccacttttccatttccacctaccctaattaatttacgaatttaaaccttgattacctctcacttagtttcaggatcttcttgactagtaatttagactccagtctttttccctcttagcaagttgcacactactgctgaataatattttaaaatatgatgttagtcatgttacatgctttttcagaaactttctgtgttccaccagagagactgtggttaatccactacagagatcttatcttacaggtgtggatattgaggatcagaaactttttttgttataaaaaccatgcatgtgctaagtaaatagcacataagattagacctaatctctgatcactcatgggttacttcttcccactattgaaatatggcccaaactccttagcatggttttcttcccagtcaggccccattatgtctttttttttttttttttttttttgagacagtttcgctcttgtcacccaggctggagtacagtggtgcaatctcggctcactgcaacctccgcctcccaggttcgagagagtctcttgcctcagccttccgagcagctgggattacaggcgcgtgccaccacgcccagctaattttttgtatttttagtagagatggggtttggccatcttgggcaggctggtctcaaactcctgacctcaggtgatccgcctgcctcagcctcccaaagtgctgggattataggcgtgagccaccacacctggccaagtcttgtctatcttcaacttctcttgcacctagagtttaactcactccccaaaggtgctaatgctattctcctccttcctcctcctgccttcactttgatgaaattctgcccgttctttaagtcccaagtcatctgatatcttttcctttccctctcacaaagccagaaaatcaggtcttgtattcctacaccacgcatagcctctaaccacattctgtcttgtactataaatatttgtgtgtatgtcagcaagcacagtagattatgtacaccattcaggcagggacatctccctacatctcataagaagtagttattcaatagcctggtaccagagtctatcaaaaatcatgtattgattctcacgtttatctgtttcataggtactaatcacattgctaagaaataacattatgcttctgtgaagacaagtgtggtcagggtgagagtcatctcattccctgagtgtaagaactctaagaactgtgtgcctctcctagctgtataccaaaatagatgttctgacttttcttaactttctggctgggagtaatcaaaaccacggacttagacttgggagttaaccttttttttctttatcgtgctcggtatctcaaataataaatccttttccttttttagaaacatacctttttttttttttttttttgaggtggagtctcattcactctgtcacccaggctggagtgcagtggcatgatctcagctcactgcatcctctgcctccagggttcaagtgattctcctgcctcagcctctcaagtagctgggattacaggggtgtaccaccacacctggctaatttttgtatttttagtagagtctgggtttcaccatgttggtcaggctggtcttggacacctgacctcaagtgatctgcctgcctcggcctcccaaagtgctgggattgcaggtgtgagccaccgtgcctggcctgcaaatgtatcttgtatatattttttcccctttgatccagagttgatctttatggaagaactgacagtatttatacccacaactatattggtagtatatttctaccaaataatatcttaaagcattcattagcatttccttaacttgccttacagagtttaaaaaaaactatgatagttttatatagttaagtttagctgaaatgtttgttgcttctgtgtctttttcatcttagagaaggggctggcattgtttggtgagtctgccagtttaataccagatagacaaataggtatcatgtattatttggtacattccagtttattgcaaagtacatgtatagaattaagattattttgttcaggaagaaaagaaaacattaaaaacactaaacagtaacatttattgcttacttattctgtatcagggtcttttcttctttatcttatttatttctcataagaatactgtgaagtaaatgctattattatggatgagaaatccaagttttagggaaacttttcattaagtgatgaggccaacattcccacttagacttatctgtctctaacccagagctccttaccattaaagggcatactatgccttccaacatgaggattaaaacatattaacaaaactagtattattttccgacaaggatttcattggaagaacaaatattacatgtagaacagtagtagtgtggtcttttagaattgtccattgcttattctgcatcacgggactttttttttttttttttttttttttgagaacatcttggtctgtcacccaggctggagtccagtggcgcaattcatagctcattgtagcctccaactcctgggcctagtagctaggactataggtgtgtgccaccacgcccagctaatttttaattttttgtagagaagagggggtcttgctatgttacccaggctggtctcaaactcctggcctcaagctatcctcccaaagtgctgggattacaggtatgaaccaccatgtctgacccaggacctttttttttttttttttttttttgaaacggagtttcgtccttgttgcctgggctggagtgcaatggtgtgatctcggttccctgcaacctctgcctcaagcaattttcctgcctcagcctcccaagtcgctgggattataggcatgcgctaccactcctggctaattttgtgttttcagtagagacaggatttcaccatgttggtcaggctggtcctaaactcctgacctcagacctcaagtgatccacccacctcggcctcccaaagtgttgagattacaggcatgagccaccatgcccagcctgacccaggacttttaatgtgaaatggcagcttgagttgctggatttaaatactctctgtgttctacagttgtcaaggttattgaaagcagtacctgatgaaccatacattcaaccagatcagttatgctcttcggttgccaagagctgcaagtagtactttatttttcttttacttctggtaagctgtgaattagcagtactttattattatttttttttagttttcaagactcctggatcagaaacaaagtggtactttatatttttcactcttcaaataaggaaactgttgactcatttctaatctctcgtcttctggacaaaggttggaactcctttcctttggtaattagtggggcaaaataaccaaacgatccagattaatgggtagggactaggtgatatcaagggtatggctttatgtattctttggctgaaagggatgttggaaaatagggtttgtctcctgaacttaaagtacattatacttctccttgataaaggctttaaaatgagaattataacaagagtcaatgataataattatacttaaaatgctcttaatactactgtaatatacccagtattttaaatatattatctccttaaatctatatcaaaacctcctaaagatagatattatccttattttttagctgaagaaagtgaaatggaaaatattacataatatgttcaaggtaacaaagttaggatttccccgaagtctgtctcaccttaaagccctgctcttcctattacaccacgctgcgcccccagctctctccctggcactgagtggccagtgctgcagagcttggggagagagggcagccaaaagaaacttgaatgtaggtagaaactaatttggacctggctctactgagatgctgactgtacctcccctgggatgtaattcagaagagggaaacatttcactccaaatgtgactttggaacagacttcagttcagggaaaggccaattgatgtttgcacagtggggtcagtcataaaatggaactggaagggaccttaaaggtcatctggtgtagcctccttttataagaaaccacaacccaaagatattggatcatttgaccaaggttacacagtttgggggagaacagtggaggagtgtggtctgcaagtttagggctctaccacaccactgccaatccttggatgttggagaatcctcttctgtgtctaatgttctgactttctttattgcataggtatttcagtgtctgtagacaagatggaatcatctccatttaatagacggcaatggacctcactatcattgagggtaacagccaaagaactttctcttgtcaacaagaacaagtcatcggctattgtggaaatattctccaagtaagtgctgatcctggtccaaaaggaccatctgtctggagcacacattgccacctgtcagggaaattggtgaaggaagtacataatgtaaaataattttattgggcgcctcgtggattttaaacactatatgaggtactgtggagaaggaggaggagggtaataatcagaagatacattctattctttgaatttttgtttagtttgtggaagaaacagttatagacacaaaaattattttaaaaaagataattatgaaataattataaagcaaaatatcagcaagtctaaaatgaataggagtgaggattaggtacagaataagagacagagcatcacagacaggagctcatcaggaaggctttctggttgagatgagtgttgaggcgagttttgatttggttgaatggtgcgttaagcactctctatacctgcactttccaatgtggtagccactatataggtggctatttcagtttaagttaattaaaattaaataacatttaaaatttagttttaaatgtttaccagctgcatttatcacttttcaagtgctcagtaactacttgttggtgactgtcgtattgaacagcacagaaacatttcatcattgcacgaagttctgctgaaaagtgtaacctacacaggcacactacagcccactggctgctgattagtaaataaaacttcattagaacacatccggtcaggcgcggtggctcatgcctgtgatcccagcactttgggaggccgaggtgggtggatcacttgaggtcaggagttcaagatcagcctggccaacatggtgaaaccctgtctctactaaaaatacaaatattagtcgagcatggtggcacatgcctgtactgtagtcccagctgctcaggaggctgaggcaggagaattgcttgaacccaggaggcggaggttgcagtaagctgaaatcgtgccactgcactacagcctgggcaacagagcgagactctgtcttaaataataataataataataataataataataataattccagcatttattttgcttttgaagctccagtttgggcaggatctctgctctacttagcatcagccagggtggcccaaaggctgggagctgtaatcatcaaaaggctggctcactcacaagtcaggcggttgatgctgtcatctgggatctcagctggggccatggtaggaacacctacacatggccattccatgtggctgtttggcttggtggctcagttcccagggcaatcatccagagacagagggaaggagggaagaaaagggggagttcaaagttgtgttgccttttatgacctagcctcggaagtcatacagtatcacttttaccacattcacttcattagaagtgagtcactaaagctgactcatttcggggaagggcaatttgactccaccttctctgataggaggaatgtcagaattttttggacattttaaatttttttaattaaaaaaaaaatgttgagacagggtttcactctgtcacccaggctggagtgcagtggtgtgaccacacagctcagtgcagcctcaaactcctgggctcaagcaatcctcccacctcagccttctgagtagctgggactataggcacacaccactgtgcctggcctggacatgttttaaaatcatcctatattctgattcagtatgtgtggatagagtccaggaaattatgtttttaacaagtatcccaggtaatttttaccttcagggaagtttaagaagcactggtagtggaagggatggacttgtggagtcaaagcagtgagcttgaagtggaatgagtcgagtctaagataggagattgaagcaaaggattatggaagctgaacacgaataaagggaataggaaagcaagcagtctgccatggaaaaatacagaagggagaaggaactggtgtaattcatttagggccagatggaagacctcggatgctctgctaaggttaggatttagtaagaaaaccagggaacgcaattggttttcatgtggggagagtgacatgatcagaccggtattttagaaaaagccttctggcaacagtgtaaagctatattagaaaggtgagagattggtaacatggagacaatttatgaggctctcttgggaacccaagtgaaagctgttgggggtcaagggggaacaggaatagagagaaagggaaggatatcagacggtgttgagatgtgattatgggacttggaaactccctgtcctgcacagaaacttctccacgttcttacccttttcaccctccttagccccacctgtctttaactaaacttggctttcccttgacatgcatgacatgcattctgtgtttgagcagtggctgcctgctctttctttttttttttttttttttgagatggagtctcactctgtcacccagactggagtgcaatagtgcaatctcagctcactgcaacctccgcctcctgggttcaagcgattctcctgcctcagcctcccgagtagctgggattacaggcacatgtcaccatgcccggctaatttttgtatttttagtagagatgggatttcatcatattggtcaggctggtcttgaactcctgacctcatgatctgcccacctcgacctcccaaagtgctgggattacaggcgtgagccaccacgcccggcctggctgcctgctccttctgcacatgcttccctgaaatattttgggggccagggttgctactcttctatatctccaataatgtttcccattcattgtttctcatgcctgcttctgaagttctagacatgtgctttcaggctcacatctaactataatgcactgttatcctccccttcattgcagtggcgtgccagcctccaggggacgctggcttctagcatcattttttttttttagtgtttctcactgggggtgctgtagcatttggggtaaggcagatcttccccatgcagggtattcatcatcatgccctcctctaaatgaacccatgacattgtgacaaccaaaaaagaaaaaaaaaagtgataggggagaaaacccaacaagattctaacacatgtgtctaaatgtcccccagggccattggcaccaatggtgtcctcattaaaggatcactgggtccacatcagtgacctgtctgatactttgggctcataatttcttttctttttctctctctctcttttttttttttttttgagacagggtcatactctgtcgcccaggctagagtgcagtggtgcaattatggttcactgcagactcgacctcccaggctcaagcagtcctcctgcctcagcctcccaagtagctgggaccacaggcatgcaccaccatgcccgtctaattttttatttttgtaaagacagcgtctcactatgttgcccaggctggtcttgaactcctggattcaagcgatcctcctgcctcagcctcccaaagtgctgggattacaggtgtgaaccactgtgcccaacctggactcataatttcttgatcttccctgtttctgcaacctgcatgttgtctcccatgcctctgcctcccgtctcaacctatcactcagaatccttctctgaaatgatgcatttggagaacctactgtttgattggagccttctgtttttccacttgtttaactcttattcccagtgaccctgtgttttgacctcaccaggacacccagccctggatgtcagtccccttcctggcctcactttcttccttgcccagctcagtcacttcagtgaggctctcacctcttccccagtgcctttctcaccactctattctgtcattgtccagcccagccagttctcattaggatttgggtcctatagtagcactaaggagagttaagaggttggaaaaggcttcatctttagggccttcttaatcttgcagagagaaagtgcagagggatctcacaggtccttctcatggtatactgggttcactgtcttttctccatgaaggctgaaaggattgcaaaactgtcaatcctgaacccattaattacaatcagtgtgccaggcaccatgctagacccttgatagaaacacatactattttggctgggcacgctggctcatgcctgtaatctcagcactttgggaggccatggcaggtggatcatttgaggtcaggagttcaagacaagcctgcccaacatggtgaaaccccatctctactaaaaatacaaaaaaatggctgggcgcaatggctcacacctgtaatcccagtactttgggaggctgaggcgggcagatcacgaggtcaggagttcaagaccagcctggccaacgtggtgaaaccctatctctactaaaaaatacaaaaattagctgggcatcgtggcccatgcctgtaatcccagctactcgggaggctgaggcaggagaattgcttaactgggacctggggggcggaggttgcagtgagccgagatcacgccactgcactccagcctgggctacagagcgagactctgtctcaaaaaataataataatacaaaaaaatacaaaaatttagctgggcggtggtggtgcgtgcctgtaatcccagctacttgggaggctgaggtggaagaatcactggagcctgggaggcggaggttgtggtgagccaagatcatgccactgcactccagcctgggcaacagagtgagactccgtctcagaaaaaaaaaaagaaatatataaaatatatactattttgaatcctaacaaaaactatatgaggaaggggctttacccctcttttatagttgagaaaactgaggtaaaggaagtaacctgctgaagttaatatttgagtttgttcctgtcacatatttttcttctgatgtgcttaacacatggaactggtttggaaagatgaatagagttatttggtaggcttggagaatgctgaagacattccagaggaaggggagcaacaggaggtaaaggcatagaagtaggacaggtggtggtatatactgaaaggagtgaaaaccagggaatcagcctggatttctgttctaggttttatactcagtggaaacacgttgctaatattacttaaggtttgtaaggttcactcactgcagcttcccaaagaagactgcaggactattttccgagatcagttgagatcaggcgcgttgagggtggtatggctgtagactacaggactattttccacaaagcatatactaatgtctgtttccaacacctagtggctttatatttatggggtttgcaaatagtgagtcctatacaagcctagctaaaaacagtaggaaaacttaggaggtctctgatcagagattaatatgaaattgttgtttggaggaagcttaatctagctgatgtttgtagataagtcagctttactttctaattgttaacagtgcattttgtgtttatatgtatagaagagtactttttctagcatcagagcttgtgtcccatggtcctttatagctgcaggcttatttctctgactaagcctctataacagtcgttaaatttgaggtaagaagttcctattgatacatccatttgaatagctagctttggtttcactcaccactgacttcagcataatatgatccttcatttgataacagttgactctttgggtggaatttgtttgactcatacatttttggaattaaagagaatctagcctggtagtttttaaactatcttaattgaagtcttcagaggaatctcagggccagttctccaacaactggaacaccctaagggctaaacccaagcccagatcccaggcccagatcccagtcccagatcccaggcccagctctttagattttccattccagcaatcctgctttgatcccttgtaaaggttaggttctgcgtaagacagcatttgaagagagggttctgcagctagcagagcttgaaaccactggtctggctagcatttgccctattcctttgacagattaggagcttgaggattagcaattatgactgaaggtcatacaccaagatggtagaattgatgatcacagcatgaagatccctaacctaaccccctgccagcatgcctctaccttatcacagcttctcctgtttttgttataactttacccattcctagttccaggaaacaggaggaggccgggtagagaggatcacttgagtccagaagctcaaggctgcagtgaactatgattgcaccactgccttccagcctgggtgacagagtgagaacctatcttaaaaaaaaaaaacaaagagcgttcatatttagttttctgtgactattcttccttcaataagaaaaaaattgaccttcaagtcagcctggttaacttcctcttctttcgcttctctgtaacattttagtggtgaaatttttccagaagaaaatacattgcttaaaccttgggagtttctgttttccctttttggctcagcattccctttgctctatttgagggcatacaagcaagagtcatggctcaggaactctgttttctggccctagaaaaatttgagacactgttattactccccagataattttagcgtcctccatcagctgcctgccccacagctgagcattagtgagctgttgcaagattaaattccttatgtaaagaaaaggaggctggaccgcaaaaaaaaaaaaaaaaaaaaaaaaaaaaaaaaaaaaaaatctgggaaggaaagaggaacaaaattttaattacagaaattttattgtaaatgttttattttctcaaatttggatcttcaaaatggtgcccccattttgtgtccttcacattttgtgtcagaagaatgctagttgctgtaagggcctctgagaaaagtctgaggcctgaacacggaattcagaagtattgagcctcagtcttgtggcaatctaagagtacaaaatataaaagtaccagggatctaacttggaagaaagaggtggtgtagagcctttctccctgttatctactatttagcaggaacttcattacaaataaaaggtggagatatttgagtaggggtttgagaacaggattaaagacagcctttggtgtatacacctggtcttacagatgcctccatgctaaaaggacaaggctaaagatgggaactattttgatttttttttaatctatgtttctattagacactaaagggaagggaacctctgagcttatttactcaactaaccacaatgtaaataccttgccttggagaacagttggctaaatataaacctgtctgccaattggttctagttttcatatattgtattattgctgtaatatactgtagatgattatccaaggggtgtggaaacgcaagttcaaggccagttctaagttcctttttataatagctacaatccactgtatccctgaattctcacttttagggaatctcttagacagatatattagtacaagtgggaaaaatatacgtaaaaggacattccccaaagcgttatttgcaatggtgaaaaactggaaacaatccaaatgcccattaaaggaatatgggtgaattaattataatgagagaggattgtcaagattaccaaacacttccatgttgctaaatcaaagggatgtttcttggcctttatcttacatgaactctcaccactttttccctcccacatttttgcttctcttggcttctctggcagtctcatcattttcttcctccctctctctctcttccttgtcagtctctcttatcatttgttctgactgctgaaatgttcgagtctccaggactgagttccaggcatcttctcacactacacactgcttgcagatgtcatctactcctgtggctttaataccatccatgggcacgcaagttctaaatgcatacaactagctcagagctttcttctgagctccggacacatgcatctcatcactgctaccaccaaatggatgttttagttaacatggctagcattgaactcttgatcttccccgtttccaaatttgctcttctttcacaattcctcgtcccaggaagcattacttccattgactcagctgccagaaacctaggaatcattctctcttccccatctgattactaccctactgattctttctcgaaatatatctcaaatctattcacttttctttatctctagtgccattatctctgcagcccagccagcattatctctcattaatgccacctccattctcagcccctccagtccattctccacactccagagcactctttaaaaacacgaattgaatcagtgaccatcctaccattaaattcaaagtccttagcattacctgcatggcccatccctgcctcccgcctcattgcctgccctttcccctctcagtgagcttctgcaacactagagttctttgtgcaccctatatacatgagacactttcttgccttgaggcctttatgcatggtgtttttctgttcctggtatgctttcctcccttccttttgtctggctaacttcatctggtcaaacttcacatctcagcctacaggtcattttctcagtgaggcgctccttttaaaaattttttattttatgttatgttatgttatgttatgttatgttatgttatgttatgttatgttatgttatgttattttgagatagagtctcactctgttgcccaggctggagtgcagtggcgccatcacggcacactgcatcctcaaattcctgggctcaggtgatcctcccacctcagcttcctgagtaactgggactacaggcgcatgccaccaagccctgctagttattttttttttaagagatggggtctcgccatgttgcctaggcttttctcaaactcccgggctcaagtgattggcctgccttggcctcccaaagtgctgggatcacaggcttgagccatcgtactcatccatttgtttttagctgacaaagaataattttacatatgtatggggtccaatgtgatggttttttgtttgttttttgagacagagtctcgctttatcacccaggctggagtgtggtggtgctatcttggctcactgcaacttcctcttcccaggttcaagcgatcctcccacctcagtctccgagtagctgaaactacaggtgtgcaccaacgtgcctggtggctaatttttgtctttttaatagagacgaggtttctccatgttgcccaggccagtcttaactcctggcctcaagtgatctactcgactcagcctcccaaagtgctgggattacaggcatgaactaccacatccagccaatgtgatgttttaatacatgaatacattgtagaattatcaaatcaggctaattaatataagtgaggctttccttgatttcctcttcctttctcaattgtgttcctttgttatttaataataccctgttcttttttttcaaaggacttaccactctgtgtgtgtgtatgtgtatgtatatttgtgtgcttctgtttttagtgtctaaattgtaagcatcggagagcagatattatgtctgttttggttatttctttcgttactttttctctagtgcttggaacatagtagacagcaataagtatttctcgaatgaaaatgtcagcttctctgaatttctctctgaaatggagaaagggagaagcagaatagtatgtatcacattatctcatttttgttacttaaaactcaaatatgagttgcaaatattttctcccactccatgggaacttttcactttgttgataatgttctttttttttttcttcatgattttttttttcttcgtgagacagagcctcgctctgtcgcccaggctggagtgcagtggtgcaatctcagctcactgcaacctccacctaccaggttcaagcgattctcctgcctcagcctcctcaatagctgggattacaggtacccaccaccacacccagctaatttttatatttttagtagagacggggttttaccatgttggccagtcttgactgacctcaagtgatccacctgcctcggcctgccaaagtgctgggattacagtcatgagccactgcacccggcttgttgatagtgttctttgatgcgcaaaagttttttttgtctttttttgtttgttttgttttgttttttttgagacagagtcttgctttgtcgccagggctggagtgcagtggcgcaatctcggctcactgcaatctccacctcctgggttcaaatgattcaccagcctcagcctcccaagtagcggggattataggtgcccaccaccacacctggctaatttttgtatttttagtagagacaaggtttcgtcatgttggccaggctggtcttgaactcctgacctcacatgatccgcccaccttggcctcccaaagtgctgagattacaggtgtgagccaccatgccaagcctcagaaaagtttttaattttactgaagtctagtttgttttttcttttgtgcctgtgcttttggtgttgtattccaataaggcattaccaaatcttgtaatgatgagatgatcaaaagataataaaaaattaaaataagatgaaaaaataagaaaaacaagaataagaaagaaaaacgacaaaaaataaatttcaaaaaatcattgccaaatccagtgtcatgagacttttcccatatgtttcaaccaagagttttatagtttcagctcttatagttaggtctttgatccatttgacttaatttttgtatatggtagtccaatttcatttttttgcatgtggctatccagttttcctagcaccatttgttgaaaagattttcctttccccactggatggtcttggcacccttgtcaaaaaattatctgaccatacatgtaagggtttatttctgggctgtgtgttctgttccattggtctgtatatctgtctttatgccagtatcatactgttttgttttaactgtggtaaaatacacagtatataacataaaatttaccattttaaccactttttttcttttttttttgagaccgagtctcactctgttgcccaggctggagtgcggtggtgtgatctcagcttactgcaacctccacctcccagattcaaaggattctcgtgcctcagccgctcgagttgctgggactacaggcatgagccaccatgcccagctaatctttatatttttagtagagatggggtttcaccatgttggccaggctggccttaaactcctgacctcaggagatccgcccgccttggcctcccaaagtgctgggattacaggcgtgagccactgcacctggccaaccacttttaagaacacagttcagtggcattaagtacattcatattattgtacaatcactaccaccttccctttgtccttttgttgctgcacagtatttcattatacatatacattataatttaccactcctctgctaacggacattcaggttgttctcagtcttttgctgttatatttaatgctatgataaataatccaatattaaaatctttttttagtgtatctataggacaaattctgggagcagaaagaattggtaaattataacatttgtgcttttataattttggcagatattaaagaaggcatagacaaaatgccttctataaaggttttaccaatttaccttcccaccagcaatgtaagacagaacctgtttccccataccctcaccaatgtcccatattagccttttttgtttgtttatttgttttaaacagaagttcggtggtacaatgacagcccacggcagcctcgaactcctgacctcaagcaatcctatcgcctccacttcccaaagcgctgggattactgggattacaagcatgagctacccaacccaactgcatattagcttattagctgtgtgcgtgtgcgtgtgtgtgtgtgtgtgtgtggttttaaggagcagagagtctttaataggcaagaaagacggaagaagcagcttccccatacagagacagagggagaaggactccaagccgagaaagggaaccccctgcatattagctttttaagaaaatcttttccggccgggtgcggtggctcacgcctgtaatcccagcactttgggaggctgaggcaggcggacacctgaggtcaggagttggagaccagtctggccaacatggtgaaacctcatctctactaaaaatacaaaaagcttatccgggtgtggtggtgcgtgcctgtaatcccagctacttgggaggctgaggcaggagaatcacttgaacctgggaggcagacgttgcagtgagccgagatcacgccactgcactccagcctgggcgacagagtgagactccatgtcaaaaaaaaaaaaaaagaaaaaaaaatattttcctacttaataggtaaaatgttgttagcattgtttgaatttgcattttgaggttgaacatcttttctgtttaagagtcatgagatgttctttttgtgaactgtatgtttttgttttttttgagatggagtctggctctgtcacccaggccagagtgcagtggtgcaatctcggctcactgcaacctccacctcccgggttcaggcgattctcgtgcctcagtctctctagtagctggaatttcaggtgcctaccaccatgcctggctaatttttgtatgtttagtagagacagggttttgccaggttggcggggctggtttccaactcctgacctcaggtgatccacccacctccatctcccgaagtgctgggatcacaggcatgagacaccgcacccagccgtgaacagtatgtttatatctgcctttttatttattcagttgtcattttcctgcttattagtagttatttatattctagggaaattaattttttgtctgtaatataagttgcaaatatattttcagcttgtcaattgaatcacagcagttctaatcccactttcttcctagttatggtcaacgaagtgccagaaatttttggtagcccttttaccctaccccattagagagttctgctcaattgcagagcagtactacatggcgactgagatgcttgttaatatctgattattaaaattagacagtgataggattgggggctgggcacggtggcttacacctgtaatcccagcactttgggaggccaaggctggtggatcacttgaggtcaggagttcgagaccagcgtggcaaacttggtgaaacccgtctctagtaaaaaaacaaaaattagccgggcatagcggtgcacacctgtaatcccagctactcaggagaatcacttgaacccgggagacagaggttgcagtgagccgagattacaccactatactccagcctaggagactgagcaggactccttctcaaaaaaaaaaaaaaaaaaaaaaagtgataggattggaagaccctttatgtaatactctttcttggctgggcatggtggctcatgcctgtaatttcaacactttgaaaggctgagacaggaggatcacttgagctcaggagtttgagaccagcttgggcaacatagcgtgaccctatactaaaaaaaatttttttaaattagtcgggtgtgatggtagacgtctttagacccagcttcttgcaaggctgaggtaggagaattgcttgagtcctggaggtcaaggcaagctacagggtcttactctgtagctcaggctagagtacagtggcatgatcgtagctcgctgcagcctcaacctccctggctcaaggaatcctcctatctcagcctccccggtagctgggactgcaggcgtgcaccacacctggctaatttttgtatttttcgtagagacagggttttactgtgttgcgcagtctggtctcgaactcctgggttcaagcgatccgcccagctcggcctcccaaagtgctgggattacaggtgtgagccactgcaccaggcctgaggctgctttttttcttcttcttttacctcctactccaaatgcctcatgaattctgaaattctacctttaggcagaggacagtgcccttttctaggggtggggctgagttctgctaaggcaggcccaaggagaggcacataatggtgattctccacgtggtggtgctgacttcaatgcatgactcagaggtctggaggaagccaggttaaggttgttctagggccaggcatggtggctcatgcctgtaatctcagcagtttgagagaccaaagcaggcgtatctcttgaggccaggagttcgagacaagcctggccaacatggtgaaaccctgtctctactaaaaatgcaaaaattagccaggtgtggtggggcatgcctgtaatcccagctacttgggaggccgagggatgagaatcacttgaacccaggaagcggaggttgcagctagctgagatcgtgccactgcactccagcctgggcaacagagcaagactctgtctcaaaaaaaaaaaaaaaggttgttctgggtggtctggagatttgtgcagcttgtacctgcacaaatctccggaccacttagtctttaaatggagaaaacctgttcctccttgaaaagaactttaatttttttctcagaggtcttccaatccaagtaataaaaatgacaaaatgataaaagtaataacaaataattatttatgaaatctaagatgtcatcaactatagctgtgccactatttttgcatctctaagaaaaaatgctgattaaactaatcactgcttattacaaacttttctcacatatcactcttgtgcatatgtaaaataatttttccttaaatgccaaacatagtatgatcttttaaaagacatttttaagtggcatttaaaacatataataatagctgtgtgctgtggctcaagcctttaatcccagcactttggaaggctgaggcaggtggatcacatgaggtcaagagttcaacaccagcctggccaacatggtgaaaccctgtctttagtaaaaaatacaaaaattagccgggcatggtggcacatgcctgtaatcttagctacttgagaggctggggtaggagaatgcttgaacccgggaggcggagattgcagtgagccgagattgtgccattgcactccagcctgggcaacaagagcgaaactctgtctcaaacaaaacaaaaccatgtagtaccatcaaatacttttaactgagttaaaatgacaatatcaataacttacactaaattcaacatgtacaggcaatgtgactatctctcaaccatttggctgagaacaattgtaagatatcaggcataaatatgggaggggaaatgtatatgttggaattaatgcattgctgtatggacttaactaatttcaaaatgtttttacacatgattacatttaatcttcctggcaatcctgaaagtagattgtaacttctttctagataaggaaactgaggcttagagagattaagtcacttgccagagatcacagttaataagcagcaaaactggggcttaaagcctagactttctgctctatccaattgtttcagcatttgaccttatccacggggatcttgttgttatatcagagcagatgactggaatagctgcaggaagtgaggtctgctctgatttacagcttcttctgatagagttgattaaaagcaactgctggcagaaataggtatgcagactgtttttttgggtttgtttgttttgaatctcgctccgtcacctaggctagagtgcagtggcgtgatctcagctcactgcaacctccgcctcctgggttgaggcgattctcgtccctcagccccccgagtagctgggattataggtgtgcgccactatgcctggctgatttttgtatttttagtagaggtggggtttcaccatgctggccaggctggtcttgaactcctgacctcaggcgatccacccacctcggcctctgaagtgctgggattacaggcatgagccacttcacccagcccagaactggttttcttaaagattaaaagtggctggggggctgggcctggtggctcatgcctgtaatcccagcatttggggaggctgaggccagcagatcacttaaactcaggagtttgagactggcctggtcaacatggtgaaaccctgtctctacgaaaaatacaaaattagccaggtgtggtggtgtgcatctgtggtcccagctactcaggaggatgaggtggtgggatcacttgagccctggaggcggaggttgcagtgtgacaagatcacgctactgaacttcagcctgggtaacagagggaaatcccatctcaaaaaaaaaaaaaagaaaaaagaaagtagccgggctggtggctcatgcctgtaatctcaatactttaggaggctgaagcatgaggatcactttagctcaggagtttgagaccagcctaggcaacatggcaagaccccatctctacaaaaataaaaaaattaagccaggtgtggtggtgtgcacttacatagtcccagccactcaggaggctgagacaggaggtttgcttgagcccgggaggtcaaggctgcagtgaaccatgatgaaccatggttgtaccactggattccagcctgagcaacagagtgagaccctatctcaaaaaaaaaaaaaaaaaaaaaaaagctgggcactcactttgggaggccgaggcaggtggatcacttgaggtcaggagttcgagaccagcctggccaacatggtaaaaccccatctctactaaaactacaaaaattagctgggcatggtggtgggtgcctgtaatcccagctgttctggaggctgagacaggagaatcactcgaacccgggaggtagaagttgcagtgagccgagatcgcaccactgcactgcagcctgggcaataagcgtgagacttcatctcaaaaaaagataaaaaattgaaagagtaaaaatataagtttaatttgagacattctttccttcccttctctgaaggtaccagaaagcagctgaagaaacaaacatggagaagaagagaagtgtaagtattcagaaattccagggcatgtggcacttcttgagcagaattgtgtggccaagccacctgcagcctctgtggggcttgggttctatgtcagctgagtggacatttgtgccagctggtgtgatctctgagccatttgctcaggacaacttggcttagtgcagggaatcttattttttcactgcttttctccttttgaaccactttttctttcctgtgttgagtgaaggacaagaggccaaatgcttgcctgaggttagtaaaatggcttctactcaaatgagaacacagggtttcctaggtggtcttccttttttccaaatcagacaatcagaacttctacatctgtgcatttaaatggtagtagctgtgcagctgttgtcatcttctgggttttttgtttaaagcaaacttcttgacccaatctagttagcaagtttcctagctgcaggatctaccaaagacaaaaacctccagaataaactctctgcttctacccgttctctagtctccgtgcttgctaacttccggtgaggctgaataatacatgtcttttgaaattttacttgatttaatcttgtgaggaaaaaaactcatatgtttggtcaataattccttaattcggatggcattacaaaaacatcctcctggcagttttcagtagctaacctatttaaattagtgcataatatgttcctgtaaatttgttctaaggctaaggtccttggcttcattttcctgtaattaaaaaatgggtctcctctggtgcattataagaaaaaactggccgggtgcggtggctcacgcctgtaatcccagcactttgggagaccgaggcgggcagatcacgaggtcaagagatcgagaccatcctggctaacacggtgaaaccccgtctgtactaaaaatacaaaaaaattagccgggcgtggtggcgggcgcctgtagtcccagctactcgggaggctgaggcaggagaatggcgtgaacctgggaggcggagcttgcagtgagccgagatcacgcaactgcactccagcttgactctgcagtcagccagagcgagactctgtctcaaaaaaaaagaaaaagaaaaaaagaaaaaactaccattactttactcaactgctggtttcttttcttccttccctcttgcctctgtttttcccccaacttgctcctttctttcttccttcccttcactgtcatccatttaacaagttttcactgagcacctactacatgccaagcacagactacatcccagccctcgtggaatttacattctagtgcaaaagacagacaataaagaaattgtgtcagtatggctgggcgcggtggctcacgcctataatcccagcactttgggaggccgaggcaggcagatcacctgaagttaggagttgggagaccaacctggccaagatggtgaaaccttgtctccactaaaaatacaaaaattagctgagtgtgttggcacatgcctgtagtcccagctactctggaggctgagccaggagaatcacttgaacccgggaggcagagattgcagtaagccgagatagcaccactgcactccagcctgggcgacagagtgagaccccgtctcaaaaaaaataaaaaaatttaaaaaagaaattgtgtcagtagtgattagtgctgtggaacagcatgaggcaggtaaggaggatagagtctagggtggtcaatgaaggcctgtggtgaggaaacgtttgagcagagatttgaagacatgagccagggagaagagtcaggcagaaggaaccgcttgtgcggatgtcctcaggcaagaacagtcttggtgtgtttgaggaatagaagagaaaggtcaaatggtgtcattgtaaagacctgggctttaactctgaatgcaaggaggcctttggagagggtttatatgcaaaggagtgatgtggtctgacttaaatttttttttctttttttattattatactttaagttctagggtacatgtgcacaacatgcaggtttgttacatatgtatacatgtgccatgttggtgtgctgcacccattaactcgtcatttacattaggtatatctcctaatgctatccctccccgctctccccaccccacaacaggcccccgtgtgtgtgatgttccccttcctgtgtccaagtgttctcattgttcaattcccacctgtgagtaagaacatgcggtgtttggttttttgtccttgcgatagtttgctgagaatgatggtttccagcttcatccatgtccctgcaaaggacatgaactcatccttttttatggctgaagagaaggctctaatcccagcactttaggaggccaaggcgggaggatcgcaggaggccgaggtgggaggattgcttgaggccaggagttcaagactagcctgggcaacctagtgagaccctgtatctctattttttaaatgtaaaaaaatagaaggaagagaatgtagaggaacaataatggcaggagcatggagaccaattaagagacaattataatgatttaggccaggtataatatggtttggactagagtagtagcagtataggtgttgagaagtggtcaggatgtatgttgaatgtagagagaaagaagaatcaagaatggcagcagtggctctgccacagtggcttgtgcctgtaatcccagaactttgggaggtcaaggcagaaggatcacttgaggtcaggagttcaagatcagcctgggcaatatagcagaccccatctctattacaaaaagtaaaaaataaaagaatagcaacaatgtttttggcccaaacacaattaaattaaaataccattaattgagatggggaagactacagtaaaagcagattagagagggagaaatagtagaagctcagttttgcacatgtaaactgtaacatgttttattaagacatccaaatggaaatgtcagtaggaacttggatactatataaaaatctagaattggaagagatccccgctgcggataaaatggacatgtgtcaaagtgtcagtggtacttaaagctatgaggtgcatgatataagctaggaagtgagtgtagacagagaagtggtctcatgacttagctcaggggcaccttggtgtttaaaggttggagatataaggagtaaccagcagaggaaacaagtgccagaagccgagtgaagaaagtgtttctagaaggggagttaacagaatcaaacacacaggtaagctgagaattgaccatcggatttggcaacatgaaggtcattggtcatcttgtgttgtttgggagtggtagaatagaggcctgaattggactaggttcaagacagtgggttaagagaagttgaccccacgagtatagacaatcatatgtggagcatctcttatgttccagctcctgaagacacaagaagaataagatgtattctctacctccaaagggactgtttagaatttggaaaatagaattacaacccaggtgtgataagtaccatatcaggcccggcgcggtggctcaagcctgtaatcccagcactttgggaggccgaggcgggcggatcacaaggtcaggagatcgagaccatcctggctaacacggtgaaaccccgtctctactaaaaatacaaaaattagccgggcacggtggcgggcgcctgtagtcctagctactcgggaggctgaggcaggagaatggcatgaacccaggaggcggagcttgcagtgagccaagaccgcgccactgcactccacactccagcctgggtgacagagcgagactccgtctcaaaaaaaaaaaaaagaaaaaaaaaattaccatatcaaataaatactcagagtgggctgggggagaatttaggagggatctgaactgtgctacatctagaaaggcttcccagaagaggcagtgcctgactcaaccctaaaggaccaagaggaattagctaagcagaggcgacagggagtggcagaatctttgtattctagatggaggaagcagcacacgcacagcatgaaggcataagagaacaggcctacttgacagatgaaaagatggttgtcgcattcaccaagatagacaattcaagaaaagaaacaggttagagagtgaggagtaaagggaagacttcgggcctggcacggtggctcacatctgtaatcccggctgaggcgggtggatcacctgaggtcaggagttcgagaccagcttagccaacatggtgaaaccccatctctactaaaaatacaaaaaattagccgggcttggtggctcacgcctgtaatcccagctactcgggagactgaggcaggagaattgcttgaacccaggaggcagaggctgtggtgagccaagattgcaccactgcactccagcctgggtgacagagcaagactccatctcaaaaaaaaaaaaaaaaaaagaaaagaaaaaagaaagtgaagacttcaaccttaatcaagaaggagtttaagatgcctctagcacttccaggtagaattggtagaaaaggagagatgtctatctagagataagttctataactctgtctatatagatacacagtatacatctatctatgtatttgttgatactataatctatatggtgggtgaaatcgggatgaataacatcatatacagagaatatgtaaagtaagcaaagcagaggacctaagacaaaaaccctgagggaccccaccatataagggagggacagaggaggagaaacctgtaaaaaaaaaaaaaaaagaaaaagaattactaaattatgaaactgagtagtggccagataaatgagaagaaatctttttttttttttttcatatggaatcttgctctttcgccaggctggagtgcagtggcatgatcgcagctcactgcaacctccgcctcccgggttcaagcgattctcctgcctcagcctcccgagtagctaggattacaggcgcacgccaccacgcccacctaatttttgtatttgtagtagagacagggtttcaccatgttggccaggatggtctcaatctcttgaccttgtgatccgcccgcctcggcctcccaaagtgccaggactacaggtgtgagccactgcgcccagtgaaatctttttttcattattgtttttttctacacccttcttgcatctcaaaatgggaagaaatctaagaaaaaggggtatcacagaaaagttggaagcaatttttaccagggagagtggtcagtaatgtcagatgctatagtgagataaaataaagcagaagcctccagtgcttttagcagttgaggtaagtggacgtgaataggtatttaaagaagagggtgggcatggtagctcacacctgtgatccccacactttgggaggccgaggtgggaggatcacttgagcctgggagtttgagcctgggcaacatagtgagaaccctctctataaaaattttaaaaatttagctgggcgtggtggcatgggcctgcggtcccagatacttgggaggcagaggtggcaggatcacttgagcccaggaggtcaaggctgcagtgagccgtgatcatgccactgcactctagcatgggcaatagagcaagaacctgtctcaaaaataaataagtaaataaataaataaaatagataacaaagaagtaacagtgtaaaaacatgcttagcctcactgatgatcagataaatgtaaattaataatgagatataaattgtaatctaaacagttggcaaataattttgagcaatacatatattcatcagtgggggaatggtaattgcacatacagtataatatactatatggttattaagattttggccaggcatggtggcttacacctataatcccagcactttgggaggccaaggcaggtagatcacctgaggtcaggaccagcctggccaacatggtgaaaccccgtctctactaataacactaaaattagccggcatggtagtatgttcctgtaagcccagctacttgagaggctgaggcaagagaactgctggaaactgggaggcagaggttgcagtgaaccaagatcgtgccactacactctagcctgggtgacagagtgagactccgtctcaaaaagaaaaaaagattgaagatttcatgtatgggcatgaaaagatatcaaaagcacattaggtgattaaatgcaaagtgtagaacagtaagtacagtatgattttgtacaaaaaaatacatatagtgtacaaaatagaaaaaaagacaacatatataccatataaactgtcaggactgggtatctaggttgggagaggtggggagtcaagtagggaaaatggcatgtattacagcatctattcatgtcgggtacatatttctatattgattgagagtttttcccccaataagttattacttttttaattgagaaaaataataaattaaaaataagataatgttatgaacattttaaagagacagttggggccaggcgcagtggctcatgcctataatcccagcactttgggaggccgaggcaggcagatcacctgaggctgggagttcgagaccagcctgaccaacatggagaaaccccgtctctactaaaaatacaaaattagccaggtatggtggcacatgcctgtaatcccagctactcaggaggctgaggcatgagaattgcttgaatccaggaggccgaggttgcagtgagccgagatcacgccattgcactccagcctgtgcaacaagagtgaacctccgtctcaaaaaaaaaaaaaaaaaaaaaaatgccaggcatgctgacatacacctgtagtcctagctactcaggaggctgaggtgggaggatcacttgagcccaggaagtcaaacagctgcagtgagctatgattacaccactgcatttcagcctgggtgacagagcgagaccccgtctctaaaaaaaaattaaaataggatcatgctgtcttataatttgctttcttcattcaaaagtatcctatgagcatcttttcatgtcaataagtatactttgatcacatgataggtatctgagaaaaacagtgtccagttaccaaggcaaagtgccactttgattgtcagggctcctgtgtggttacagtaagggcaggtgaagtcagagacctagatgactcatccattgtgtggcacgagaccttacagagccaagagtgctgctggcagttagggtagaaccagcttctggagctgttctgtaattccttcttttccagcaagaaaactttttaagcttcttatatctctgatgcatacattcttcccccaatggatcattttgtaagctaaaatttaaacactagaatcaagcagttctataatttcttttcaagccttatttctacttgatgaagtggctttcaagagtatattcagaagagtaatagggtgagagacttaattcccaaaatagctgctaatcctgtttaattcctaggttgtttgtcctttctttcttagttgaaagactggtgagtcacagactacaggagagaaggtattggagtttgcagtttgttgggaaggtggtgctgttcaatttatttaggagtacagtcctttcaaagtacgggacatttaatttaatttaatttttctttttttttttgagacagagtctcactctgtcacccggactggagtgcagtggcgcgatttgggctcactgcaacctccgcctcccaggttcaagccatttttctgcctcagcctcctgagtagctgggactacaggcgcgtgccaccacgcccagctattttttgtatttttagtagagacgtggtttcacggtgttggccgggctggccacgaactcctgacctcaggtgatccacccgcctcggcctcccaaagtgctgggattacaggcatgagccactgcgcccagccgggacatttaattttcaacaagcgtgtttcctctattatggaacaacagtgacaatttccaggttgttttcagtctgtcttacatgtataaattaattccatttttggccctagtgaaagtgaactctcttagatatgtaaatgtgtgtcctttgatcatctgagtgataagtagtggtatttgcatttgaagcctgcatattttacaaccagaggatctgtaaaacagtgaatttcttgataactgagaattttttttttttttttggttgggggatggcgtctcactttgtcacccaggctggagtgtagtggcgcagtcttggctcactgcaacctccacttcccaggttcaagcgattctcctgcctcagcctccagagtagctgggactatgggtgtgcaccactgcacccagttaatttttgtattttttttagagacagggtttctccatgttggtctggctggtctcaaactcctgaccttgtgatccgccggcctcggcctcccaaagtgctgggattacaggcgtgagccaccgtgcctggccctgataagtgagaatttatacacagataaacttgtagagaagagcagggaaaaaaaaaagattaaattcttatgaaaaataaaatttgactgctcatatgcatgtaaattatgtcagatataactaaatatttatgcaaatacttggaaagtctggggacttctccagggttctacaaattgtttcaatccttgctgccactatccgtaattaatggtatagtttcagctatcctgcaactatcctgcatctttgtcttatttaaaagaagaaaaaaaaacccagcagaatttaccatgttattttatggcaggtaatgatgaactttgctgatgtgtagttacagtgtttcaagcacttgtattttgctttttctttcttgtttttttccccattaatctttgggtaaaaatctcttgtttcgcatgtaactatcattagagctgggtttgcctttcttctcattttgtccttataaggccatcctgttttatcacttcctgcttcagctcctgagtttttctctcttcccctctccctctccctctgccgggtggatgctttctccatgtggcaaggctgtaactgttcacagctgtctgaaacagcagtggaccaggagcagcttggagttttaactttcattttacaaagaacaacatgtttgaatgtttcagcaggcaagttataactggcatctacttcttgttcttctagaacaccgaaaatctctcccagcactttagaaaggggaccctgactgtgttaaagaagaagtgggagaacccagggctgggagcagagtctcacacagactctctacggaacagcagcactgagattaggcacagagcagaccatcctcctgctgaagtgacaagccacgctgcttctggagccaaagctgaccaagaagaacaaatccaccccagatctagactcaggtcacctcctgaagccctcgttcagggtcgatatccccacatcaaggacggtgaggatcttaaagaccactcaacagaaagtaaaaaaatggaaaattgtctaggagaatccaggcatgaagtagaaaaatcagaaatcagtgaaaacacagatgcttcgggcaaaatagagaaatataatgttccgctgaacaggcttaagatgatgtttgagaaaggtgaaccaactcaaactaaggtaagaattgggcgggtttgaaacttgagaaagccaattcaagcactaaacaaagctgtttttccaatctagctattttgagtagaggcgaatatgtggtcagtatgtcttttgattccagttagataagttaatagtctcaaatgcattatttacatagatgctaagatttgtgagtctctgacacaatttcatgttaaatcaggttcacactgggattcaaattggtatctagaaatgaagagagtttaataccgattggattatgtgtttttgtacacttgcccttttaaattgtcttcctgtgttctttatcatttgtagctttgggggtggaattactgctgaatagctctctgcttggacacagctgcagactgagtgttaaggccggagtttaacattaagactgaggcttacttgtctctgctagctgaatcccttctcttcttctcaacttcctcatctgtgccttccaacaaatgttttctatcagctaaaatcctctctcaggcaaaatcaatgaagatagccagactagctatagctttcgggagttttgacttgcaaatgcacagggttgcgttttcctacaactgctaatgaaatttgatccttcatgtggattgcagacctcgtccccagagggaattacttaactagaaaatgagttacatatgctggtgatttataacacaatccagaggccacagagctggtaaatttttccagttttctcatactttcctatatatctggctttgtacatggggatggttcgttacaacagtcgttataatgaaataaacagacctgatggggagcaaaaccatctgttactctagattccacctagatgggaaagctggattttttttaagctaaatatttggcccaagtccctatgtttggaaagtaatataataatattaagcattctttctgagataaaaaataactcatcctgtagtcttcagttatattagatgtgatattgtcaatcccttcccatgacttgcagtgccagtcacttttctacttagaattagaaaagttcttgaatgtttgcgggtcatgtttgaagttgtgcgagtttttgacgatgtgtaaagctacaacacttctctgtgcatgagctttagctctactttaacagtgaaaccagttggcaagagatgtaaccacaaagcagttttataacgtttcttaactctcttccctctcaagtttttagacctttagtcctgccaactccttctttcccctttatggttttaatttaaaaatttgttttatttaaatgggaagaagaattttaagtggaaggaaaaaatgtcagaaatcctaaatagagaggaaggggttttgttgtgactcaaagcaccattgtaagtctcctcctcccagaccctgctaggaacaggacagctgatgtcatgccagtacacacaatgtagattcagtgcaaaaggctgctgcatgttgaaactggccaaaggtaggaaatgactgggactgtagcagacaaaaatgctgattatgtgtaaggatatggtgagacactttttctcataaatatctagtgagatatgggtcagaacaagcctatctccctaaggctgcttggagaggagaaaaactttccatataagatcttactagtccgggcgtggtggctcaagcctgtaatcccagcattttgggaggcagaggttgggggatcacttgtggccaggagttcgagaccagcctggccaacatggtgaaaccccgtctccactaaaaatacaaaaattagccaggcatggtggcgttgctggtagtcacagctacttgggaggctgaggcaggagaatcacttgaacctgggaggtggaggatgcagtgagccgagatcatgccactgcactccagcctgggcaacagagtgagactctgtctcaaaaaatatataaaaataaaaataaagatcctactagatggctgatagcactgggccaccagattgattgctaaaggtataggaagatggaagaggctgggcacggtggcttacatctgtaatgagaatttagggaggcccaaggcaggaggattgcttgtgcccaggagtttgagaccagcctgggcaacatagccagacctcgtctctactaaaaatttaaaaattagccaggtgtggtagtatgcattgatagtcccagctacttaggaggctgaggcagaagattgcttgagcatgagagtttgaggttgcagtgagccatgatcgccactgcactccagcctgggcaacacagtaagatccctgtcccttaaaaacaagaagatggaagagacataagattcacctgggcttctaggtttcattgctttttgtgtgtgccatttttaatttcctgatttgtcacttaatggactgcttagggagtggaaaacacagccacccttggttttattgctgtttgtaaataagcatcattgtccatactgaaaacagtctagattatatttatttatttatttatttatttttgagacagaatctctcactgttactcaggctggagtgtattggtgcgatctcggctcactgcaacctccatctcccaggttcaagtaattctcctgcctcagcctcccaaatagctgggattataggcgcccgccaccacgcccagctaatttttgtatgtttagtagagacggagtttcatcatattggtcaggctggtcttgaactcctgacctcaggtgatctgcctgcctcaagcctcccaaagagctgggattacaggcatgagccaccacgcccagtctcagtctagattatttttaacagttctgtcaggtattctatagtctgagctcaacctacctgtatagtctcacagccaatcttatactcaaaccttggaatactcatcccccaactgctactttttgaatcttttattcttaatatttcacgttttaacttcagtgtgtttatactttttgaaatgagaccagaacatagtagactttatagagaagaccagttttacctagattccaaaggaagaattaaactgctgttattgtttgaaatgcgttttttttttgtttttgttttttttttttttatggagatagggtcttaactctgttgcccaggctggaggagtacagtggtacagttatggctcactgcagccttgacccctctgcctcagcctcccaaatagctggggccacaggtgtgtaccaccactctcagctaatttttaaaattttttatggagacagcgtttcgctatgttgcccagactgttcttaaactcctgggctcaagtgatcctcctgccttggcctcccaagctggtgaaattacaggcatgagccaccacacccagcctgaaattcttaaaggatgagaatgtcaatgacagagcaccttggcatcattgtgactaacctgggagacagggaagaagcacgccatgggaagtgtttacatttgggtacagctgtgctaagtactgtggagcccatagccttgaggtagacggctactttgccttttttcttgaactgtcttgcagaatgtggatttggggtaagtggtcttgaagcactcatttagtcaccctcaaattaagatttttacttcatctttcttgggcctgtacctccaagatgacaaagaaaagaagaaacaatggtcacaccaaagagggccgcaaccaggtgtacgctattcactgcagccaatttgctgcataaactgtgcccattgtgtgcccaatgacaaggcttattaagaaattcatcataggccgggcgcggtggctcacgcctgtaatcccagcactttgggaggctgaggcgggcggatcacgaagtcaggagattgagaccatcctggctaacacggtgaaaccctgtctctactaaaaacacaaaaaaattagttgggcgtggtggcgggcgcctgtagtcccagctactcgggaggctgaggcaggagaatggcgtgaacccgggaggcagagcttgcagtgagccgagatcacgccactgcactccagcctgggcaagagtgagactccgtctcaaaaaaaaaaaaaaaaaaagaaaagaaattcatcacttgaaatgcttgaaatgtagaggctgcggcagtcagcgatatttctgaagtgagcgtcctagatgcctgtgtacttcccaggctggatgtgaagctacattactgtgtgagttgtgccattcacagcacggtagtcaggaatcaaggtcatgaagcccacaaggatcgaacaccttccccccactgtagacctgcgggtgctgccccacgaccgccagaaatcaaggtcatgaagcccgcaaggaccgaacacctccaccccactgtagacctgcggtgctgccccatgactgccaccgaagcccatataaggagcagagttcttaaggactgaagaaaaactagcctctggagaaaaataaaaaaattgcaattgtacttaaaaaaaaaaaaaagattttacttcaaaggccaggcttgaagttctgaacactttgaagtctccaattatgagggatccagtctaagcctctggcttttgctatttagcaataggtgttctatgatgggctgatttggaaggagggagtcagccactcttgagccactgcagtgaagtcacttgatctcagtctggagagaaacactttaatagctaaacattctagctttgatttttctgaagggaatacacctgttttcaattctgggatttttggggtgcttgcttgactgtatatgaacttgtgatccaaggaaaaaataggagaaagaacaatgttggctttttaagtcaggatagttttatgtttgctactagataaggcaaaaataaaaacttatttttataaattcaagaagaaaagtaaggatgtttttataccctagtggtcaataacttagttcatagtatttatttaataaaaggaaggtggcattggtggtatagtggtaagcatagctgccttccaaataatgaaaattgattaaagcctatttctcagttattctctacatttgatgaatagataggttatttaggtcaggtggtttagctgaatatgatggttttatttatttatttttgaaacagagtctcattctattgcccaggatggggtgcagtggcacaatcttggctcactgcaacctctgtctcctaggttcaagcaattctcctgccttagcccccgagtagctgggattacaggtgtccgctgccattcccggctaactttttttgtatttttagtagagatggggtttcactatgttggataggctggtcttgaactcctgacctcaggtgatctgcccacctcagcctcccaaagtgctaccgcgcccagcctgaatgtgatggttctacttcctatgagtgaatgagtggtatatggattaatgtaacctatcgtcaaaagaaatgccacagtgggctgggagcagtggctcacgcctgtaattccagcactttgggaggccaaggcaggtggatcacctgaggtcgagagtttgagaccagcctgaccaacatggagaaaccccatctctactaaaaatacaaaaattagctggagatggtggtgcatgtctgtaatcccagctgctcaagaggctgtggcagaagaatcacttgaacccagaaggcagagtttgcagtgagctgagatgacaccattgcatcccagcctgggcagcaagagcaaaacttctctcgaaaagaaaagaaaagaaatgccacggtgacacttagtgagtgtggtttagcattcctaattccttatatgtattaatctggattttaggtggccaagataaccattcaggacagccttttatgaaaaagataactgaccaactagttatgacccatgtttagttattgtcatgttgcctttttttttttttgagacagcctcgctctgttgcccaggctggagtgcagtggcaccatctcagctcactgcagcctcccaggttcaagcaattctctgcctcagcctcctgagtagctgggattacaagtgtgcaccacgaagtccggctaatttttgtatttttagtagagacggggttttgccatgttggccaggctggtctcgaactcccagcctcaagtgatccacccacctcggccttccaaagtgctgggattttatattataaaaataaagcaggccgggcgcggtggctcgcgcctgtaatcccagcactttgggaggccgaggcaggcggatcacgaggtcaggagatcaagaccatcctggataacacggtgaaaccccatctctactaaaaatacaaaaaaaaaattagccgggcgtggtggcgggcgcctgtagtcccagctactcggaaggctgaggcaggagaatggcgtgaacccgggaggcggagcttgcagtgagccgagattgcgccactgcactccagcctgggcgacagagcgagactgcctcaaagaaaaataaataaataaataaaataaataaagcaatatattcaggtaaaatagacatatataaaataacaaaggaagtttcctttgactcatcacccttttctcttgtttgtgacctctccccgtagactcccagcccttcagcttccctctgaatttcagttcttattagcaccaggatcatgatatgtatagatagcatcaaaatgccaacaaaaacttcacttgttccaacatctttgtggtttttcttcttgtaagttcctggaagtgacacttggtattttgtttagttttgcataacactcgtacataagagtgtatatgcgctgatgtagtagaatgagtctttagagagtaaggcaaccaagctaaagtgtgatgatctctgttcatcaggtacttattcatagccaatctgtaatctgcatcaaagaaataatttatataggccttcttgatgaatgggtaggtgtccatagggaatgcccagattgttgcagaaattattcataacatcttatcttcctcttagttaataattgtatgtgttcctttatctacttaacgttaagataaaaaattttcttctgctttctgaatatgtcttatttagaattatatcccaagaagaatacaattctgaggatgttcataattgtattaattgcatagttttgtttgtttgtttgtttgctctgtcgcccaggctggagtgcagtggcacaatcccagctcactgcaacctccacctcccgggttcaagtgattctcctccctcagcctcctgagtggctgagattacaggcgcatgccaccacaccagctaatttttgtgtttttagtagagactgggtttcaccgtgtgggtcaggctggtcttgaactcctgaccttgtgatccccccaccttggcctcccaaaatgctgggattataggtgtgagccactgcgcccagccaaattgcatggttttaagttaaaattttaaagtaagtttggggaggaaaggtatttgaataactattaacatcaatgtggagtctatacagtcatctcaatgtaggggagtatatctttaatttgcctgtcagtgaatcttcacttttaccttgacctaacatttaatcttcaatagatacattgctagtgctttaaatgtggataattggttttgcatgttattgttaattgtacacaagaattgtctttgtttttctatcaatgcactttcttacatatcttggtaaaactaactttttgctgatttagcatattcacctatagtttgtagcttctcttgtcatttcaaaaatgtaaataaggctatcctcagcattattttgactgacatctatttatagtggtacatttcttgtaaagactacatatcagcataaattttttatttactcttaataactctgagtaatctcgtgtgtgtgtgtgtgtgtgtgtgtgtggtaagataataattgatccagggtaaagatgcagtcaaagaattccaatctttttaactgttccttgccctaaatgactgtccttgatgtgccagctagagaccactcatctcttcttctctgcttactttcatgtccactaactatgtactggtttttaaccagtttcattatagtaaaacatatcaacaagcaatgtcaggggactggaatattctttaagcaatgttggctatattagacttcaagggggctagaaagacttcatctccccccagtacaaatattactacctttgtcttcctgctagtgggctcattcctaaattagacaacacaggtgtgtatccagatgaatatatttacaagtcatttcctctagccttctaactcattctaactcatcagtgagttacaatgagtgagaaatcgctatcaaaattgttgacatatagatcctagaaccttaagagagtttaagaagttatttaatccagctcactgccctcagtcagttagaactttacaatcccaattttacagatgcgattagatgaggtcagagaagttaattgatatgccccatggcatgtggctaattaatatcagaacaggattgaaattgggtagtaccccttctaccatataacactatcttcatggatataataactatttattggatagaaacaatgggccctacatatctttgaaatctaaggaaactggcaaaaattgaaaacataaaaacagctatgttctcaaagactttaactctgtcttcccacagtttatgcttaactaattgaaaagcatcaggacagtgaacagaaggaatacattggaatgcaagagatatgaatgaaagcactggagttagaagcttgtgagtttgggacctggcgtggtggctcacacttgtaatcccagcactttgggaggccaaggcacaaggcacacttgtaatcccagcacttgaggtcaggagttcgagaccagcctggccaacatggcaaaaccccatctctattaaaaatacaaaaattagcctggcgtggtgacatgcgcctgaaatcccagctactcagaagcctgaggcaagagaattgcctgaacctgggaggcagaggttgcagtgagctgagatcataccactgcactccatcctgggcgacagagcaagactttgtctcaaaaaaaataaaaaataaaattaaaaagatataattcattaaacattgttcttacatcaaaaggtatgatttattgtttattcttatatattttcagcttgttctcaagattataacaccactagtacaatataaggacacattccccaaagcattagcatttggttttaccatttttgtctacttaaattaatagatatgacttgttatcctttcttttttttttcttttcctaattgtaagactaacacaaagtatttgtagaatgcttgggaatacaaaaaatgtagagaaatcctaccacctggagataaatctctttctatgtgtattattttacttacattaactctctttctaagagagtccctgaagaaagaaatttttctctcaatactttaataaatcaaggctaggttttatctatgccccgatttccatgcatagttcagcaaagctccatttttccctaaaagccaaccttcctctgcccttgactttggtgagatgacagcgtccaaaggaagctgaagttgaaaggttgaaggaagtggctaagtgaggcaggggactctcagtaaattaaagtgttgagaatcagcttttaaagataattttttctgaagataggtgtagaaaagacaggaaatcctgctttgttacttatttagaacctaacttactttatttctgttttaaaaaatacagaaaaaaattctacagactactgtctaaaacttttatcctcttactagtacatcttggtgcgtttgatttatggattcacagagaatatttaagggatgttcatactaacaagagttattgtcagctgacaggaaggaggacttcagggtgggtgaggccaggcctcaggaaattccagaaagtcttaaaagtatcttgtctattctctttccttgacattagaatgattaaggctccctcaagtgtctgagtaaaaagagctaaaatgtgataaaagtctgttacagaagagtattttggtatcagaattcgtgtgtgtgtgtgtgtgtgttttgtgttcctttacttccttgagaaatattggaggaaacccctccttcttcctgtacctcagattaccacttggaaaatgtggatcataaaactcatcttaaatgcatttgagatcatttttgtttgtttgtttgtttgcttgcttttgagacagggccttgttatatcgtccaggctggagtgccggggcacaatcataggtcactacagcctcgacttcctggactcaatcatcccacttcagcctccggagtagctgggactgcaggcatcaccactatgcctggctaattttttttttttttttttaaagcagagacagggtctcaccatgttgcccaggctgatctcaaactcctggcctcaagcaaccctcctgcctctgcctcccaaagtgctggattacaggcgtgagctaccacgcccagccttgttgttattcttttttttttttttttttgggggggtggggcggagtttcgctcttgttgcccaggctggagtgcaatggcgtgatcttggctcgctgcaacctctgcctcccaggttcaagtgattctcctgcctcagcctcccaagtagctgggattacaggtgtccaccaccatgcctggctaattttttgtatttttagtagagatggggtttcaccaggttggccaggttggtcttgaactcctgacctcaggtaatccacctgccttggcctcccaaagtgctgggattacaggcatgagccaccatgcccagccaagccttgttattcttaatgtttgagtggtttaaaggtgaaatatattgaaagtaatgctgtgcttcactgaacctgcgatatcatgaaaacccatcttacctcacagctgtgtttctcctcagagccacagtctgtatgagggatttttcagagacagttctcttcctatttttctctgagaccaaatggctttgttcatgtacttttttagtacttgaaataaattaatgcagagttttgatacccccatggagcaaaaggcttcaaaaaaaaggtaagggggccttatttaattaacccagcagtttaaattaaaagctaacaaagatgggaaattttatgcgtttaaaaccaaagaaagcctctgccctggcaaggtgtatgctctggttctaaatgattatgctcccaataacagcagtgcagggacttcacacaagacagagaaggatgtgtagctccaactagacagaaaacagctctctgcaggttgtaacatgtaacacatattcttggaattgtgcttgaactttgacagaaagcaaatatctgtattaagaacacagaacccgtttccttttggttgttcttttctttttttctttttttttttttttttggaaatggggtcttgctctgttgcccaggctggagtgcagtaatcttggcccactgcaacctccacctccctggttcaagcgattctcctgcctcagcctccccagtagctaggattacaggcacgtgccaccatgctcagctaatttttgtatttttagtagagatggggtttcgccatgtgggcgaggctggtctcaaactcctgacctcaagtgatccacctgcctcggcctcccaaagtgctaggattacaggtgtgagccactgcacccggccccttttggtttttcaaaagaagtttatcagtaggctttctcccattttgagttttgaaaattctaatttttgtagtggttatcttccagtgcagcagcatttggaataaatatgtggaattttctttattttaatgatcagcaaataagaagtatgttgaaaacaaaataaaaaggtgggccaggcgcggtggcttacgcctgtcatcccagcactttgggaggccaaggagggcagatcatttgaggtcaggagtttcagaccagcttgaccaacatggtgaaaccccaactctaccaaaaactcaaataattaggtgtggtagcagacgcctgtaatcccagctactctggaggctgagacaggagaattgtgtgagcttaggaggtgggggttgcagtgagctgagatcacaccactgtattccagcctgggtgacagagtaagactctgtctcaaaataaataaataaataaaaattaaaaatgtggattgagggtatcctgccagacatatcttttccttttgaccaagatcttcattatcttttttcttttttttttttttttttttgagatggagtctcgctctgtcacctagcctggagagcagtggcacaatttctgctcactgcaacctccatctctgaagttcaagtgattctcaacctcagcctcctgagtagctgagattacaggtgcgcaccgccaccccagctaatttttgtatatttagtagagacagggtttcacaatgttggccaggctggcctcgaactcttgacctcaagagatccacccaccttggcctcccaaagtgctgggattacaggtgtgagccaccgcacccaaccacttcattttcagatagcggctgctcctagagcaagagtatgttgagctgtgtgagtcatatggatgtataataattcatgaaagtatgcctgacctgtgtgtgatgtagcacggatagtgttgttccagcttgttttagtttttattaaaaatagacccaatcaggccggatgcagtggcccacacctgtaatcccagcaccttgggaggccgaggctccttgagcccaagagtttgagaccagcctgggcaacgtggtgagaccctgtctctactgtaaaaaaaaaaaaaaaagaaagaaagaaaaaatagacttaaatcaacaatataaattgcaaagctgactggatataaattattattattactttttgagcagggtcttactcatcacccaggctggaatgcagtagtgcggtcacggctcactgtattcttttttgtagagatggagtcttcctatgttgcccaggctagtcttgaactcctaggctcaaaggatcctcctggctcagcctcccaaagtgttgggattacaggcatgaaccaccaaacccagcaaggagacaaattatatatacacacacacacatatgtaatatgtatataatatatttttatttttattatttcttttgagacagggtcacactctgttgcccaggctggagtgcagtggcatgatcttggctcactgcaacatacacctcccaggctcaagcaattttcctactgcagccttctgagtacctgggactacaggcgcatgccataatgcccagctaacttttggttttttttgagacggagtcttgctttgtcacccaggctggagtgcagtggcctgatctctgctcactgcaacctccgcctcctgggttcaagcgattctcctgcttcagcctcctgagtagctgggattacaggtgcgggccaccacgcctggctaatttttttgcatttttagtagagacggggtttcaccatgttggtcaggctggtctcgaactcctgacctcgtgatccttctgcctcggcctcccaaagtgctgggattacaggcgtgagccaccgtgcccagtctaacttttgtatcttttttgtagagacaaggttttgccatgctgcccaagctggtctcaaactcctgggctcaagtgatccacctgtctcagcctcccaaagtgctaggattataagcttgagccactgtgcctagccttgggagatatattaaatatatattgaatttgaaagaaactattcttactggtgtggtataaacagaccaatccttggctctgatttctgatgtggtatgttttctgtctccaaggagggggtataaaaaatatgtaaaagtgatagttcactttcttttctttttttttttttttgagacagggtctcactctgtttctcaggctggagtgcagtggagcgatctctgctccctgcaacctctgcccccctggttcaagcaatcctcccacctcagcctcccaagtagctgggaccgcaggtgcatgtcaccacacctggctaattttttgtatttttagtagagacagggtctcaccatgttgcccagtctggtctcaaattcctgagctccagcaatctgcccgccttggcctcccaaaatggtggttttacaggtgtgagccaccatgcccagtctcacttcctcaaactttacagtaaagttgattagtccattgaacttaaagatttagtaactatttactaatgttaaattcaaaagggtgctaagtgttttattcttatctcctgtcatactggatttcagatatcttttttaacctcaagttgtctggaaataaactgagatttgaatgataggatctgatgtaaggatctcattataagctgaataaacatgacatactccctgtgtactatgtctgggaatattctttgacactacagtcttaaaaattataatttgtaactttcattaaagatctaccttagatatgacagagataaatgtagtaatttaatggaatcacaaaacacttcattaaaaaaaatctttgttggccaggcgcagtggctcaagcttgtaatcacagcactttgggaggccgaggtgggcggatcacctgaggtcaggagttcgagaccagcctggccaacatggtgaaaccctgtctctactaaaaatataaaaattagctgagcatggtggcaggcgcctgtaatcccagctactcaggaggctgaggcaggagaatcacttgaacctgggaggcggaggctgcagtgagccaagatcacatcactatactccagcctgggtgacggagtgagactctgtctcaaaaaaaaaaaatctgtgtcatccacttttctgtaagtcctggaaatatatggacaaaaaggcatggtctctgcccttagtgagcttacagtgcagtagagggacagtcacccaacagtttgaccaggtaccttgagaacagaggaaagattacctaaatttatgttggcaaggtactcagacttcatagtgcttacactgagtctttgaaggaacaggcatttgtaaggcaacagaaggacaaaggaggctggctcggtagggaccagatctagaacaggacttctgtgacttactaagcacttcgagtttaatttcaggaatgagtaggaatgctgaaagaattttgaaaaggagggtaaaatagatttatatttttggataattactttgtattattggggataatggtagcatcatagagactggattggaagataatgaagaaccagttaaagaggtataatgcagtagtccaggggaaagatgatgaagacatgaactaaggcagcaatagcagaaataacatgagacggagaaaggaaacagcagattctgcatcagcacttggcagtttagaaggacatgtcattgtcatctggtatgtgaggattcccctccaataagtgttacaaagcttgctggttaggaagccatctttagcagagaatattacctatatagggttacttatttttccctgggcacctgtgaatgtgtagtgcttgatatttgtaatttaaaaaaaattctatagaatataaaatataaaatcaaatctggattttatttataaagaaggtttgcaagttgaaccttgcgtcaagatttcccattgtttctgcaaaacttatcgttgggtttcgttttccagattctccgggcccaaagccgaagtgcaagtggaaggaagatctctgaaaacagctattctctagatgacctggaaataggcccaggtaagcagagagttccatgtgtatgaggtcctttaggaagtactcactagtagtaacatcttttggactcgaagccaatgcttttaaaggaagagtggcacaaattaaaaggaagtctgcctattagatgcaagccattctcaaatctcattgctctcgataaatagctttttttttttttttttttttgagacggaagttgacgtgctcccaaagtgctgggattacaggcatgagccgtcatgcccggctgcttttttcatatttttaatccacccttgttagtggtaacctatggtaagcaaagggtactttgaggagctataagtaaagtgctacgatcagttttgcctccagtcatctggggtttgagggcttcagtagatgggctgtgtcccctatcaggtttggttaccctgtattaccagtgataacataacactttgagagtggaattatgttttaaaggggacatatacaggcacttcacaaaagaaaaaattagtaaaaacaggaaaacatcagctacctagtcatcaaagaaatgtaaattaaaaagcattgagatctcttctttttcatgttaaattagccagaattttaaaatacgagcccaggcatggtggctcagacctataatctcagcacttagggaggctgagacaggaggaccacttaaatccaggagtttgagaccagcctgggcaacatagacctatctctacagaaaaaaaaaaaaaaagcccagcgtggtggtgcatccttgaagtcactgctacttgggaaactgaggtggttggatcatttgagcccaagacttcaaagctgcagtgagctatgattgtaccactgccccatactctagcctgggtgacagagtgagaccctgtctcaaaaaataaaatatgcaatcctcaattatggtaaggttcttttaatgctaagaaagtgagtgaatattactttataaatgacaattatattcctgattttcttcttcgtgcttttaacagaagatattggccattagataaaaataacccaaaatttagaattttgaaattatttgaatcacttttatcttctaataaaacatgttggccagtcacggtggtttacacctataattccagcgctttgggaggctgaggcgggaggatatcttgagctcaggagttcgaggctgtagtgagctatgatcgtgccactgcacttcagcctgggtgatagagtgagaccccatctcagaaataaaataaaacatgttatttggatgcttccaggtcagttgtcatcttctacatttgactcggagaaaaatgagagtagacgaaatctggaacttccacgcctctcagaaacctctataaaggatcgaatggccaagtaccaggcagctgtgtccaaacaaagcagctcaaccaactatacagtatgtgttctgcatcattcattcattcattcattccatcatccagcagatggtcactgagtactggaattaggaaatgtcaccagacccttgtatctgagccctggtcccctagctgttctcttttcacatgaaccctaccctcgctggatttgcagttcttaccatggtctaatcctgactttgctttcttagtcctggttcccaccccactcactttttttgtgatgttaccagtgagtatcattgagagtttccctggctcttctacttaatctttgtgttgttaaagaagtagtattttattagttttaatataactcttattttatcttggttgttgagggaagaaggaagaagactgaagagcttattttggcttttgagggaagaaagaagaagactggagagaaatatcagctgtgttcattaacgagggttttttttgtgattttttactgagatataactcacataatataaaatcaccattttaaagtatacaatcttgtgatacttagcatattcacaaggttgtacaaccattaccactgtttaattccagaacctttccatcaccctgaaaagaaacttcatacctgtgtagtcactcccaacttcccctgctctcatcccctggcaaccacttagctacttcctgtctttatgtatctgcctattttggaaatttcatatgaaggagtcatacagtagatcttctacttaatctttaatccttacgatgtactgttttcctaaagaagtagaatagtagataaggaaaagggagagatcacaagaaggtgacgtgctcagtaagcatgaaaattttgatattcagctgggtgtgatggctcacacctgtaatcccagcactttgggaggccgaggtgggcagattgcctgaggtcaggagttcaagaccagcttggctaacgtggtgaaaccccatctctactaaaaatacaaaaattagccagcatggtggcaggcacctgtaatcccagctacttgggaggctgaggcaggagaatcgctggaacccaggaggcagaggttgcagtgaggcaagattgcgccactacactccagcctgggcgacacagcaagactccgtctccaggaaaaaaaaaaaagattggtattcaaaatacaatggagggtccttcccctttacgttgtcctgtgcttaacgggtaagctgatgctacagaactgctaaattgaagttaccttatagccaggcgcaggagctcacaccgtaatcccaacactttgggagcctgaggtgggtgggtcatttgaagtcaggagttcagaaccagcctggccaacatggtgaaatcccgtctctactaaaaatacaaaaaaaaaattagccaggtgtagtggcacacacctgtaatcccagctactagggaggctgaggcaggagaatcacttgaacctaggagatggaggttacagtgagctgagatcacaccactgtactccagcctgggtgacagggtgagactccatctcaaaaaaaaaaaaaaaaaaaggaagttacctttcaaatgccatttattcacatatatatgtatacacacacatagatacaaatgtacacacacatatttttgtatccttcaagcatttgttctaagatttcaaattacaaaccattaatctcttgatgtcctaattgtctaacaaaatcaaaaagaacaatattgaattttatttgttcttaggcagatcgaaattggtgcatattggaaaccataatgagtattctgggagttaagccttctcttccccacattattaagtatacattctctaataatatttggtggactaattctctgggcaatgaataatttcatcttggttttttaactgtaattttaacaactttatgttttaagaagagatgatgtgtgtaaatcaattagcaaagtggagtatcacaggctgattatgcaccgtgaatgtgaaaagcgagcaaatttagacttcccttagaaggcaggtcaggagatacagcaaattgggatctgcgaagctgaacttcctcttgttaccagattttactgcttctcagtgccctcctgctgtaaacattcccaccaggtgactccctatgtggggaaacctgttgagtaactttttttttttaactcctaaccatttctgcattacagttctcctgctctggagattttaagagttgaaaactctttgggaattcttgtaaaaagtacattttgtctcatccccaaagaatttcccaggccccttacagaatatggttgtaacaaggcacatacatactctctggcagcagttctggaggtggggctttgagatggggtcaggaatgagttgttgggctatataatgttctgcagtgctagctgccagctcctcctcacagatgcacctccggtgctgtgggtcgtaatctagaataccatcactaggtgactaagtcatactcacattcctttcattgacctggtggccataaattgtttcctcccatgcctaaagattcacagagaacagaaaagtactagattactacattattagcagactaatggtgggaaatgtctatagtcatcgacctctatgtttattttattttattttatttttttattttgagatggagtttcactcttgttccccaggctggagtgcagtggcgtgatctcggctcactgcaacctctgcctccctgattcaagcgattctcctgcctcagcctcccaagtaactgggattacaagtgtgcaccaccacacgtggctaattttttgtatttttagtagagacaggatttcaccatgttcgccaggctggtcttgaactcctgacctcaggcgatccacccgcctcagcttcccaaagtgctgggattacaggcgtgagccactgcacccaggttctatgttgattttagatgtaatagatgagttaattgtaatattcaccccagtgtcctttgcaaggaaaaaaatgcaattatccttattccttatgacaataaaatgcatgttcttttatgttgaggctctgttttgagaagtaaaataaattatgtctttagtacaatatatgaattgtatatggaaaaacatgctttttgaaagtcccaccaaaaaggtttctttatggtatcattaaatataatttcagtttttatatgtatacatcatccctgtctctctttccaggccgggcatttatatatgtatggtcagtatattttctattattggcacttggcatctcctttcccctgctccagaatggtcttttctgataaaactcacaagctttgcattaccacaagctctgctgctagaagagtgaatcacaagaatgttgtatgcttggggtgttctgtgtgcctgtgttgatgtgtctgtattctaatgagcaatccagttttacactagcatacagatatttaactctgaggtatgtgtccacaaagctgcttttgtcatttcactagtcagtgggttttgcttgtgagagttagggggttgatttgacccgaggcttcttagaagaattttttaacattccaagtttatctaatagatgtgctatgaagagaacagaatgatgggactttaaaaaaatttttacagttatttttattttgtagaatgagctgaaagccagtggtggcgaaatcaaaattcataaaatggagcaaaaggagaatgtgcccccaggtcctgaggtctgcatcacccatcaggaaggggaaaaggtaggttgaaaagtctgatgtccagttgccaaggaagcatgtgttctaaattagatgcttgaaattagaaacaactctaactctaggctgtagagtgtctgggaatttggtaacagctgccaggacagattgccatttttgcaggtcacataatttcagttgagtagctctgcaacttatagctgaccaaataatgagccttcattggaaaattattttgctcagcagatgctcagaaggcaaagagctgaagtgattttttaaaatctatttggaggctgggcacagtggctcacgcctgtaatcccagcactttgggagggtgaggcaggtggatcacctgaggtcaggagttcgagaccagcctagcccacagggtgaaaccccatctctactaaaaatataaaaagccgggtgtgggggtgcatgcctgtaatcccagctgctcgggaggctgtggcaggagaatcgcttgatcccaggaggtggaggttgcagtgagctgagtgcactgcactccagcctgggcgacagagcaagactctgtctcaaaaataaataaataaaataaaaatctattcgggccgagtgtggtggctcacgcctgtaatcccagcactttgggaggccaaggcaggcagatcatctgaggtcgagagttcgagacaagcctgaccaacatggagaaaccccgtctctaataaaaatacaaaaaattagccgggcatggtggtgcatgcctgtaatcccagatactcaggaggctgagacagttgaatcgcttgaacccaggaggcggatgttgcagtgggctgaggtcacaccactgcactccagcctaagcaacaagagcgaaactccatctcaaaaaaaaaaaatctatttgggagagcatagattcagggcaacttgattccatgctcctgggaagaataatttacaaaaataaaataaaaatatatttgattagagattatcttcagatactcatatattcttaatttaagtatacatttaacacattttgtgcaagaaaatcttactcttccactcatattattttgaaaggcagtcactatgctaagtaagcataggaaataataagcttaaaaacttattgacaaaccattccatgtggtctttatgtgcaagaaaacagagtagaggagagattaataagaggtcagctatcataaaaatgtatgataggtgctgtgaggctgtgagaggggtatacaggaccacagaagcccagagcaaagatatttaacctgacttcctcaagaaggtgatgtctgagctgagtcttgaagaacgtgtggaagtaggccaagtgaatgaggggaaggttgagttagaaatagaaggctattccaggcagatacaacagagatttggaaaccagagatgatggctgaggaattacagggattgtttgtttgtttggagatggagtctcgctctgtcacccaggctggagtgcagtggcgtgatctcagctcactacaacctccatctcccaggttcaagcaattctcctgccgcagcctcccaagtaactgtgattccgggtacgtgccaccatgcctggctaattgtttgtatttttagtagagatggggtttcaccatgttggccaggctggtcttgaactcctgacctcacgtgatccacccgccttggcctcccaaagtgagggattacagctgtaagccaccgtgcttggccagaattacaggtttgctgacttggctggagcatgaggtacacataggcagcagtgagagacaggtggaaggagagggctagggtaaatctttatgtcacccttaagggtttggatgtagtggtgcagcaggagaaagccactgaaagattttaagcaaatcatatttgtgtgttatgtattaatcattagatgaatggcttaattgaaataagtaacattatttatgtcaggggaattatcatgttctctaccattgcccattgtccaattcttttagtctttcagtcaatatgataatcgaatgttaaatgagatgaggagaaagggttttcaaatctattacagtgatttaatcttaggagaaaagccattgcttctgttacacttattgacacccttgacgccattcttccaaaagacatggagatcattaaatggattaagagcaacagttctcaagcttagttggaatttgtattttttaaatttttttagagatgaggtcttgctctgtcacccaggctggagtgtagtagtgtgatcatagctcactgtagcctccaactcttgggctcaagtgatcttcctgcctcagcctcccaagtggctgggactacaggtgtgcaccaccacatctggctaatttatttttatctttattttttgtatagacagggtctcgctataattctcagaatggtctcaaacttctggcttcaagcaatcccctcagcctcagcctcccaaagtactggaagtacaggtgtgaaccactgcaccctgtctcaaacttatttgactacaacagactttacaaagtaggatggtatattgtcagaatactaacaggaactcatgagatatactactcttggatcaaagcagacccacagaaaaatggtctcaaactgatggctacaaaatttgattcaaagaccagaacagaaaaaaatattagaatagtttattttataaaaacatcacaaatgtatgttggaataacaagacaaaatacttggcagtcatgtgttacatggtcatataatcccccataaattgcaaacatccttgcagcagtggactcaggcattagcccatgaggcacatgccatgtattaagtgagttatcttgttaaactgtcttgttttctcatcttttaaatgggagattatttcttaagaataactgactaaatatttttgaagtttttcttatatactgttaaaaaaaaaaaagaaagaaagaaattttaagagaaaaatattcccagcattgaaatatccccatctttatcccaggagcatagtttgggaaacagtcatttgggaaataatgcttgaattgtccctgtatctaaattcatgtttccttcgtcattgtcttcatgctgatttgaaactggaactctgaactgaactggaagattagaacattttaattatagcctaaaaggacattagtgcgactgtgaatcatgaagtgggtggggaagaaaggagataaagacaatacatattcttcaagcacatgctgcaggtttacaaaccctcagctgccttaaaattcgcaatgtttttcagacccttagctatccttttggctgtttgcctagcttttgttaaccaatacctaagtgttatttgaacttcagcttgttaaaaaaaaaaaaaggacatgtgcctggcgaggtggctcacgcctgtaatcctagcactttgggaggccaaggtgggcagattacctgaggtcaggagtctgagaccatcctggccaacatggtgaaaccctgctctactaaaaatacaaaaattagccgggtgtgataatgggcacctgtaatcccagctactcgggaggctgaggcaggagaatcacttaaacccaggaggcagaggttgcagtgagctgagatcgcaccattggattccagccttgcaacagagcaagactccattcaaaaaaaaaaaaaaaaagcaaagattacctcacaggttcaaggtgaccaaattaaaggtgagagaagaacatcctgggatggaggtacctactaattctcaagaactgaagagctttttgtaggcatgcacaactttcagaaaatttatttcatatcattagataaaatagtgcatttgtaaggcgattagttgaatacctggcacatagtaaacacccagtaaatgctggctgtgattgtaccggtttattttatgccatgtcagaattcctgtaatgaagagagtagtggaaaaaataaccacgctgaaattcaggtgcagtcagccagcagcttaatcttcattgtaaatctattcagtttgtcagacatcctgatataaacactcagcattgcccataaaatccgtggcatctgaataaaaggaaattatgtgaagagtgcacattgggtcacctgttgactcttcatgattttggatgtggagtaagataccaggaaggcatgggggccagtagaaaggagggagagctctaatagagagttcttttatttaaatttgatggcttttgagaaaatgatatatacacctatacgtaagatctgccatctttttaaacattgccattttgagactgggattagaagggaaactgtcctcaaagataatactgaggttagttttaggtaaatttgttttataactgtcaaaaggtcttctatataggcaagctcgtttcagcaggatgtagttggttgggaaataagaattaggaaaattaaaaaataagaatggttcctatatttaaatactttatctttccttggagtgggttatggttatacggtgaggagctttgctctccttgatagagggctttgttttgctttgttttttgagagcagaaaaatatggtttagaagttgttttataaagggagatgatgcacacttttggcagttgagtgcagtctgtttctcgggttactctgtaattgagaggcatgttaatatcctcataaaagacattttgctgcctcttgttcaaatgctcagctgttctggtgcccgttatttcccctaggcagccagtgactgactggagtcagcaggtttttatggcattaacagcagtttgctcttttatttttaatatgactcttaatccccctctaactttttttttttttttttttttgtagatttctgcaaatgagaatagcctggcagtccgttccacccctgccgaagatgactcccgtaagcattctttcttagatctggaggatgaggttcttgttttctatctgtatttggttcaggggtgttcccattactgtcagtgctgagaaaataacatagtaaatcctctacttgaatttaagggctaatgcttgaatgtcctttacacacttcatggcttaaggagaagttaaattcaattgaatatagttaacttgggacaaactgaatacttgtaatgcttttctcattgaattcatcctactttttgcaccaaaccctttcagaattgaagctgtataaactaattttgaagtttcattttaacagaagtttggccaatacggattttattcatttataatgttattcataaatacctattctttagtgaataagtatttgaataatctgttaaagatacatattttttccctgtttatctaaatgtatattatagtcaacctcctagccaggttctagggattttcctgctgacagtgaattttgtcacctgtcatcctattttggagtcattttgagcctcccttttcccaaagacaaaaatgtttttttttgttttttacttgactatgtccactttttattctgattttcagtataacttttaattttcattttttagagacagggtctctttctgttgcctaggctggagtgcagtggtgtgatcatagctcactgcagcctcaaactcctgggctcaagcagtcctcccacctcagcctcccaaatagctaggactacaggcacacaccaccatacccagctaattttctttgagggagtctcactctgtcacccaggttggagtgcagtggtgcaatctcggctcactgtaacctccccctcccaggttcaagcgattctcctgtctcagcttcctgagtagctgggattacaggcgcacaccaccatgcctggctaattttttgtattttagtagagacagggtttcaccatgtagcccaggctggtcttgaactcctgagctcaggcaatccacccgcctcggcctcacaaagtgctaggattacaggcgtgagccaccgtgcctggccgtacccagctaattttttaatatttttgtagagaaaaggtctcactttgttgcccaggttggtctccaactcctggtctcaagcagtcctaccaccgcagcctctcaaagtgttgagattacgggcgtgagccactgtgcccagcccatttaaaaatatatgttgctgggccaggcgcagtggctcacacctgtaatcccagcactttgggaggcctaagtgggtggatcacttgaggtcaggaattcaagaccagcctggccaatatggtgaaaccccaagctctactaaaaatacaaaaattagccaggcgtggtggtgggcgcctgtaatcccagctactcaggacactgaggcaggagaattgcttgaacccaggaggtggaggttgcagtgagctgagatcgcaccatcgcactccagcctgggctacagagcgagactccgactcaaaacaaaatatatatatatgttgctggccaggcacggtggctcacgcctgtaatcccagcactttgggaggccaaggcgggtggatcacctgaggtcaggagttcaagaccagcctggtcaacatggtgaaaccccatctctattaaaaacacaaaaagttagccggatgtggtggtgggtgcctgtagtcccagctactcaggaggctgagacaggagaattgcttgaacccaggaggtggaggctgcagtgagctgagatcatgccactgcactccagcctgggcagcagagtgaaaatccatctcaaaaaaaatatatatatatatatatatgtatatatatgtttgctgggcgctatggctcatgcctgtaatcccagcacttcgtgaggttgaggcaggcagtttgcttgagctcaggagttggagaccagcctgggcaacatggtgaaaccctgtctctaccaaaagtaccaaaacttagctgggcatggtggcatgcatctgtggtcccagctacttgggaggctgaggcaggaggatcacttgagcccaggaggcagaggttgcagtgagccgagatcatgccactgcactccagcctgggtgacagagtgagactctgaaaaaaaaaaaaaaaaaaaatatatatatatatatacacacacacacacacacacgtatatatatgtatatatatatacatgtatatatatatcatatatacatgtatatatatatcatatatacatatatgatatatatgtatatatatatcatatatgtgtatatatatcatatatacacatatatgatatatatatactatatatatataaatttcttgtaggtcacaagacaaaaaagaaaaacatatatatgtggatttctagcatctccccaggctagtttactggacactgaaaaccctacaactgaaatagaatgatgaattaaacagatctctagttaatcctaccttaaaatttcggagaaaaactccttctgcttgaatccagaaacattctttttttgcaatcatttttctgggactagaaatgtttctgagaaatgtttttgactaggtttatgaaacatttttttgaaaaataagccttaatattttagtactttgttgactcacctcttcattttggcaggaaagtaactcatgtagttggaatttcaatgattatgaaaaaaacttcatggagcccttttccataatcttcatccattggtatctgctatagaactgaccaaaaacagtgtcaggttacatgtatacacaaatgcgcgcacgcgcgcacacacacacacacacacacacacagagtacaaaatttctgccctcacatctccccctttttccaacttcagttgaaacacttcagaaaaagttattaggaatgttaatgaccaaaaagacatctaagtctataaacggcctttaaaaatgacaaatggcacaaggaagaaagttctttatacagagtggtttggatttctgctacgtgtggcagagggtaagaaagcctcctcactgagaacctgatttctgacaggaccagagaatacctgagccatagttgttagtgttcgaatattcttcaacagaaaagcagtgtttttcctggtgttggaaggatctgtcattaatgaaagtgcccaaactttgcttttcggaagaacactttccaagacattccatgagatactgtaaaatgtcttccttttgtaactcaagcaggtgactcccaggttaagagtgaggttcaacagcctgtccatcccaagccactaagtccagattccagagcctccagtctttctgaaagttctcctcccaaagcaatgaaggtatgatggcaatttctctctgagcctttggacattggtctactggtagagctaattgtaccttttatgatgatgatgttgattataacctggttttgctttcctgtggatgataatgccacagaagagcacactgaagccagtcgctttccctggaaatcttgctgcctctgctcaggtctttggcccgggagcgagaaggctcactaatgactctcagtttgaactctggaaaactcatgaaagttttaaaataatgtcggtttttttatttttgtttttgtttatttattattattatcttttttttttttttgagacagaatctcgctctgtcacccaggctggagtgcagtggcatgatctcggcttactgtaacctccgcccccccatgttcaagcaattctcctgtctcagcctcctgagtggctgggattacaggcatgcgccaccatgcctggctaatttttttgtattttttggtagagacagggtttcaccatgttggccaggctggtctcaaactcctgaccttgtgatctgcctgccttggcctcccaaagtgctgggtaagccaccacacctggccttgtttttgtttgtttgtttgtttgtttttgttttgttttgagacagagtctcgctctgtcgcccaggctggagtgcagtggcgctatcttggctcactgcaagctccgcctcccgggttcacgccattctcctacctcggcctcccgagtagctgggactacaggtgtcctgccactacgcccggctaactttttgtagttttagtagagacggggtttcaccgtgttagccgggatggtctcaatctcctgacctcgtgatccgcctgccttggcctcccaaagtgctgggattacaggcgtgaaccactgcgcctggcctgttttgtttttttgagacagggtcttgctctgttgctcaggctggagtatggtggtgtgatcacggctcactgcagccttgacctcccaggctaatgcaatcctcctgtctcagcctcctgagtagctagaactatacgcacatgccaccatgcctggcttttttttttttttttttaagagatgtgattttgccatgtttcccaggctggcctcaatctccaggccttgggtgatctgcctgcctcggcctcccaaagtgctgggatgggattataggcatgagccactgtgcccagccaggaaaaatctgttcaactaaaatcagcacattggacgagatgtgcaatttcaccttaaagataatggcttcctaatctgcagagcttgatcttaacctgtggttagcttttttttttttttttttttttgagacaggttctcactttgtcacccaggctggagtgcagtggtgtggtcacagctccctgcagcctctatctcctgagctcaaaccatcctcccaagtagctgggactataagcacatgccaccacacccagctaatatattttttacatttttatagggatggggtctcactatgttgcccaagctggttttgaacttttggcttcaagtaatccccccaccttggcctcccaaaatgctgggattacaggtatgagccaccaaacacacctggccctgttgttcccacttttttttttttttaggacctgttgtttacaacaatgtcattaacatttttaacgaaagaatgtgtccactggaatgggggctggccagcccattttctgaaaaaaaaaaaaaaaaaaaaaaaaaaaaaaaaaaaatgaggccgggtgtggtggctcacgcctgtaatcccagcactttgggaggctgagacgggcggatcacctgaggtcgggagttcaagaccagcctgaacaacatggagaaaccccatctctactaaaagtacaaaaaaaaaaaaaaaaattagccgggcatggtggcacatgcctgtaatcccagctacttgggaagccgaggcaggagaattgcttgaacctgggaggcagaggttgtggtgaaccgagattatgccattgcactccagcctgggcaacaagcatgaaactcttgtctcaaaaaaaaaaaaaaaaatgacattcaagcaacacttatactaagggtataacattagatattaagaattgaggccaggcacggtgactcacagctataatcccagcactttggggggccgaggcaggcggatcacgaggtcaggagttcgagaccagcctggccaacatggtgaaaccctgtctctaaaaatacaaaaattagctgggcgcagtagtgcgtgcctgtagtcccagctacttgggaggctgaggcaggagaatcacttgaacccgggaagcagaggttgcagtgagccaagatcacaccactgctctccagcctgtgtgacagagtgagattccatctcaaaaaaaaaaaaaaaaaaaaaaaattggccaggcatggtggctcacacctataatcccagcactttgggaggccaaggcgggcagatcacgaggtcaagagtttgagaccagcctggccaacatggtgaaagcctgtctctactaagaatacaaaaattagctgagcatgatggcaggcacctgtaatcccagctacttgggaggctgaggcaggagaattgcttgaacccgggaggtggaggttgcagtgagccaagatcgcgccactgtactccagcctgggcaacagagctaggctcctcaatctataatctgcttttattacccaagttttaaaagtcgtcttttcctcttctatgggcaaatatatattcccataaaaataagccaaaaaatgtttattaaaaatgcaaaacttattttaggtttgttagctgacttgttttaattgactagcttgctaatgaggggctacttcactcgtttggattacccacacttctttagtgtctttctcctctagtgctcttttaagtagcagggttgtgtttcaaaagttttagcatttgagagaaactcaataaatagaatgagttttaaggtggtttgtgctgctcccaactcatgctcatatctgccgtgcttatacctctgactgtgagcatgattggtccacagataaaagttttactgcacacaaagtatgaagaggaggggacatcagggagggtttggaacaaaaggaggaaaggggagaatccaggatttaaagagtggatttaaaaggtgagcaaggtgaaaaagataaaacatgaaaattttaaaggaggcagagatttatgagaagagtaaggtttattgaaaaggaacaaaaggtaaagaaagcagaaagagaaagcaagtccaggaagaatgggcggggtcatggtgattgaatctgtacatgtgctccgcatggctgtgttctggccttgaaggttggctgatgctgccatcagcactttctttgtcagtatctggagtctcacaaagtagcaaaccccacagggttactttcctctctgacagcaatgctgcctagatgtgagtgctcaggttgtggttggggatcaagaacggctagcaaatctaacttggtgatggattctgtgtaacccaggacctggggaaatacaggaactaaaatctgttcttgtgactatttgaattctcaatgcagtcttgcatccctcgttcaactgcttggccagacttccttgtactgggtggggatccctccccactcaagttccacggggtgagcggatgagtggtgtgtgaaagggcacacctcacttaggtctcctttggcaccagggagaggaaacagaggtaaagctgtctctgtctctgcctcagacccatgcctactcctttggcactggtcactcagcagtagaatagtagtatagtagtagacggccctatctgcatagtcacacacctcgggttttgagcattgtgtaatgaccagagtaaactggcctggctgtttgcctctggtccacagctcagatgatcatggtgtacagagcctggtggaacccagttacatctccactgttatttaagggcaatttatttgctcttcctcagagttcccctttacagtctgcaggcaaatatacagatactttagtaaatgtttataggaagacctgctggcagaactggtctcatggctgcagactatgaacagaagttgtttctccactttgggaaattacatacagctaagaataaacttgttcactcagaatagatttttggatcccacacatcctggaaaaaactgtttcttagtgcctgtctgttattgaaaagaggacatctaaggtagagattcaattcatttcaaattttagcttaataaagtaaaaagaaatgatagaggtctttaaggattctgtacactttgaacactggccacagagcttacttggtaagacttggtaccaatgaagttacaggttcattctcaaaaagggtgtcgttctgagagcagagcttagtggaccctgtgagaagtatcaggcctttctacttcaagagactcagagatctcttaggctttatgtcctcccatttgaaagaaatcatcccctaaacgttcccagaggagaggatagggaaggaagaggcaaggagatgtgactggccctagggaacaactgtctgccctcactgtgtacgggacaaccaagtcccaggcctcctcacagcgttttgctgatgaatgttgagagagaacatggcactctacgtgagagggcagcacacactgcactgcccctctcggtaccctgccagctgttcctccccctgaagacacagtgggaggttttatgctggcttgcaaagctgtcaaaattatgctagaagagtgtctagaatcttttctcactcactcactattactgccttttcagaggactgtcctttcttctctgtgtagagcactctatttaagatatgaatattccccaaaatgctttcatagagtttcacagaaaattagaggaagggttaaggctgcacagggctggcccaaccatttgctgtgtggtgaagaatttcagtttcattacctagatattttacacaaattggaaggaatgaaaggcattttgtggtattctgaggaatagaggcttgacgtcaatacagaattttcatcttctttcactatgtctaaaggctagttaacatcaatgtctgttgtcagctgctcccccctacctcccacacacaccacaactggggcctttattagagtaaaaaatatatgagacaagagggtaaaagaatgtaaatgaagccatgcaaatttgttagaaaaacagctttaagtagatggtaatcaacagagggtctgtaatatccctcaaacgggaaagacagtatttatgaacatcaattatttatagattacctcattcactctagaatatcctgaagatattatctacacatttttatttgaaacaaagggaagaccatagtttgttcaaattgctgtcgtgggattaatttcatttgggttagcatctgctctcctccccaaagagtttcccttggctgtggaaatttaacattccaggacaatttagaaaatgctctcttggtttgtgagtcaggagttctgagtttgtgcagtgagcaggtctatgcagacctacccacaaaggctgagggagctgaaaagccaaagaaagaggctgacaaatccagtttctcagaaagaaacatttaataagagcttatgaacagaagtgatgtctaggaggccatgagacagtggatccctgcaccagccctccagaaaatatcctttatatagcaaggttttaggataaaacatgtgcagctagtcacgcttgactttcttgcaaaacttatcactggagcgattggataagcatctttatgaggggttgtctatgctctgggcactacccctttatgagggataatctatgctacaggcattgtttaaagactttgctgcagaacaaaccaccttggtatgcaggagtcaaaccaccagttagcatggtggtttcactccaagatggcatcactcctgccatgcaacaggctgttttcctacagttttaattctatttctgttattgactatgtgaactttgataagacctggtgtttaactttctacttggtaggggcaaaatggtgggagaaggggaatgaaaaaaaaaatctcttactaactgaaaaaatatactgtgaagataaaaaatgtctaacattgtcgtattggcagtgttttaaacatggctgtgccaagtctgagcatgccatgaaggcatgggcaggatgtatgccaggcctgtgataatggtagagatttttaggcactgactatgcttcctgttgtctgaatagacatgggggcaattacagaaaagtggctgagagcccaggacatagaaaataaaggggaggcacagccgcagccgctgtgagttggcattttaccatgtcgggaccctcttgtctttatgaaactagaaggggcccttaggcagctgctgctgcataaaccttaaataatattgaaaagggttgatgtgagaaatgaataggaataatgggactctgataggtctggctagttagaagctcaaggttagtcaattatgtgagctagcaatctattaacttgatgttaaggaggaagacagactttttgctccatgtgggtgaaggctctattaaagagagagccgatgtgggtcaggtgtgggaggtagtaagccactaaagaattgttaatgagacactccttgtgtgggtgaaggctcataaaagctcgctctcctgagctgggatatgttccagcctcaggtagatacgagtgaggctgattttgccatgattagcagagttacttaaaaaggaaaaaaagaaaaatgtggtcttattcttggatctgagtctctgagtttcagctcagctgcagtaaagctctccagggcacgccaaatgctgtgtattcattgaaggttcctgtttgtctcttccagcttctgcctcctgctcctggtacctaatttctgctcctgccttccactttcctcctaatgtgagctcaactttcagctttctcacaggttctcctttccttctgttccctgggctgcttccccctcccacagtgtgtgcctcccctccgtgtgtttgtgatggaggagtgctctgcgtccttcagttcccctttagcagaacagtatccatctcctcttatcccatgtgaagtttctgtctcctgctgtgtctttactgaccagaatgagcacttactctcctacatctatttcaagtgttaaaaaatacagaattccgggccaggcgcagtggctcacacctgtaatcccagcactttgggaggccaaggtgggcagatcacaaggttaggagttagaaaccagcctgaccaacatggtgaaaccccatctctactaaaaatacaaaaattagccgagtgtggtggtgcacgcctgtaatcccagctactcaggaggctgaggcaggagaatcgcttgaacccggaaggtggagcttgcagtgagctgagatcgcgccactgtactccagtctgggtgacagagtgagactctgtctcaaaaaacaaaacaaaacaaaaaaaacaaaaaacgcagaattccctttctgcaactgaaaatgatttttaatctgataaatacatttgtcctacttttacattatgtgaattgtgatttgtacaggctctctccagtagcatccattatactattacaccaaaaatttattctgctttttaatatctctccttttgttgttgttgttttgagacagagtcttgccctgtctccaaggctggagggcagtgatgagatctcagctcacagcaacttctgcttcctgggttcaagtgattcttgtgcctcagcctctctggtagctggaattacaggcgcccgccaccacgcccagctaatgtttgcattttctgtagagacagggtttcaccatgttggccaggctgctctggaacttcgacctcaagtgatccacctgccttggcctcccaaagtgctgggattacaggcctgggccatcgcacctggccagtgtatctcctacctagacaaagacctagtccttttagagaaaacttaattaaaactctgcaaagatatctccatttagcagtgtccatataagaaaaaaagaattctgaactccaaatacgataatgtgttaattacttgcaacaacattcattacaataacatttggttatatttaaatacctcccttatgctaaactaggttgtaacctgtggtcttttgattctttagatgtttctttttaggacattgcccctagaataaagcagagtcctggtaactagccatttccactcagctttgttccttccttcttaaatcccttgggcactacttgggagtttaccactaattttattaaacttccttttatagatttctttattttcattttatgcacattttctgctctcacttcctgcccaaatctacttggaaaaccatttttattttttgctttacctcctagtgaatcatgtggcaagtgaaccaacagtctgaattttttatgggcctgttttgggttttttttttttttttttttttttgagaccaagtctcactctgttgcccaagctggagtgcagtggctcaatctcggctcactgcaacctctgcctcccaggttcaagcgattctcctgcctcagcctcccgagtagctgggactataggcacacgccaccatgcccggctaatttttgtatttttagtagagatggggtttcactatgttggccaggctggtcttgaactcctgacctcgtgatctgcctacctcaacctcccaaagtgtgggattatgggcgtgagacactacacccagcctattttggattttttttactcaaaattctatcttgcccataacctggttcatttcaggcttaactatccaggtcctgggccttgggattaatttgcattacttaccatcatgtgttttctggtgagagcccaggctgatcatggcagcaaaagcacctcctaattgctgatgagagcttcctggccacctaagctgtctcccgcatctactggttgaggtgtttgtgttgggcaagtcaagggttaactcccatacacctagggactttgcattcccatctactccccaccccttagtagccatgtaactatttcttttctttattttttgagatggagtctcactctgtcgcccaggctggagtgcagtggcgccatctcggctcactacaagctctgcctcccgggttcacgccattctcctgcctcagcctcccgagtaactgggattacacgagtgtaccactacgcctgcctaatttttgtatttttactggagacggggtttcaccatgttggccaggctggtctcgaactcctgacctcatgatccgcccacctcggcctcctaaagtgctgggattacaagcatgagccaccgcacctggcccatgtaactatttcttatcatgtgaaagcttataatatttttggagttctggcttttatcagtgctagaataccaactgttttatattctttaggattgagtttatcaggtagaaccactgtgcccatgtttgttccaactttacaaacagttcatgaattcccagtcattaatacattaaccagtgtgtttcccattgcattagtttttctctccattggtttttagaaatattatagaacctatagctttaatgggctatgcttccctctggtgtcctaataaaatactttgtgtctcttataaattgttccacttgtgtgtcagttttgacttgtttaaaaatagtatgtctagttgattgaacaaatcaagattataagcagagcagaataaaaggggctttactgaaatgtctttcctaattcccaaagccaaatgctcttcctctccttgaaatttatcccctttagaatctgtcttgtgtttacttggcacttgaatcaaacttctttcttctgtgtgtgataacattttctcctaatccctgcactcccccccccgaccccttcccccatcccctgctcctaacattttttatgtgggtcgtgacttgtctaagccattctttgtaatccagacgtagctccacctatccttggtggctgctacatttagagcagccacacagtttgggaagggaatatcaagagagcctcttggctttaaagagtcagctgatagaattgtagcaggtttagtgctccatgagaattgactgaccagctaagggagcccttagacaaagtaaattctagggtccatctcaagacagtgctaactcatcgctgcccatgctaaagttgtctttttgtttttcctagaagtttcaggcacctgcaagagagacctgcgtggaatgtcagaagacagtctatccaatggagcgtctcttggccaaccagcaggtgtttcacatcagctgcttccgttgctcctattgcaacaacaaactcaggtaagtcagcccaaaacaagccatctgtctataactggaactctagagggagtctttggcttttagagcactggtgctaaaagctactgtgctaatgatattctgttgaaggctcttgaataaagtaaaaagcatcatttagtgacaagtctttcataccaaataatgatggtgtttggaacttcttggtgtattgatatgttaatttacatgttaggaccgaagcttaaataatatgagttgcaggtaaacccccctgtgacctaatttaatagaatgttttcccttggtatcacagaatcacaaagttaagaaatctcaagaggttacttgtttaagcccttacttgtcttaaccactgtataaatgataataatggcaataataatagcccctggagagcatgtctttttctctatgttgcctcactttatttctgagaaaatagttgttacatatcatttcttccaagtaactcaaagtgcaaatataaatgtgacaaatcggggaaacattccaaattaactcattttaatcatagagtcttacagaaggaagtaaccaagatgtcactttctccagctttcctttctgagcaatccttcctaaaatactcttgaaagatgttttggcatctgtgtgacatttctagctattagatagctctagctagacagcttctccaaacatgcagccaaagtgtacctcagtcacttccactcattagttcttctgctgcccactgtgttaatttttttctccaaagcacctttttttttttttttttttttggatacagagtctcactctgttgcccagggtggagtgcagtggcgtgatctcagctcactgcaacctctacctcctgagttcaagcgattctcctgcctcagcctcccaagtagctgggactacaggcgcccgccaccacacccagctaattttttgtatttttagtagagaaggggtttcaccatgttagccaggatggtcttgatctcctgacctcgtgatccacccgcctcggcctcccaaagtgctgagattataggtgtgagccactgtgcctggcttaaagcaccttatttcttttgtggaagtgctgccgttttataccccctttaacatttgtcactcttcagaatggttcgtaacttaagggaaaaaactttaaaaagataaaacttatcatcctgcaagagacaccaaatctcctaaaggcttgtctaggactgacattagggaaaaactacctcctgtcaactcctcaccattcttctattaatcaagcttatatctaggtgtggatataaggatcacacctgtaatcctagcattttgggagtgcccaggtaggaggatcacttgatgccagaagttcaagactagcctgggtaacatagagagaccccatctggtttttctttttgagatggagtctcactctgttgcccaggctggagtgcagtggtgtgatcctggctcactgcaacctttgtctcccaggttcaagcgattctcatgcctcagtctcctgagtagctgggattacaggcgggcaccaccacgcccagctaatttctttctttttttttttttttccggagatggagtcttgctctgtcgcccaggctggagtgcagtgggatgatgtcagctcactgcaacctccacctcccaggttcaagcaattctcctgcctcagcctcccgagtggttgggactacaggcgtgtgcaacatgcctggctaatttttgtatttttcatagagatgaggtttcaccatgttagccacgctggtcttgaactcctgacctcagtcagtctgccctcctcggcctcccaaagtgctgggattacaggtgtgagcaaccacgcctggccaatttttgtatttcttagtagagatggggtttcaccatgttggtcaggctggtctcaaacttctgacctcaagtgatctgcccacctcggcctcccaaagtgctgggactgcacctggccggagatcccatctctatgaaaaatttggggaggctgagactgaggctggaggatcacttgagccctggaggtcaaggctgcagtgagctatgatcataccattgcactccagcctgggtgacagagcaagacctccactcaaaaaaaaaaacaacaaaaaatggctgggtgcagttgctcatgcctgtaatcccagcactttgggaggccgaggtgggcagatcacgaggtcaggagattgagaccatcctggctaacaaggtgaaaccccgtctctactaaaaatacaaaatattagtcaggtgtggtggcgagtgcctgtagtcccagctactcgggaggctgaggcaggagaatggcgtgaacctgggaggcggagcttgcagtgagctgagatcgtgtcactgcactccagcctgggtgacagagcgagactctgtctcaaaaaaaaacaaaaatggctgggcgtggtggctcacgcctgtaatcccagccctttgggaggccgaggcgggcagatcacgaggtcaagagatcgagactatcctggccaacatggtgaaaccccgtctctactaaaaatacaaaaatttgccgtgcatggtggcacacacctgtagtcccaactactcaggaggctgaggtaggagaatcgcttgaacccaggaggcagaggttgcagtgagctgagatcatgccactgcactccagcctggcgacagagcgagactctaacaaaacaaaacaatacaaaaattagccaggcgtggtggcgcactcctgtaatcccagctactcaggaggctgaggcaggagaattgcttaaacttgggaggcggaggttgcagtgagccaagattgtgcaactgcactccagcctgggcgacagagcgagattctctcaaaaaaagaaaagaaaaagaaaaaaaaaatatatatatatatatgtatttatataccgttaagaatagagttaattcaagcacaaaagcttgatgatggctacccagaaacactgactccaaatgaatggggtcagcattccaaagtggagaaagttagtttcacttacacagaaattttagcaaagattatgacatttttcatataagaccagtgcatataccacagtgatttgattgggtacagattggtacattccaaggaagattatcactcgcaaagaagggatagtgatctgagggggtcttatctctggtgccctttggtcttcataatttatagtgaaaagaaagagttgcagctacatgctgtgtgacccaggttgcatagccacattcctctcaaggctcagaatgatttaaagtttctattactgttggtttttttttctttttttttttttttaagacagtctcgctctatcacagtggcacaatctcagctcactgcaacctctgcctcccgggttcaagtgattctcccacttcagcttcccaagtagctgagactacaggcatgtgccaccacacccagctaatttttaaattttttgtagagatgaattctcactatgttggccgggctggtctcaaactcctgggctcaagcgatcctctcaccctggcctcccaaagcgctgggattacaggcatgagccactgcacccaacccgtgctttgtgttatgataagaaaacaaatgtgctaaaatgggggtaaggaattcctggtcactgaagggcttttaaagatctttttcttacttggcatcttctgaaaatactggaattgccagattttagcctcctggtataagtgagaatgtgaagatttgctaagtttatgctttttttcttttaatgacagtctaggaacatatgcatctttacatggaagaatctattgtaagcctcacttcaatcaactctttaaatctaagggcaactatgatgaaggctttgggcacagaccacacaaggatctatgggcaagcaaaaatgaaaacgaagagattttggagagaccagcccagcttgcaaatgcaagggagacccctcacagcccaggggtagaagatgcccctattgctaaggtgggtgtcctggctgcaagtatggaagccaaggcctcctctcagcaggagaaggaagacaagccagctgaaaccaagaagctgaggatcgcctggccaccccccactgaacttggaagttcaggaagtgccttggaggaagggatcaaaatgtcaaagcccaaatggcctcctgaagacgaaatcagcaagcccgaagttcctgaggatgtcgatctagatctgaagaagctaagacgatcttcttcactgaaggaaagaagccgcccattcactgtagcagcttcatttcaaagcacctctgtcaagagcccaaaaactgtgtccccacctatcaggaaaggctggagcatgtcagagcagagtgaagagtctgtgggtggaagagttgcagaaaggaaacaagtggaaaatgccaaggcttctaagaagaatgggaatgtgggaaaaacaacctggcaaaacaaagaatctaaaggagagacagggaagagaagtaaggaaggtcatagtttggagatggagaatgagaatcttgtagaaaatggtgcagactccgatgaagatgataacagcttcctcaaacaacaatctccacaagaacccaagtctctgaattggtcgagttttgtagacaacacctttgctgaagaattcactactcagaatcagaaatcccaggatgtggaactctgggagggagaagtggtcaaagagctctctgtggaagaacagataaagagaaatcggtattatgatgaggatgaggatgaagagtgacaaattgcaatgatgctgggccttaaattcatgttagtgttagcgagccactgccctttgtcaaaatgtgatgcacataagcaggtatcccagcatgaaatgtaatttacttggaagtaactttggaaaagaattccttcttaaaatcaaaaacaaaacaaaaaaacacaaaaaacacattctaaatactagagataactttacttaaattcttcattttagcagtgatgatatgcataagtgctgtaaggcttgtaactggggaaatattccacctgataatagcccagattctactgtattcccaaaaggcaatattaaggtagacagatgattagtagtatattgttacacactattttggaattagagaacatacagaaggaatttaggggcttaaacattacgactgaatgcactttagtataaagggcacagtttgtatatttttaaatgaataccaatttaattttttagtatttacctgttaagagattatttagtctttaaattttttaggttaattttcttgctgtgatatatatgaggaatttactactttatgtcctgctctctaaactacatcctgaactcgacgtcctgaggtataatacaacagagcactttttgaggcaattgaaaaaccaacctacactcttcggtgcttagagagatctgctgtctcccaaataagcttttgtatctgccagtgaatttactgtactccaaatgattgctttcttttctggtgatatctgtgcttctcataattactgaaagctgcaatattttagtaataccttcgggatcactgtcccccatcttccgtgttagagcaaagtgaagagtttaaaggaggaagaagaaagaactgtcttacaccacttgagctcagacctctaaaccctgtatttcccttatgatgtcccctttttgagacactaatttttaaatacttactagctctgaaatatattgatttttatcacagtattctcagggtgaaattaaaccaactataggcctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatttttattcaataaagattttaattaaaatttg

SEQ ID NO: 38239 - DNA, 33495 bp, Homo sapiens
ttctttctttcattcattccttcctctgtttctttctttcttcctttcatttttttttcttttttaagagcgagcggctctgcggtggcggtttggggtgggcgccgccgaggtgaggtcgtctcgcctcccgcgcgccggtaggtgagtgcggcctcggtcctggcctggcggcgacacctgggttccagcttccttacggaagagatgagctgcggctgctgttagggttagggccaggcctgttctcagtccgcgcacccgctccttgtccggagtagccgaagcctggggcttgcgggcccagcctgaggggagctgagggtgcccgcgggaaggcatctgggtcgcggcgaggaccctttcaggcgggcccaacactgccgggcgtttaatggggtttccccaattttctgctaggtagggccacccaggtttcaagtgagtagcaggctccgttccagaggtcttggaacaggtccaggttactcactcggatgtgcggcgtctggttggaaatggttgaatcccagaatggcagtgcaggatgggaagcacatttattgtgtgccatgtaccagttgctgtgccaagcgaattttctattacggaaaacaagccagctggcccgttttgcagaaaacttaagaaacaaagagagttgaagcgtcatgcttgagagttggtggtccttgtgactgtcagtccacacagaggaaagggggagacctgtttgttcgtagtcgtggttctttaatgttagtggaaaacaagatctcctggggcccttttaaaatgcagtttctcagactcccgcacgctcgggtagcccgactggttagttcaggagtgggacccaagaagccagatgcgagcctggtgatcggaattcccgatgacctcttgcctaccacctgtgacataagatttgtcgattcatcagttatttggtgtattcatgtgtccacagggacaccataaaatggaaggcacccttctgaaatatttgaagggaatcagtgggtagactcctttttgatacaaagtattgagccgacagcagcttttacagtcttttagttagatgacctgcgaacaatttgtaaggatctgaaagtagaggctgcccgattatctttctcaactgaagtcttcatgtccttaccctgtggggaagtgcttcatgatataagaaaggaataattgtgtcaaaaccatttagttgattatcagtcttcactttcatcttccaagaatggtgatgcttggttagaatcaagctgctgctttagctattgaaaaccacgtatgtggtaaatcaagtaacaagtgcgatgtacgtacagggtcagtcatagtgtaattatgcctttatggcagctaaattaagcattttcaacgtgttcaccattagtcaccttttgaacatactttgtcttcattcttaaatattatgtttcactctttactatagaatatgttgttaagattgttttgtctaaaatcaagtatcgacaagtttaaaaaaaagattgttttgtgtttggttttctgtatttccactatgctctatggaactatgggtttgtttttgttcaatttgtttggtatttattagacttcttgaatctgtggattagtgtctttcattaattctgtaaaattctcagccattttatatgcatatattgcttcttcccattgtttctctttttttttttatcgatttaactaaaccttttcactcttttctctatgtcttttactctgttctttcgtagtacattctggataatttattctcaagttatttccattgttattaaactcggcctctgaaatcttaaatcatatattgcaatttttagtttctgaagttctgtttggtttgtgacacttttacagttttttatttcttactattttgaggcttaattttatttctttaaacatggaaagtatagttgtttttataatctctatgtttaattccactgtctgaattccctttgggggagtctgtttctgttgtccattattcctgctgttttacttcccagttcacctttactttgaagctgtagttcttttgggcacaagattaagatggagagggaggtagttgtcagactccactccctggatgggctcctggcttgaacttgtttctgttatctcataaaggcactgaaactttagcttttaggtcagagaagtcctcaggatgaaatccattttgaatattgggcttaatttctggttttcaccttctagattgtgtccaaattctttactatcttgttagcttttctatttaagaattaatatttttggctgggcgtggtagcttacacttgtaatcccagcactttggtaggtcgaggtgggcagatcacttgaggtcaggagtttgagaccagcctggccaacatggtgaaaccctgtctctactaaaaatacaaaaattagccagtcatggtggcgggcacctgcaatcccagctattcgggaggcagaggtaggagaatcgcttgaacctgggaggtggaggttgcaatgagctgagatcatgccactgcactctagtctgtgtgacagagcgagaccctatctcaaaaaaaaaattatttttgacaaatttccagcatatttagtgcagaggtggagaattggtttcaattacctagcccactatttcaagaaatgaaaatccccctgtattctgaaatttggaatgtgaaatttgtgtgatttccaagttaaagatggttattcttcatatacctaaaatttccaccacttttcactgtgcatcgtcacagccattatgaaaattaagcttccccaatgcttattctagtcttcctttctgaactgcttagtgcctcttatggcctgtaacctagttttacttttccttaaattgctgtgtgccaaccttatgtcttttactgaatgagtgtaagttcctcagttgcctgtttagtacatagcattgtatcttgcacataataggttctcggtaaatatttgcttcaaaaatcttttttctttgagatggagtctcgcccacttcgcgcaggctggagtgcagtggcgcgatctcggctcactacaacctccgcctcccgggttcaagcaactctccttcctcagcctcccgagtagctgggattacaggcatgtgctactacgcctggctaattttcatatttttagtagagacggagtttcaccatgttggtcaggctggtctcgaacttctgacctcaggtgatccacctgcctcagtctcccagagtgctagggttacaggcatgagccactgcgccaaaaaaaaaaaaaaaaaaaatcttagttggccttgtctggttattgtaatgcaaagtttttttttttttttttttttttttaagggaaatgggtatctccttatgttgcccgggctggccttgaactcctaggctcaagcagtcctccagtctcagcctcctgagtaactgggactgcgtttttttgttttattttgtttttaatttggtcttgaagtggagttatatagggtggggggagggaggatggagtatgacttgaggtgtgggttaggttctgaagcgagcctagatgacaaaatagcttacaagcaaagctacccttgaaatctcagggaggcagcatgttaattgtaggaataccagtgttgcagaactctgacatggccagtgtgatattgtaaaatacatatttggccttcatccctgtctcctgtggcatatgactcctataatccttgaaatctccaaaatgattagtgtctttttatatgctaaggagctgactgatggctggcagcccctaagtaactttagcatgggggctggtcacttgaaagacccaggcaggattagagggttgggaccttcaaccaatgtccaacctctggggagaggagaaggcagacgagctgatgaccaccagcgtcactggtttaattagtcatgtctaagtaatgaagcttccataaaaatccaaaagactgggattggggagcttctggataggtggacatgagaggttcctggatgatggtgccccagagagtgcatggaagctctgtgcccttcccacatgccttgccctatgcattgcttcatctgtatcctttgtaatatgcttttataataaaccagtatatgtaagtaaagtgttcctctaagttcctctaagttctgtgaattggtctagcaaattaatagaacctaaggagggggtcatgggaaccctgattaatagccagttggttagaactacaggtaaaacaacctgattcttgtggttggtatctaaaatggaggctagtcttgtgggactcacccctcaacctatgggatctgacgcggtctccatccaggtaggtagtgtcagaattgaactgaattagaggacacccagctggttggtgtctgctacagaattggttggttgcttggtgtgtggggacatatccctcacagaattatactgtgttgattgttgagtgagagaatagcaaaaatgctttggtttggtttgggttttttttttctctatatcctcaggcaagttttatttcggctttggaaaaaactgctgtttttcttcctgtgagccccagatgaagttgttggtttgtatttaggagtcacaatatgtaaaaaatacaatgaatacaatcattcatgcatagtgagggaagtatttatattcagagaggtgcatgtgaatgaggatcagctaagggaaccgatatttaaattagttatctttcttctagtgtgtataggtgaattcaagataaatgcacatttgagaccctgcccttgtgctatggaaagataaataaatcaatactttttttttaacttcttttttttccccctcgccaggcaaggtcggtcttgtgctgttgcccaggctgtagtgcaatggccctcatagctcactgtagcctggaactccttggctgaagccttcctcccacttcagcctcctaagtagtgcaccatcacacctggctaatttttaaatatttttgtagagagagagtctcactgtgttgcccaggctggtcttaaattcctggccttaagtgatgctcccagcttggcctcccacagctttgggactgcaggcatgagccactgtgcctagcctgtttgtctgtttgtttgtttgtttgtttttaatagagttggggtctcaccatcttgcccaggcaggtcttgaactcctgggctcaaacaatcctgccttggcctcccaaagtgctcagattgcaggtgtgagctagtgcaccaggccttaatttcttttcttttttttttttctttttctgagacggagtcttgctctattgcccaggctggagtgcagcggcgtgaaatctcagttcactgcaaccttcgcctcctgggttcaagcgattctcctgcctcagcctcccaggtagctggcattacaggcacatgtcaccacagccagctaatttttgtatttttagtagaaatggggtttcaccctgttggccaggctggtcttgaactcctgacctcaagcgatcctcctgcctcagcctcccaaagtgctaggattacaggtgtgagccaccatgcctggctgaatttcttattgtatgtgtttcatagatgcctgaaagattattgcaaagctgaattttttattgtatgtgtttcatagatgcctgaaaggttattgcaaattgctccttatgataaacatttaaaatatggattaaatttctttttctgtggtttagtttttagattcttttagtctcctttgctaccggaatatgttaattaagctttggtgttagaagattgacttcactttgcctagtaataaatactaacagcgggctctctgttagtagttgttgttctctaaataaattttatgatataggaaaagtcagctaaatttttaaaaatctaaataactgtatcttggtagaagtgccttctggccagaaataagtctttatttgaaatatagatgagttagccagatggcaaattcctcttagttgctgtcctgcattttgaagtacagtgtgacttgaacatcagagtaaaaaatgttggaaagcaataatctatatttactcacaaaaggaaatggattgacctattgcttttgctactgaaagtgaagccttaaaacaacagaacacagaaacctgattctggtgtgttttaacatgtacaatctaattaattttagaattagaaggatatggtggccagtgatgtaaacactcaagtagtttgccatcacataattcaattccataggaaaccagatctcattactttgtgtcatggcactagctaaatggagtcatttttcaagttaggaatagcaattatttggggagcaacaatgtaagttttgtattttaaaacatgtgtagtgtgctatgtaagaactgagcccattttgtcccaccaccctggaaattaaatgggacggtctccaatgtaaacccagtagttcagtgttaccagttactttggcttgaaatataagaactttgttttcttgacggtcaggcagatttgaaaaccacgttctttatttgtgccaatttggactctaagtttggtggacaaagtgaattttgaaatggttttagttttccatgaattccctatttgaagaaattgaataaatcctttaaaaaataatgtaatgtttagtttgataattaaacttgagtcactttggaaaacgtgagtaaaggaaagctgacagcatttgtttactctttctaaagtggaacacagtaaggacaaagtaagcattcctaatgtaagtcctctgcattcctacagggctcttcacagttagagcccgtatccctgatatccctgggctgtttgtcttttgatttgtttttaattaccctagcaaacaaaagggaaaaagaagagacttgtgaaaatttacctagacaataggaattagaagtcaacacaatctaattttctagcttctttgtctacttccagcaggtcagtaagttacaggtacttatcacctctttcttgcagaataaacagccattggactcttcaaacaaaaacgctgtctccatcaagtactgctttcgcaggataagtgaccatttttaatcagttgaaattaacggaaagtagcagttatttttgaaagatgacatcaattatataatatagtaaagagatttaatttttagtcctttgtttcttactgcacaaattgtatggcgtttgaatagaattcccatgatactgacacttcagcaaatacttgcttgatggctaccaatctctataacttacattgcacagtacctaggaatattcatgtgagttcattcctccctgctcagattcttcagctcctcgtggttggtttattcagtaagtatttgaatacctaatatatgccagacactgtgctaataataataagcactgtggagacaaagagctgttggaacagtcacagatgataaaacacaaagaataagggctgtagtagagttatgaatgatcatagcaggaacacaaaggaaggaaatacatattaactactctaggaggtcttggaaagcttcataaaggagatggtctttagtctgattctgggcggttggagcagcagtttgcatcgggtgaaaagaaagcaagggcattcctggcagagggaacagcctgagcaaagccatgcagagaatgaagacctacagaagaaaatgctaatttgaaaaaagatgcataaagcagtctatgttttagtctagtctttttaaacttacagaaatttattactatgtgtgtccatctaacttggcttattttctttatttggggatcaagggaatgccagaattatgatattagttttattactaattaattaatttatttattgagacagggtctcactctgttgcccaggctagagcgcagtggtgcgatcatgggtcactgcagccttagcctcctggagtaaatgatcctcccacctcagcctgtgagtagctgggactacaggcacacatcaccatgcctggctagttttttaaattttttgtagagatggggggtctcactttgttgcccaggctggtcctcctgccttggcctcccaaagtgttgggattataggcatgagccaccatgcccagcctgaattaagatattagttttaaagagcagacttttgtaagtgtgcattagttttgacagtgtgactgtgttttcaggacaccaacccactgagagctgatgagaaatacatttcttgtatttttctttcccctgcaacgcttgcctttaaattttttttttaaatatgcatttactttatttcttattttcattaaccaactgatttctggttttgtccctgtgtataaaagattgtaggccgggcacagtggctcatgcctataaccccagcactttggcaggctgaggtgggcagattgtattgcttgagtccaggagtttgagaccagcctgggcaacatggtgaaaccctgtttcacgaaaaaaaaaaaaaaaaaaattagccaggtgtagtggtgcatgcctgtagtcccagctattcgggaggctgaggcatgagaactgcttgagcccaggaggctctctgaattcttatttaggtagaaatgtaaaattctagggtttgtttttattgttgttgttgttgtttttggcatattggaagatttttaaattttctcttttaaaaatataggccgggtgcagtggctcacacctgtaatcccaacactttgggaggccaaggccggtggatcacctgaggtcaggagttcgagaccagcctggccaacataatgaaagcccatctttactaaaaatacaaaaattagccgggcatggtagcacacacctgtaatcccagctactcaggaggctgaggcaggagaatcgcttgaatctgggaagcggaggttgcagtgagccaagatcgtgccactgcactccggcctgggcggcagagcgagactctgtcttaaaaaaaaaaaattatatatatataacaagaatgaagagagacatttactgggacaccaatggcattgccgtatcctagtatttatttcccaggtttaaatcatatctaatctgataaattcatttccttcagacatgattatttttctccatcttataaaattaaagtaactaggaatgtttggctcagaaaagcaacaaattaggaggaacatgggaattgtcttcaaacaactgaagtatggtcatgttagaaaagatttgattctttttgtatagtcccagtggattgaacctatgtattgaatttatagtaaaacagatttcagttcagtttaaggaagaactatcctaacagtcaaatctgcttagagagggagttggctgcctaggaagggaatgcagtggtccctcttgaagttttaatatatgagttggatgaccttctcctgggtgtgtatggtaaattcagatgtcgagtggattatcatattaggtgggctataaggactatcccaccctgaattatttactaggaaaaatgggtgatggaaagaaaccagatgattaatacaggatgagaaaggagacacggttaataggggataagaaagggggaaattgagggttcggaatgtctctcccaaccattagagccctagaaagttcacgttttctctgccagagacatttaagaaattgttggctctggtttcataagaggttgttctgtagaacttgaggaatttttggcattttcacagagactgaacagttctgcttcagtaatgagcctctggctggagtcattgagtgctgctaaatcagaagtgtccaggttgtgggctttaggtgggagcaacagcgtctgtcagttgatttcatttctttctagtaattttcacaattcgctcttattgttacattaaactaaacctcagcaacagtagtattcaggctgagactattctcttgttctgaacgtttgggtttgttttttcagcttccatttctagctttactaaataaaaatgttgcatgaatattctcagcactggaatttgaagtaggaagaaagctgaagtcgacatgtctttgttttcaactaagatttagtgttttctggggaggagtatggtaaagttggtaagagtatgcatttttgatatcaggcctggatttggttctcagctctaccattcaccacctgtatcaccttagacaaataatctaactcctctggacctcaacttcatctgtaaacagataatatttctcatagggtcaatgatcatgtaaattagataatatccataaaaggaatataatacatggtaagagctcattaactgttagctgctttatttttgtggtagcgtggaaacttactgtttttgttgttagtggttatcttggaatggacattggattgaatatgtgcctccttgttagcacatagtgctgtgaataacatgtctgggtaggggttaattccacagttactcaaaaggaaagaaaccaataaagaaaaacagaggtttagtttaaaaggagtaatatggccaggtgcggtggctcacccctgtaatcccagcactttgggaggcctaggcgggcagatcacgagttcaggagttcgagacaagcctggccaacatagtgaaaccccatctctactaaaaattcaaaaattagctgggcgtgttggcacacgcctgtagtcccagctagtcaggaggcggaggcaggagaatcgcttgaacctgggaggcggaggttgcagtgagctgagattgcaccactggactccagcttgggtgacagaacgagacttcatctcaaaaaaaaaaaaaaaaggagtaataagtaatatacactctgctatctttatttccttctctcctctttgaagaaaagctcaggtagaaataacagattcggtaatcttctgtgtcaaaatatgcataaaatggttgaggtgattgtgggagtgagaaaagagaaggattgaagttcaaatcttaaatggcacagacaaggggtttacagggaggaaggtcagaagagatataaatgaagagtcagattagtattcaggaaagtacgtggaactgaagttgggagatctgttcttccagtctcactttctccattcatggtttgtgcaccttccctgctatacagactggacttgaacactaagtcttcaatagctgagattctccatcttaatctacttggaggcaagagcaggtgaatcaagatagtgtaatgtctcagaaacaggaatttcaagaagaaacaatgtcagatgttacagaaataaaggaggatgagagctgggaaaaggatgggatgctcaggaggccaatttttctagattagagggacagagaaatagctgcaatatgagatttactatggaacaccaggtaataagaattatcccaggtcctcttgccaactgtgtagataacatcgatgttaataaaaattctctgatatgtcaggaaaaatgtattcatgtgctttcatcaatggcctataaattaaactatttgagagttttttttttttttgagacagaatcttgccctgtcgctcaagctggggtgcagcggtgtgatcttggctcactgcaacctccgcctcccaggttcaagcgattctcctgcctcagcctcctgagtagctgggattacaggtgcgtgccaccgtgcctggctaatttttgtatttttagtagagacggggtttcaccatgtcagtcaggatggtcttgaactcctgacctcgtgatccatgcgcctcggcctcccaaagtgccaggattacaggcatgagccaccgcacccggccgagaattttttcaattcaaagttggaagataatttttagtttgttgctgggtgagatggagctaaatctccttgtttctctttagaattttaattgcagttctcacttgaaatgattttttttgtttttgtttttgttttgtagattggttgtttcattatggatggaggggatgatggtaaccttattatcaaaaagaggtttgtgtctgaggcagaactagatgaacggcgcaaaaggaggcaagaagaatgggagaaagttcgaaaacctgaagatccagaaggtatactgtgacagtcagtataatggtctttaatccacacagcaaccctgcagagtaggtattaattgtcctcacttggttttatttatttatttttttgagacggagtctcactctgttgcccaggctggagtgcagtggcgcgatcttggctcactgcaacctctgcctcccaggctcaggagattctcctgccttagccttccgagtagttgggattacaggcaccagccaccacgcctggctaatttttgtatttttggtagagatggagtttcatctgttggccaggctggttccaaactcctgagctcaagccatcctcctgcctcggcctcccaaagtgctgggattacaggtgtgagccaccatgcctggccaattgtccatactttagagttgaggaactgagactcaggggcgaagtcacctatgtaaggtcctgcacagctgggagcagagccagcatactcacatcctgcttcttttctgcctaccacacttccttccaagagattctgctcctctcctccatctatacaggtggatccatggtctgaacaactgagaacactgctgctgtggagggtttgggctggcccctcaatcagttaactgtctcaggccatgggcgctattgacattgatagttggctttgagaactggtggcccctctctgaggtccaaagggaaactggactttgtactatttttgtgttatccacaccctcagatcatgcagagacttgactttgtctttaaaaccttttgtgattccaaaataatatgaaaacaatctgaagtgtatatctcctccccgtccacctctctcccctctccttttcctttcagaatgtccagaggaggtttatgaccctcgatctctatatgaaaggctacaggaacagaaggacaggaagcagcaggagtacgaggaacagttcaaattcagtaagcttcagaaaacagagagttcaaggggctctgtggggtacttttgacgcacttttgccttgtgcagcacttttcctaactagccgtggaattgtcttgattttcgagtctccggatgcttatttggtggaaaagagacagccttcagccttctagaccacattgaatatttttgtttagagctcaaaacacccattttaattctatggtaatatttagtaatgggaaaaaatgccttgtttttttttatgccctgttatctattcaaacgccatggtatttaccagttcttttttttttaatcccctgaagaatctgctgcttatttaaaaaggggaaaggaaaaatcttatttttccctttagcctgctaagtgtgccttgtttaattatttcctcagaaaacatggtaagaggcttagatgaagatgagaccaacttccttgatgaggtttctcgacagcaggaactaatagaaaagcaacgaagagaagaagaactgaaagaactgaaggaatacagaatatcctttgtacttggaggaaaacctgtaaggtgtccattttctcatcagcatctatggatgttgtctcctcatcaacagaaagagggttttctacctggtgatctctcaagtccctttgaacactgatattcctgtaattctgaaaagctggtagtggtttgtggagtttgtgttgtgtgcaagagtgttatagtcaaaagtccacatccttcttagggttaactcaaggcatcaatcctactagtactgggattagattctgacacaggtgggcagtgcagtcagcttcatccaggggagaaattgggctctgagttttaaaagaacatgtttagcaactttcctatattcttagtaagatgttctctagtggtatagcatgccctgtcctgatagaagggctgagaaagcagcaaagatgactttgctctagatcagtgttgccttttggtcatccacttgaatgtcttcatagacatcccaaatgaaacttggctgaatcaaaattctcaatactgtgccacatcacccccactctcatcacactgcccttccccaaagtctcttctttttctggtcctcccagtcccagtaactggtagtcctatgcctccaggtgcctgggccaagaactgtttccaaaacgtactccaaatctcttgaattgttggtatctactgctactgtagtagtagtagactttcttctcgactcctgtgaccatctaattggtttgtttctgctctcatcctcaataatctattccttagacaagaaagggaactttaaaaaccatacatggcatcatgtcacttttctatttgaaacagtctagtgggttccccttacatttagactaaagtcttactctgtatcaggccgtagaaggttctacattatttaggccaacccgcctccttcttgcatcttgaagccactctttctcatgttgactgtactgcagcctgctggccttctttatgttctctttcaccatgctttctgagtcaatctcagggcctcagacttgctgtttcctcagcccaaaatgttctgccctcagattttgcaagatgcatttcacagctcagccctctgctcagctctcccttttagaaaccttccctaagcaccccacctaaaattgctgtcggtaatatcaatttttttttttgagatggagtttctctcttgttgcccaggctggactgcagtggcgcgatctcgtctcactgcaacctccgcctcccgggttcaagcgattctcctgtctcagcctcccaagtagctggggttacaggtgcatgccaccacgcccagctaattcttgtatttttagtagagacgaggtttcatcatattggtcaggctggtctcgaactcgttacctcaggtgatccgcccactccagcatcccaaagtgcagggattacaggcgtaagccaccgcacccagcaagtaatatcattttttatagatttgtcactatctgaaagttgtctttatttatttgcctactggtttgtttatctctttcctgctagaatgtaaagtaaatgagctccataagaaaaaagactatctgacttggtcacttctgatttctccagtgcctggcatatagtagattctcagtaaatatgtgaataaattaataaatgattcataggagatattaataggaccatttatcttcatgtgaggaagcttatttggatatttcaagcttatatgttgagtaacatcactggtgtaatccaacaggcttcacgtctaagatggacgacattactgtgtatatgtactagttggtattttcttgcagagaatgtgcagcacattccattttaagagttacgtgggaggcctggacacagtggctcacgcctttgattccagcactttgggaggccgaggcaggaggatcgcttgaggtcaggagtttgagaccagcctggccaaaatggtgaaaccctgtctctgctaaaaatacaaaaattagccgggcatggtggcttgtgcctgtagtcccaactactcaggaggctgaggcaggagaatcgcttgaacctggaaggtggagattgcagtgcgccaaggtcacgccactgtactccaggctggggacagagcaagactttatcttaaaaaaaaaaaaaaaaaaaagcgttgtatgggagaagacatggacagattccctgattccctgggaattgatttacatcagaactggtaggaaaagacctggcttccagtcccagttctgttactggcattcaggtgcaacatggagatggaagctcatgggaagttatacctcaatctcaactgtaggattgaggctgattattctgaactcccccttccctgaccctgatgaccccaaaataatatgtgttcgtttgtagagataggcagatacccatattgtgttgtttcagacaccaagctttttcctctaaggaaatacattcattacacttctcacttgaatgatattatgttttattttggtagactagcaaataagacatatagtgtcccccaaagtagcatctggggagaagtgctgttgagtgtgagatgccctttggttttcaattaaaaggaaagaatgaacagggcagcagtgagacaaaagaaacctttgtgtcctggtaacattgcagtacaatgaggctccagggataagggctttaactggaaacttggaaagttctgtctagaaaaactgaagaaaagcaggccttccaagtcactgacatctaatacactaatcccaagcatgcaagtagccagagacatgttgagataggaattgaaggattagacatttgtttattgaagctctaagttaggaactgtttctaggctttgcttgattactatatgatatgttgtataataggatacttctgaatacaaataagctgtggtttaaaccatgtaaataacagaactcttgtttcgtctcaggttaaaccagtatttagcagtattgtgtatgttaaaaaacggtgcaattttaagagaatgctgatctaatgaatttcttgagatttttgaggtgtgtttgtgtttttaaagcattttgggagaagaggggcttaagaaggaaaaattgcttgtactttgcggatcaaaaataagattattaacaccccctacccctaaaaggttaggacttttcttcatttcaaaagaataaaaagttaaatgttgggttttgtctatgtcgtggtataaataatgtataaatatatacatgcttttgttgtgttttttttccatttttgtttttttttaatatttaatattgagagttttgagaacttctgtctcctaatgatggagttgcagataaaaaatcacaacatgctaatttttttttggcattctctcctagaaagatgaaatcttttttttttttttttttttttttttgagacagagtttcgctcttgttacccaggctggagtgcggtggcacgatctcagctcaccacaatctctgcctcccgggttcaagcgattctcctggctcagcctcccgactagctgggattacaggaatgtgccaccacacccagctaattttttgtctttttagtagagacagggtttctccatgctggtcaggctggtcttgaactcccgacctcagttgatctgcccacctcggcctcccaaagtgctaggattacaggcatgagccactgtgcctggccaatctatttttttttaaataaaaatgagtattaacattatctatttccatgatgaccctaaaaacattaaattcattaaactcataatagtactaagcattatatctaatttccattgcatactgcaaatatttaaggtaacttgtgcccataagaacagagttagttgcctggagagtgattagaattagaatcttaggatttctggaaaatcttaggattttctccattgttcaaagacacgtagataaataaccttaaccatacatcctctacttccacccacctttttgggctgataattcatgcttcttagatttcctgggcactagatgtcactattgttccaggcactagtgcatcttaaataaggacttgcactgtgtcagaatacttatctgttgtctaagacgtttcaagagagagcataaaacggagggagaagtggagggagaggagggagggctggtggagggaacaagtgaaagtgacctccccgacaaaaatatggggcctttcttcacttcaaaagagtaaaaagttgagagccagagattggcatcaagaacgaaaaactgatgttacaagcgaactggtcatgcttttaaaaatagcttttcagttcttgtatatatgcacaggatttctcattaaaatcacctttgattgtttcttggccttttggctaagatcaagtgtaaaatcaccttcagagagtgtttaaaacaaactcccgggcctctagaggtctcattcagtaggtttggggcagggagggacttgacatgtttaatgagccttggggtgattctgatgtttccttgcaccagtggagcaggagttagtcttcgtgatgtctaagattaattgccactgatagtcagaacaacattctgcaaaatttgatttaacccttgaagggggaagcatgttttcagggaagccacatttttttttctgttttctttatattccttaagatctgttttcctcatcaagcatgatattggccatgtccttggtaatagtgggttttgtggctatgctcagattttcattgagaatcagaggaaaaggttgcttatctgtattattttgggctttatatgctgtcttcctccatggtctctttcatttatctttgaattggctggatttgactggcagaataaagaagggtggggcatttatttaaataagtaggccagacattacatcgcacagccgaagggctagtgggttatatttgttgtcttcccttttgcttagtttgacccttaactggtaactcacaataacctcaagaaggttggaatttctcaagagaacaagaaggaagtggaaaagaaactgactgtgaagcctatagaaaccaagaacaagttctcccaggcgaagctgttggcaggagctgtgaagcataagaggttagtcagcactcacacaactcagatttctctctgaccgtgtactctgaaacaccacttgtaatggaagccagagccaacgcttgcctcgcgtgagtcctggtgaagttcccttggtgtgctcacctatctctccctttccagatttgaggccttctataggctttgaccctcgtctctctgatcacttattcaacaaatataaataatagctactcttcagtggggatctgccacaccaggcattgtgttaagtgcttcctgtgcataatcccatgtattcttcaacaaccctatgaagtacaattataatccctgttttgtagatgagaagaccaagagtttgagaggttgagacccttctttgtgcaagatcatagagaaacagagagctagagttcattatttgggcttctgtctagaaaaatgaggtagtgagtcttgtgaaaggatctgtgtagggtgtactgagagcaaggaggaggagcatacaatgctgctgggagggtgttgtgtgcatcttcatgttggggaggttgggggaaaccattggaaagatgctgattaggtaggacaactagggctttgacaagcaacaagggagagaacagtctaagcagagggaatagctgctgcaaaggcatcctgtcctgaaagaacatggcagccctggcagggttacagacctggctgtggctaggtttggattgatgtggaagtgatagcactgtctcaaggctatgataagttctttgctatgtttgctcctccctttccaaatcctgaaatgtcatcagagtgattgaatctggtcatttagatttgacccaacagactgtgggcgaaatgataagtttaagtgcagtctattaggaaaatcaatatgatatattggcaaccagccatatgttttgaagggagtgtattgatgcagtcttgtggtttggcacaccacccatctgctgcagatgttcttaggaacactgcctacatgtaaaaatgtcatgctggtatagcaacagaggggaggagttatcctgagaagggctcgctacccaaaccatgaattattcctttcaagttctcacataagctttcctgcaagactagggactcgcaggatttggacctgggtcagttttactggaatatgccaagggagggctctccaggtgatcaatttgttatcccttgagactgctcttggtggtcgcagaatgggtgttgtaactgtttcccttagttcttagatcacctttagaaaaggctctgtagtagcgtatttggtgacctgcatataaccccttttgggttttgaaacaacatcatttaatgtttctttgtgtagtaaggtagtctcctggggcaggagttcctaatctgtccgaccctgagtttattggaatcacctgggagtttgttaataatttatattcgcaggccttgcactaattctggttcagtaagtttgaagtgaagtctgggagtcgtagttttcaaagttccatgagtgattctgctgcctggtgaaggtctggaagccattggcatgtatatgtcatgaagcataagaccaaaacaagcagcaatttcttaccttcttcaaaggaatattctttactctcttctagtttattcttttatttattgttagaaaaaactgtcagatacctagttcatgaatgtgcagtctttttagttatgagcatctgaagctataaattttccttaactttcattgtatatgagttttatatttccttctaagtattttaaaatatccattatgatttcttctttgactcaggaattatttagaaatgtattttttaaatctccatattgaggtaacaaccatatttcagtgaggggaaagataagccttccccctcgccacacacgttttaacaccttatgatgatatatatatatatatataacagtgtcttagaggctgcaaaatatgtttctcttttgtcattgatttccaacttaattgcatgtggttttgtatactctgattctcttttctttttcttttctttttctttttctttttttttttttgagctggagtttcactcttgtcgcccaggctggagtgcaatggcgcaatcttggcacacctgtgcctcccgggttcaagcgattctcatgcctcagcctcccaagtagctgggattacaggcatgcaccaccttgcctggctaattttgtattttttgtagagacagggtttcaccatgttggccaggctggtgtcaaacacctgacctcaggtgatccgtccgtcttggcctcccaacgtgctgggattacaggcgtcagccaccgcacccgggcctcccacataagtcttaaatggaacctgctgtgtactccctgcaagaaaataccaactagtacatacacacagtaatgtccccagtcttagaggtgacttcagtatggtctgttgaacaccacaaactagacattattttttgatacagtatttgtttagatttatatttgtatttgccagtttatttgttcaccaccccttccttctggggtcccttccttctgggatcatttctttcttcattgaaatacattccttatacattgttttagtgaaaatcttgtgggtgactctcagaatctctagcatgtcactaaagatgttttcttcaatctgtaattactaaatgtttgtcatttatgaacatgtctaaatattcttgaaatccatctgtggttctaaccaatttgagtgataaagacggccaagaatctgaagttgaagtgatggttgatacagtgctttatttcctggatttgtcaggagtttaaattgtctttatgactgatgatgcaattggaaggagattaagaatctgaaatgaatacttttcattcatttttatcatcccagcctcttgagactgcctaagacccatataaatagttattggagctcctgattccctaagctttgatccacaagattggacatggctcaagtcaccatgtgttttgttacagctcagagagtggcaacagtgtgaaaagactgaaaccggaccctgagccagatgacaagaatcaaggtgggtggcagccttcattacttccttgtactcagaatacacatgaaccacagtaaagggctgtaatgcattgcttctgcaaatgaatgcatttctgtcttcaagcaagcctacctatgcttaatttacccaacttttttatgccaggcaggattttattaccaggccagagtttataccaggcaggattttatacctgcaaaagttattatattagaaaccagtgaaactgatcaatgaaaatagtactctcccaggagtgcttaccaggccctggtcataccacctctgctcacaaaaggtgtttttctgtttcccccaaatgtcaggtttcttgatttcacctggtttgctaccagtgggaggtaaatacctggctcctgctcattgttgtactggattgagcctagaagcttaatacaatctcaaggagtatacttctttggtttttacttttatgtgatgaaatctgcctctgtattaagaggcaagaacttgtaagtgaaggtgaatgttactggggctggattagggatgagaaattcgagtgtgttttcagttttattctaactccatgtgggattgagactctgaactaaattccatcgatcaacagggcttacattaatttctctcaaaaaaagatgatgctttttaatatgcatctactaagcaccagtggtggtggtctgttgctgttacccttttggtctagaacctacttttaaaaagaagagtctgggggaaaaaaaaaggagcctgccttttacccgtatctcttccatctagttctccttagagggaaacagaattatacttttttttttcttttttttgagatggagtctcactctgtcacccaggctggagtgcagtggctcaatctcagctcactgcaacctccgcctcctgggctcaagtaattctcctgcctcaccctcccgagtatttgggattacaggcgtgcgccaccacacctggctaatttttgtatttttagtagagacaggatttcaccatgttggccaggctggtcttgcactcctgacctcaagtgatctgcctgcctcggcctcccaaagtgctgggattacaggagtgagccaccaagcccagccacatttcttatgtagccatcaagagctattctatgcatgtgcaagcaattgtaaatatgtatcttttaaatgctttattatggataatttaagcaatattcagaagttggaataagtataataaacccccattaccaagcttcactgattttttttttttctttgtaaggtatctcctacaggaaagaccgtcaacaattttttttttttttttttttgagacagggtcttgctctatcacccaagatagagtgtagtggggttatcttggctcattgcagcctctgccttcctggtttaagcaattttcatgcctcaaccacccaggtagctaggactacaggcatgtgccaccacgcccagctaatttttgtatttttagtagagacgggatttcgccatgttggccaggctggtctcgaactcctagcctcaagtgatccacctgcctcggcctcccaaagtgctgggattacaggtgtgagccaccacacccagtcagcagtttttaacacatagccaattttatttcatttatatctctcaactgtaatattttgtgacaattccagacattatatcatttcattcataattcttaatatatgtctctagcaaatacaagttcttattttgtttctttgttttaacaattacagtaccattatattaataatcacaggccaggcgcagtggctcatgcctataatcccaacactttgggaggctgaggcaggcagatcacctgaggttgggagtttgtgaccagcctgaccaacatggagaaaccctgtctctactaaaaatacaaaattagtcgggctgctggctatgcctgtaatcccagctcctcaggaggctgaggcggaagaatcgtttgaacctgggaggcagaggttgcggtgagccgagattgcaccattgctctccagcctgggcaacaagagcgagactctgtctcaaaaataataataataataatcacagtaattaccaaatattatcgaatattaagttagtattttctccaattgtctcaaaaaagttttttctttttaaaaattatgatcttggccgggcgcggtgactcccacctgtaatcccagcactttgggagccgaggcgggtgaatcacgaggtcaggagatcaagaccatcctggctaacacggtgaaaccccgtctctactaaaaatacaaaaaattagctgggtgtgctggcggatgcctgtagtcccagctactcgggaggctgaggcaggagaatggcattgaacccaggaggtggagcttgcagtgagcagagatcacgccactgcactccagcctgggtgacagagggagactccgtctcaaaaaaaaaaaaaaaaaaaattatgatcttagcaaggaccagacattatatttggctactatggcttttttttaaaaaagtattgaggtataattcacataccataaaattcaccctttaaaaggatacgactcagtggtttatattttttaaaaatcagttgaccataaatgtgtgggtttatttctggactctcttcttccactgagctatatatgtctatctgtatgccattagcacacagtcttgatcactatagctttggagtaagttttaaaattgggaagtgtgagtcttccaacttggctcctctttttcaagattgttttggctatttggagtctcgaatttccatatgaattttgggatcagcttgtcagtttttgcagaaaaggcagttacgattttgatacaggaattgttggaatctgtagattaatttggcaatgttgccatcttagcagtaggctaatataccttttaatttgaatttaatctgtaagttcttcctttctaaatttatattttgttttctttgtattttatttgtggagaaactgggtctttgttctttagcatttctctggctctagattttactgattgcatccccatgctgtttcctgctaccttgtgtttcctgtaaaatggtagtttgatctggaaggttgatcaagttggttttttcggcaagaatacattatatactgttttcatactttcattgttagtagtattttaatctaacctactctgttcattgcttaattcagcagttattgtaccttgggaatcattgcataactggacatagagcacttcctcgttcctttttaaggctgtgtagtattgtatattgcatgggtatatcatttatcctactttttaattgatgaacacttagattgtttcattctttccctgttctgatgtttcagtaataatcctgcacatgcataatttttcacatgcacagatctatcaggttaaatactttgaagtagacttgataggtcagagaggatatacatttgtaatttaggtaaatattgccaaattgcccttcaaataagttatcccaatttatactcccatcagcaattttggaatttttcactgacatctttttaataaataggaaatttgcttaaataggataaatgtatactgtatatgtgtatacacacacacacataaagcttcataggaatatttttctttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagggaatatttttcttttaattaatttttttttagagataggatctcactttgttgcttaggctgtagtgcagtgactattcacaggtgcagtcatggcacactacaaccacaaactcccaggctcaggtaatcccccacgtgagcctcctgagtagctggggttaaatgctcttggcataggaatcttaaatgtatttctacaagtaagctagtcgctctttatatggtacttatttcctggtaggaactatacaaatgaatcagtggaaaggaaaacttgtgtggattctttgaactatctcaggcagacagctgtgtttcagagccatctttttgtcattctaaatcccttcttcctactcctgcattcttgcaacagaaaccaggcaggaagtgtcctcctttgctaggaattaaggctccacaagaagaacgctccctgaagcttgcttcagccctgtccttagcagtgggaggatttccgtcttgggcccctatgactctgatagaaattcaggcttcccccagcgaagattttgaacttaagcactgagcagagccagtgaatgcacaagttggccccatctactcccaagtcacgcatctgtctgaatactaagaacattctctattagtaattttctgtgttaatttggtatgacaatgtggtcctgcaaatgcagaagttggcaggaaacttcaccaaatgggtgagatcagagggcaccattttgttctctttggacagttaactgcttttggaatgaaatttgtcagatttgcaatctcttttctttcttgaaacctcctagataattggggtatttggtctcttcacttaaactcttctgataccacagtggtccagattccttgattatatttctgtagctaacttccattcttccgttaggccagttctctacccccacaggcactctgactttcatccttcttttctatgtaaaatagaactttaaattccattcgcccttgaaatatggtcatgtgccacataacgccattttggtcaatgatgggtgcatatatgatggtggtcccataagatcataatatcgtatttttactatgcctttttctatgcttagctatgtttagatacacaaatactgaccattgtattacagctgcctacagtattcatacagtaacatgctgtacaggtttgtagcctaggagcaataggctatataccatgtggcctacatgtgtagtaggctataccatctaggttgtataagtattctatgatgttcacaacaatggaattgtctaatgatgcatttcttaggtcatattcccatcattaagcaggggtgtctgtacttgataaaatgaaatacctcattcaacaatttcacataaattagttttctaggtaactgatctatatatccttttaaggttttttttctttgttggtttgtttttttattttgagacagtctagctctgtcacccaggctggagtggggtggtgcgatcccggctcacagcaaccttcacctcccaggctcaagcgattcttctgcctcagccacccaagtagctgggattacaggggtgtgccaccacgcctggctaatttttgtatttttagtagagacaaggtttccctgtgttggccaggctggtctcgaacccctgacttcaggtggtccacccgccccagtctcccaaagtgttgggattacaggcgtgagccaccacgcctggctggtttgttttttttaaacaaccaaatttttctaacagaatgctgaaaatatcattctatctggtatacataagtactacaatgtatttttaagtcatgaatggtatagtttgatgttatgttccaaatgttaaaagagcatcacatttttataccccttccccccaaattagccatttgcaatgaaactgtaaactgtctgacacattttcctgcattctgatttctgacccttgtgaatgcaagcctgctctgagccaggccctgtgctatatgtcctgggggtggaatggtgataaaagaatgcttgccttcaaggggcttaccgttagtggagaatacacacaagcaacccctctcatcttctacagccttcttagctttaatactgggatgctcttggggttacagagataaatgggactattcctccctagtttaagggctcaggatgttctttgaatttttgtatttgcttttttaaaaaattgtctacccaagcacagctgcattttaaaaaactgtctgaattggtaatatatgcacataataaaacatttaggccaggctaggtggctcatgcctgtaatcccagccctctgggaggctgaggcgggaacatcacttgagcccaggagtttaacctgggcagcatagtgagccttatgttcttaaaaaaaaaaaagaaaaaaaagaaaaggaaaaattcaaaagggacaaaagaatgtggagtaaaaagtaagtctcccccattttccagccactcatttcctttcccctgagcagcctctgctaccagtttttatttattgttctcagacactgacatgcatctacatgggcatggccactttgccccagattgtaactttcacacactgtcctgctccttgcctttttcatttagcacaatatcttggggatcattcaataacagtacacacagagatgctttcttcttcttcttcttcttctttttttttttttttttttggagataggttctcgctctgtcacccagtttggagttctgtggtgcgatcatggctcactgcagcctcagcttcgccagttcaagtggtcctcctacctacctcagcctcctgagtagctgggactacaagtgtgcaccaccacacccggctaattttttaaattttttgtagagacagagtctccctgtgttgttcaggctgttctcaaactcctgggctcaaatgatcctcctgccttggcctcccaaagtgctgggattacaggcatgagccattatgctcagctactttattcttcttcatggttgaatagtagtccattacttaactagtcatctattaatggacattttggttgtcagtactcttttgctactataaacagtgctgcaatgaatgttctcttatgaacatcatttaagttcgaagaactttgccaaatttctctgtactccctgaacagcaaatgaagtttgctgttcctaacatgttccctcctaatatattgtttatcccgttatgtttaaaattcatctgtttctttttctttgagttgttcatgttttccattcacttttctatttggttgttggttgtttttttaacagatttggaagaactcttagtatcttaaggaaatttgcttttatgatagtacaagtatttgctcctgccttttttttgtagccttgctctatctctgtagccactgtcggctttcatttgacttttctccatctccgtgttttaacattgcttatctttggcaacttccttttcccttcttagagcttcttgcacaaacaagcaaatacattgatctcctgaactttgtgtgcgggccgtttgatatctcttctaactgctcagtggtattgtttgcttactcctggtttcctatacttggaactgtgtattcttttcacatttacttgaggtgtctgggtaaatgaggtgttagtgcatctaaggcaaaaccctagaaggtagtatgcttgtcagcctgtggcaacaaagtatgaactccaacccttactctgcagtgagctcaggttatcattttcgtatgttctcttttgattcacgtttagtttcacattttctgccctaagcaacctacaaccttgccaagtcatttgactttcctcatcagtaaaatggggataatgcctatacatcaagttgtagtgattaaataaggccggaaacatttcagggaagaatggaagggctggagtagagttcttaacttttcctttcatcttcaagtcctgcattttcttttcttcctcctccttctttctttctttgttttgtttgtttgtttgtgtgtttgttttttgagacagggtcttgctctgttgcccaggctggagtacagtggtgccatcatagctcactgtaaccttgaactcctgggctcaagcaatcctcacattagcctcacaagtagctgggaccacaggcatgcaccactatacccgactagtttttttgtttttttttgaggcagtgtcttgctctgttgcccaggctggagtgcagtagcgcgatctcaactcactgcaaccactgcctcctcctggattcaagctattctcctccctcagtctccctagtaactgggattacaggcacgcgtcaccacacccagctaattttttgtacttttagtagagatgggatttcactgtgttggccagtgaactcctgacctcaagtgatccacccaccttgggtggtcttgacctcctgacctcaagtgatccacccaacttggcctcccaaagtgtgggattacaggcatgagccacctcacttggcactgtctaatttttcaaaacattttctcgtagagatagggcctcactatgtttcccaggctggtcttaaactcctgacctcaagtggtcctcctatctcagcctcccaaagtgccaggattatacgcataagccaccatgcccagccaagccctgcattgtctagattgaggtctttgtcattgaggtggcagagtaactgtgggtttcctgtaagaaaaagagtcccagctcctagatgacattctgcatggccttaaaatgttacctgacaggcttcagttttctcatttgtaaaagaacacaactggaaagcaaaggttgtgttaaattggtttctgaattgctcctctctcccacttgggaaaagcggcccttcttaataaagaacgttattctggtgagtccttctgagcctattctagtccagggggctacccgattttttaaaatgtttaaaaagaaaagaatgttattttgtagctgatgtttggccttaaaattgtatctgtgctagctggcttattggtcagtaaataagaaatggtgtaatacgctgagaacttaatggaattgttaatattgctcacagtgtctctcttaatctgttttcagattctcacggctgtgtgagcacagggaaatcaaagcactctaggctacactccagagtagcttgttctccaactcggatttgatggggaacaagagagtgtagtcaggctctggggttaaaaagaccttgattcaagtctcagctctgcccctttactttcagaagtcctttcacctcctggagcctcccttcctccttcagtttccccatctctaaaacgagggtgatgatagtattggctgcatagcattgttctaaggctcctctgtgggaaaatcccttggtacagtgcctggcacatggtaagtcagtccccaactttggaaaagggtgatgaagtgacagtctttccccttttattgcagagccctcatcctgcaagtctctcggaaacacctccctgagtggcccctccatccactgcccctctgctgcagtatgtatcggcatcctcccaggcctgggtgcctactctgggagcagcgactccgagtccagctcagacagcgaaggcaccatcaatgccaccggaaagattgtctcctccatcttccgaaccaacaccttcctcgaggccccctagtttctccgtccctacacagggagctcctccccaagggtagatcggaccgttcatgctgcctataggcattatgtccctcaaaaaaaaactcctttgcctgcatcctgtgtacaacatgacatttttaaccaatccaatctaaaaatgtgccagaatccacctgtggcccgaatcgtgtttggttcctctttctactccactgcagatgaccaaacctgtcccgctgccactttcctcactgatattgggaggagggcaaggcccagccgaagttccactaaaaatgccccaggagaataggcaccggctggcttgccaaagggtttgggttttattgctttctgttttttcttttcccgacagcacaaagaagtaagggcagttattggacaggtgttatttaaacattctattgtaaatgaatgtgttgtttggttctactgcattgtggagcatgcgggggaagagaactgacccaggtagtgaaatggagcccttccctggaactaaccagtccttgatgttgtgtgactaagtaaagatgataaaccccatctgctgggggtgtcacttcacactcggcatgcattgtgaaagctttccatacccttggccattccctctctcctctctctccaaccccatttatgcaggaagggactgctaacaagaacgcttccatctcaaaccttttctctgcctgggaaattattttatgtttgtttttgaaataaaggatttagtttaagattctaaattttagagaaacaaacgtaggccttgtttactaatagccagacatcagaactgcaggtaggtatgttaatgagatgacttatttctggcagctcctggaatcctaatattgtaaatgagtgggacacacttgcatattgtgaccattctattgaggcccttctctgtttaatgcatattatacttgtgcttttaactgtggaatctatttctaacctaaaggtgctgccctagtacttttctttgctgcctctgctgctctttttcctttccaaacagcaactctgaggccatgagcagccaaaaactagaggtactgctccacctcgtctcataaagggaaacgggctcatcccttggattctggaggagggagagggagatggtgtggaggcctcgaggacagagatagacatgagctttgacaacaatctgtaggctctcctgctttagaataagcatgtaccattctttatccattccccttattcctacatcaattgtttttactttcttgggtgtgagactgagtgagacacacacaaaatgtgttgacactgtgatgccggcaggcagagcagctactgactttgaacatgggcagagaggcccctggatctcatccagcccactccttttccccttccagtacagtgacactctggtgcccattggcagatggcgacttccctgcacccataactgatgctttgtgaattcttcctccttttcagaactactctgtgctaattgttctgccagtatgggcgcatcagctccatcctgacaaacaagacatttaggtaaaactttgtaggcaccttctgcttctctgcttcattgttcctgtgatagtcctgttgttattacagcatgtacccaaaacagcctcacattgttacaggaggcaggccaggacatcaaagtcatcatctttatgtggcatgactcttaagaggccattactgtatctcatggcctcttgatgtggaaagaagttgacagagggttgcagggtttaaaaacatccattaacatgaaagctaataaacctgtcagagaac

SEQ ID NO: 38240 - DNA, 39675 bp, Homo sapiens
cccaggctcctcgggactcggcgggtcctcctgggagtctcggaggggaccggctgtgcaggtaggcggctggggaggtgggcaaagttggctcctttttccgaggaggggcgaggctcggtggggaccgatctctggagcgccgggagcgccgggttttgtgtgttcagtgggtgtgtgcggtcctccgcggtcagctgcgccgcggtccccgcctgggcagcgggaaaccgggctggggatgtaaacaaggagatcggcgtcggaagagagaggagcctctaggggaggcaggctgtggcgctgggggtgacgctggtggctgggaattgctctcggtgctgccttgagcttggggtcagggttttcaggagaaggggaaagggctgcgcccaccctttatccatgaggagttttccctttgttacttggaagctgtggacacttggtggagcgtggggaattacggacgagggcgtgtggctgggtgtgagtgtggacttatgagcgacacaaaatggaacttgctggtttggtgcttggggaaggtggggctgggcagtgggcacaggatgggggcgcagggaaagaaggattctagcgctcggggattcatgagagtgcatcattttttccctccttcttgtcttatccatccaatcctgtttcctttccggggggccctggggtccgccattgccccctttccccagcagggctggccctggcagagcctcccctattgtgtctcccgggcttccgtggagagttgggtgtgcagcctggagctcccagcgctggcttctggctcttacaagtggtggctggtagaggaggcacccgagggtgggagctgggagcagcctcgctggaaacatgggtctgccgcgtcacctgctgcaagcctgcacgctcgcgggaccgtggctactggaggcttctccccaccagtgtgctctctgccactacttcctttgtctctgtggcttcgtgctgtctggctgggctaagatttccagctttgaagatggatcagtgggcatctcaggccctctctgaaaggagccccctttggggatccagccaccctcatattatggatgtgtatgtctacgtccgcaacttagccttttgcacgtgacttgcctggtcgttgccatggaaactcctccatttctcagcctccctctttctcctgcccattcctcacctccatatctcctcccctccccccagtatggttgcctagatactggttatccctggctaggagacctagatatctggctcctacacccaattgcagtggccccttactcacaccacccacttcacacacactgcacatcaccaacaccacaaacacatacagacatataccacactacgcaatcaacacaccctcacactcacaccacacatacatatacatcatacctatacacacatacacaccaaacacaccgcatatataccgcaccaccacacaccagctacaatgctacactgacaccctacatgcgcactgtgcatgcacacacacacacacagtacatctaaataagtctcaggctgggctgaggcaggggagagagagggcagtttccttccttatccagccacctccctaggggtgtggaggggaagagatggaggctcaggaagcccagaaggaaaaccctaacatctccctgggaaccctgcagaggaaggtggagggaaaggcactgccagattccctcaaaagaggagccccttccctaaacctggaagggaaggttggataaagagtgggcgcagcccttttccctcctcctcaaagccccagtccggagctccaggtgttaacgagagccattcccaggtgctgggctccagaagctgggcactgaccagaatttcaatctctccactgccgctgctcttttccctgacccagagaaagcctgaggctctgggagtcatcctcaccagcagaggatcaggccagctctgggaccatcggaggctctgagccctaacaaaggagagaaggaaaagtggttactgtcccaggaaagccaaggaggccaggccagggaggcaggaaggggagggaaaccagaaagagggaaggagaggggccacaggagtcaagaaagcgaaagttagggctacccgccgttgcctggggttcaggccaccctctcttcctggcacgttttcctgcttcccccctggctcctccaaacagatctgtgcatctaggagaggaagcgggtgtgcaaagggctctaggcttgccagggttctcccaagacgtgtggcttctatggttgacagacggtaggcgcctgggggaagcgtttccttcctggcttccatcggatcttcagactgacctgaggaccgatttcattcaatcattcaaagaactgttttaagtgtctactgtgtattaattgctggggacatgaaggtgaggagggagacacaatccctgacatcggaatcctaggtttctcagagccggaagaggccttgagggagcatccagtgggaacacagtgggggaaactgaggctcagcagtcacgtggccagtagtcgctgaggccttctaactcctcggccaggattttggccttcacactgcctgtcctgcaacccttgctttcttttctcagtcaccatcagagatggtgggttgatggaaacctatggagggagagcctttggtcggctggtgactgggacgcccttccaaagtgagggtcccttagtgggcgggtacaaccgaggagcctgcttcactatgttttcttggaaggcgaggctggaagctgtggcaaggagatgggggagaaagggcagtttcctagaccctggaaatttcccgacagcctcgggggagtccacccaccgaaatctcccctaaataagagcacctcctctcttcctcccaaccttgttggacttagtcggccgccatctggatggcagactgtgccaggcagccccccaatattcaccttcgaacaaatcaccttctgagcaccctaagggaagcaaaccagtcaagaaaggcacagccccaaggaggcagggagcctgctgtggaaaggccgggttctagccccagctctccccctgagcttccgtgctaccgaaaggcaaatgcgttcattgcacaaatatccctttggatgcaaactgggcttctggtgaaatccagaaatggcttggactgctcttcagcaactgaaagcctttcggattttagacctttgtttccgcatctgtcaatagtggggtttagactcatgatttccaaggcatgtcttcctctaaatttgtgtggattatacaatcttgaaagagatcccttttctctccaggtaccaaatagtactcattatttcataatacagggctgcagctgagctgagctgagcaggaaggggctgggctctggttaccctggagaaagtttccttttcacccagtgtggcagaaggtgccctagaagctgaaaccaagtttttttctttagggctgagggagccacctcctcctggatgctgtggtctacctggccttttctaccaggctgcacactggaggcgggcggcggttggggggggttctttaaagagttgttctctggaagagacaactggagaggactgggctgtcattttggaggtccatgaaatcttctgcagggagaacccctggccagctggagagttgcaacgagaggggccggtcgggaacacagtgctctgacaccgtccctgatgagaggcaggacatctccggccgaaacaaaagcatggaaccaatttggcagcatcatctctgctccagaatccggggagggagaggtcccgacctgggaagggatgaagccagcttgtaggctgcgcaggaacatgtttgttacaaagatgtgggagggagcacacagcctgggaaaggggctgggcccccacggaccaggctggggccatgggaatggggctgccccagctcagaatatctgatgtgggcagagagggccaaggatgaaggggtgtagttagaataacagtgacccccacgcagctggaggacaaagccaggcccacactgagagaccagaggctaaggtttcaaactccctcgttcatccttttaataaatgttcccctcatatgtcaggcaggccctgtgggcttctgaggtttctcctttgctggagccctcctgctcaggtagatcaatgggcttgtcctgttccttcctctcccctactgtccacctcatgtccacatcctaccaggaggccctgcgactttcttcctccataggaagagcccctccatgcaatcacgggtgcacttacactctcacacacgttcccttcctcacacatatataatctcccacacccgacagggaggcagtggctcacacattctcacacgccctgtcacctctcccgaagagctgcagtctctcagaccatggtgatggcctgtgaacgtccaccctctcagcccattccattttacccactgatgttacagctcaggtccaggtttgccactcctctgctcaaaaacctccccaggctcaccagtgcctattaataagcacaggtacatggtgtaggcactccaggctcagcgtgacctggctgcagccacctctgcaggcaccttctccagatggtcatccgaagcctggtactgtctcaccctctgcctgagctcaagccgttgctggaatgtgccgagtagagggtggcagtctttgtagacacacaaacttggattctaaactgcattctgatgcttcctggatttcttcactttgctaaacctcagtttccttacctgtcaaatgagtgtgaggacagtatgaggcgagctgtgtaaagggctcagcatgctgcctagcatggagtaaacactcaggagatatcagctgctgtaataatgatagtaatgacacattattaggattattagaatggcattattattgttatatcatccttcgtggctcctcccaagtgtttattctttcaagtaattattccatattcccaataaacaggcattaaaattcccaataaacatactcatataccgtgaatgtcctgtcagttcttccttgagagcacacacctgcattttagctgcagagggacacgccccgcctcccaccccgcccgctccactgcaccgcctctcaatggcaggtctgttctccccacggtgcctggcacagtgtcagacacgtggagaaagcccagtgaacagcgtgtgtgctgtgacacgcatggggaagagtcctcatcaccaggaggtgtagacacctagtcgcccttcccggctgtctcccatacgccggtgcacaccacgcgttcccaagatgcacatccctttattaccgtgcgtcacctcagtctcccacttgctttggtagagtctagaaactaagaatttgaccccatctgaggtctgagagatgcttaaaagctgaagtcaaaggagagaggctgattcctcacagcattttggtagttgggatttgacagagacacagagattagaaatgaggcaatggaggaaggaggataccgagaaagttttaaatgcctgaaaaattccctacagatcctttggttgttctgagcttagaatggatttgatgtaaagggataatgatgctgaagcgtcctttcattcacacatcaacatttattgagcagctgctgtgctcagtgccagggatccagagatggccagagtgtgcctgtgctcccagggagctatggtgtgatgggggcatacactggtgacagccctacatgggaaggggtgtaggccttggctctgtgggtatgaggatgcattgaggggagggaggggataatgtgtttcctgaaacagagacagagtcaggtcaacagccccctcctctaaaggcagggcacatttctgggtatccaggcccgtgggtcagggttcatcttcatgccacttctacccctaaaagggagacaatatgaaattgtgcaaagtgccctgtaggctgaaacatgcaggccagagctgtccttctaaagaggtaggcagagagagcaaagggggctgcctggtgctgtggcctggctgtgggcagggtggcgtgggcctggcttctgggttcctggccctggcagctgctctgggtttctgtgtctgctgctgggactgctgtctgtcctgtcttgaatgggcctttgtcagcaggtgtgtgggggaggtgatcccatcctggcctgactccatcacgccctgctggggcgtgcagcctgctggggccccagcctgtggcttctgtgcaataccactcaccattcagactctctggagccagaccgagatctcctggggaaccagaggggcctcagcccctgtgctggcaggcaggaggcctgaatcccactctgactccctctgggcaaggcgcggcattggcctgtgcctgagttggcctcgcagtactgttctgtgtttctgcttctgagggctgttgtgagaagtccatgggtgatggctgggatgccacagtgtcacggttgtcagtgatggtgaggtgacagcaagacctgggaagggggctggggccccacggaccaggctggggcccagagaatggggctgccccagttcagaatatctgatgtgggcagagagggccaaggatgaggggatgtgattggaatgacagtgacccgcatgcagctggaggacaaagccaggccggcacgcactgaaagaccagaggctaagatctctccaccatgcctccgcttatggtccagcttgggatctttccagggagacttccagaaaacaggcctggatttgtgatttgtgaattctgtttctgtttctaaggaagaggccttatttcttttcacagtcagttattttctgtctctctctcttcttcttcttcttcttctttttcctctgtccaagtttctcttccctagaaagaacttcatgttttcatgttaaagataaaggtgcctccaggttaaaaataagtcccctgctatatgacaagagagttttgcctctcccgctccaccctgtgcagccgggctgggttgggtctgggccggttgagtccagggtacctgacgactcagcctccagcaccctcgcagtgggagtgcccctcttccatgaatgagggttggaggggcagcattcgagccgttgggctactgaaggcgcctgacaggagagggaaaggccaccctgggaggtgtcagccacagtgatgcgctgggcggaggtgccctgtcctgctcctagactgtccagctgccttcctggcagcttgggaaattcagcagtgtctgcagcctccttgagccatggactgctggaatttcaccaccctctgctctgtcctttcccttgccagtctctgagtccagtctcctcctcgactcctctctggaacattgctggctgggcggggcgggcaatcatttcaagttaggtgatttaacaataattgatgcttaattgtttatttgatgggcatttaaaatgcaaattgagggaactggttgcattttccactgatggatctgtggcctctggtcgacccaaagcacttgttttaaaaggcagctttaaaagcccttgatggttgtttgtttgctctgaggctctgaaccagagaagcccagctcctgttacagattcatcaaatgccggaaaggtgagcaggagccggagtgctgggatggggttgaggattgcttttaactgaatttttgaatttttattatttttctacgaatagactatctttttagaacagttagatttacagaaaacttgggcagattgtatgagttccaattttctcccctggcatgcagtttctgctattattacgatcttacattagggtggtacatttgttacaattaatgaacaaatattggtacaataatattgactaacattgacactttattaaaatgtcgttcgtttgtaccttatgtcctttttctgttctaggatcccatccaggataccacactccattgagtcgtgcctcttttggtgcctctgggtggtgaccttttctcaggcttcccaggactttgacagttctgagggtcactggtcaggtgtattgtaggatgtggccctgttgggatttgttcgatgttctcctcatgattagactggagtgatgggttttagggaggaagatcacagagggaaagtgccattttcatcacatcacaccaagacgatacaatcaggatgattcattgctgttgacgttgatgggactgggttttccatccctttcatgccccccacgcagcacagtttcaaggcctggtgattggagctgtgttctctccgctcctcgagacaaacataccaaaccatcagccagcactttcggccgtcctcaccatcccaggtgaggacagatcatggggtagcacagagacttttccgataggagaatcttaatgaagcgagcatgaaacagaatgtgctatgcgccaaattagtgccaacgacaggcgacaggcgctcttggagtctggagaaaggggtctacgtggagtggcagctggacaaagatagcatttattaaccttggctgcacatcagaatgagtgggggagattctcaaaattaccgataccttggctacactgcccttggctacactgcccgggtttagagctgaatgtggctgagttgatttccaggcatcttttttcttttctttctttctttcttttttttttctgaagctcttcatgtgatcctaaggtacaaccagggttgagaactggaataaacaaagaagggaagggcattgtaagtagaaggaacagaatatacaaaggcacgcagttagagacacatgtggcagaagatggaacgtagaccatcttagctgaaagtaatgagaagatactggaggggtagaagagaggtacacttagagattttcatatgccagaaagaagtttggattttaaaaaactaaataggacgtagaggcaccaccgaatgcctttgagtttgggagggaggtattcagaatacactttagaaaggttagtcctgcagtaatcagtgtccagcacagaggggaaggaggaggttaaagatgggtccagctactgcactattaggtaagttacccagaggagtgacggaaaggaagttccaattagagagatactgcaagtgcgagcatggctaggactttgccacagatgcagtgtggagatggggaaggagagaggaagccccggaaacttggtgaggccgtaacctccgtcaggcagggaggcagggattgtgtctgtcttgctcactgcagtgtcctcagtgatgagtgaagtgctggaaagcattaggccatcaataaatatttgttaacttggttactggaaggataagggtgccattgtttccaaaattacaccttgttccaaaagtacgctctttctcccccaatttctccacctaaatgcaggcaaatttctctgctgtggaaagcaatctgattaaataactcaggccaagatataaatgactgttaggattgggagtatttctcttgtagtgatgccgtgacatttaaacgtctctccttgggaagaattgttgtggaggcagatacatttttgagtaggggtggcctttatttcgattctacaccctcatctaattctgagccataccagaaaaaaaggtgatctgcagctctgcagcccacggtgaaaggctgccggctagtagttctgttggcacccaccctgagctgagctccagtggacaggatagcctacaactggtctgggactccatccagtactcagcataaatgcactggtattctgctaggcaaagtgcagcggggcactcagcagctgtgagatggacagaggctgagagggacacaggagtgcctgtgctgatgccaaagctcagctgggactgatggggcatcgctgggaacagctgggatctgacaatgggtaacagacatgccacaacctctcctattaacaggccccagggtcccagctttaccccaacctcagtcatagtcagcagaacagagttgggcaagaaaatgtgaaaggcggaaaaaggggataatgcatgccaaagtctgaaaagctgtattttgggttattcttccttggcctgggtaagaacaccctcatcaggtgagcccagcttggtcaggagttagggtcaacatgttttttcccgtcacctatacccatttcccccccagtttttttttagtatggtaaaatacacataccataaaatgtactatgatttttaagtgtacatttcagcagcgaggtaagtatatccatattgttgtggaacgatcaccaccatccatctcaagaactcccatcgtcttgtgaaactgaaactccatacccattaaacactcactccccatttccccccttcccggtgcccctggcaaccaccattctcctttttgtctctgattttgactactctacgtgcctcatatgagtggaatcatacagtacttgtccttctgtgactggcttatttcacttggcctcacgtcctcaaggttcatccatgttgtagctggaacaagtaaggacatggaaagatgctcagcctcaccacaggcactcttttttgttttttttgagatggaatcttgttctgtcgcccaggctggagtgcaatggcacgatctcactgcaacctccaccacccgggttcaagcaattctcctgcctcagcctcccgggtagctggaactacaggcgcgcaccaccacgcccggctaatttttttgtattttagtagagatggagtttcgccgtgttggccagactggtctcgaactcttgacctcaggtgatccacccgctttggtctcccaaagtgctgggattacaggcatgacccaccgtgcctggccaggatgctcaacctcaccacagtcactcttatgttcctcctcagcctctgtccatctcacagctgctgggcacaagattcatgcatgtgttggaatttccttcctttttaaggttgaataatattcctttatgtgtatataccacattttgcttatccattaatccactgatgaacacctgggttgcttctgtgttttagctattgtgaataatgctgctatgaacatgggtttacaaatatctcctcaaggttctatttccaattcttttgggtatatatccagaggtggaattgctggatcatatgggaattctatttttaatattttaaggaaccactgtactgttttccatggcagctgtgcattttacattcctagcaacagtgcacagtggttccaatttctccacatcctcaccaacacttgttattttctttcttttttttatagcagctatcctaaaggatatgaggtggtacgcattgtagttttgatttgcattttcctaattattattgaggttgagcatctttccatgtgcttattggccatttgtatatcttctttggagaaatgttagttcaagttatttgctcatttttgaattgaattgtttgctttttttgttgttgagttttaggaggtctctagcagatgtatgatttgaaaatatttccttccactctgtggtatttttgatctgttgattgtgtcttttgatgcacatttttacatttttataaagtccaatttttcggccagacgcggtgacccatgtctgtaatcccagcactttgggaggccgaggcctgcggatcacgaggtcaggagttcgagaccagcctgacccacatggagaaaccctgtctctactaaaaatacaaaaatgagctgggtgtggtagcaggtgcctgtaatcccagctactcgggaagcagaggcaggagaattgcttgaaccccggaggtggaggttgcagtcagccgagattgagccgttgcactccagcctgggcaacagggtgagactccgtctcaaaaaaaaaacgtgcaatttgtctatttttttcttttgttgcctgtgcctttgttgtcctattcaagaaaccattgccatatccaacgtcataaagcttttgctgtgtttttttctaagagttttaagttttaggttttacgtgtagctcatggatccagttaggttaaattttgtgtgtggtgttaagtaagggtctacctttattcttttgcatgtgtacatctggttttcctggcacttacttgttgaaaagactgtcttttccccattgaatggtcttggcacccaagtcaaaaatcttttgaccacatatgtgagggttatttctggactttatcctactctattggtgtatatatgtctgttcttatgtcacacactgttttgatactgtagccttgtagtagaatttgaaatcaggaagcttgagtccttcagctttgttctttttcaggatttttttggctacccagggtcccttgagattccatatgaattttagcatagatttttttatttctacaaaaacatgtcattgggattttgatagggattgcattaaatctatagatcattttggatagtattaatatcttaaaaatattaggtctttcaatctacaaacatggactattttttccgtttatttacatcttctttaatttctttgagaaatgtttctattgcatgagtttctcatcttcttggttaatttctaaatattttattctttttgatattatgatatggagttgttttttagtttcctcttcagattttttattgttaatgtatagaaatgcaattgttttttgtgtgttgaccttgtgtcctgctacattgcagaatttattagttcttacagtttttatgtgtgatctttagggttttctatgtataagatgataccatctgtgaacagagatcattttacttcttcctttccaatttggatgccttttacttatttgtttattttgcatagttgctctggctaggacttccaatactgtgttaaacagaaatggtgaaagtggatatccttgccttgttcctgatgttagaggaaaagcgttaagtctttgaccattgagtgtgatgtttgctgtgggttttttttttttttaaacttatggcttgtattatgttgaggtagtttccttctattcctaatttgttgaatgttttcctcatgggaggatgttgatgtcaaatgctttttctgcatcaattgagatgatcgtgtggttttttttccctccgttttgctaatgtggtatattatattgcttgattttcatatgttgaaacatttttgcattccaggaataaattggggcctccaattttatttcccttagttcctgcccatttccacatgtgccagggaggcagcaagaaagagtggaaggtgcatggcaccagcagaattagtgacagttccaggtatgcttttgttagctgttgggccttgggcaatagcataagcctgagcctctccttttctaatctgtaaaatagcagtaataaccaacatcccatggagttgtgatgtttctttgagctaatgcttgtaatgttatctggtgaataaggtgtcttataaatgactggtgtataacatcatcacatcatcatcatcatcatcatcatcatcccctttgaccaatgtgggcagggaacaggaatatgcaacatgtaagacacagcagctcccctttctcttttgacagtcacagatacactgaagggcccaggcctgagggacaagagttcctatcttgatacatcttgccgtgacctcctcaacccaaggaggagggaggaacagggccatcttaggaacagcaccttggttttgcagaagtccatttggccctgcctgtgtgtctcagggcccaacccttctagagagataccctgaaggggccctttgtgggaggcagtggcttctccttgaatgaccttggtgaaggaagaagattgggcatggtgaccagaggaggtggctgaggaccttgtgggctgggcctcggtctgggatagccgcagctcctggtctctttccagcagagacactgtgtcttctgggcagcggccctgtagccagggaagggcgtgagttgttttctcccaggaacagcagctgtctgttgacttttccttctcataccctgccctggtgcattttcctgtctctgcttttaggtgcatctgtgtgagtggggcacgcagggcatggtggaggcacctagggcatggtggaggcacccagggcagccgaggcctcagaaggaggaggatgacgtgagggcttgcttgatgcttcctctaaagccaattctcttctctcagcagcctccacctctcctggcttcaccacctgtgtccctccttcccattttccagctcagtttctgcggggacttggcccctgggccagcctctcccgtctcgaagcctctttctttctctttcctttgcctgcctctcccacttcctctggggcatcgccttttcagtttctcctcctccgggttttctctcctctcctgctgcctcatgtcctctgtctgtcttgcttctgtgtctctcgtgggggtgccctcagtttgggcctgggaagatgtgtcccttgctttagctgtcccagccagatgtgtcctccctgggccacatatctgcagctctggatgacataggatgtttgtcttgaggcaggaaaaggcagtggccgggagccagtgtcagctgtgggccgaggcccctccacatcctgtgacctcacgaggaccctccacgtcctgtgaccacacgaggaccctggagccttccagtggttggaggacaatgttaaaaggaagggaagggggaggaagtaactgggccctctccctagcccctatctctgtttatctttccattttcctggaaaaggtagaaatgaaggaggaagccaaggacagagttgggcagtgatacagtaatgatactaacaggtgatgcttcaccagcagttactattcgccaggctgcactcagctccgtccacaggccgtctcttttcattgcaaatgacagcaacagaactccatctaatttagttgaagcaggggtatcagtttacagagccagactcgggaagggtggggccctctggtgtgggaacacaggagcctgaggcacagctaggaagctctctgggcccctcctccctgcctctctcccctgccagctctgtacctgtcagctattggccgacttctcccccaacagactcctcctcctttcatccggcaggatgctgaggtctttcctaccatgtcttttagctacagggaaggagctgagattggcaggctcccatagaccagcagggttcgagtggggacagagcaggctcccttccaaaaggggatgtcattcacagaagaggggactgatgtgggcacaaagaccacctcatctgaccctcactgatcccgagatgcatgctgttaggcccatcttgcagttgcagaagccaagactctgagaagccaagtaacgctcccgaggccacagagccactgagtggcagagaggagggagagctgagtgctcagagcaaggaccctggagccaggttgcttgggattgaatctaggctctgctactttctagctctggaatttggggcagcttacttaatctttctcacctcagtctgcccgtctgtgtaaagggaatgatcgtaataatagttgcttcttaggactattgtaagggtagaatgagttatataactatttagaacaacacttggtatggcatgagcaccttacgaatgttacatgttgttatcagggtgttttacagtttacaaagaaccttcacacctattatctcacttgaccttgatcatagccttggaaagtggacaagggaacggactggcagattctgcactgattctgcgctgcccgcaccccatgctctcaccctcggcctaatcagcttcagggttccgtagcctgtttttaaaaatcccccacccgagtaaacagctctctgttcaacaagtgagtatcaatgctttctcaggggtgagctggcaggattgtacattctgctgtctctctagcgcacgaatatgtatgaagctagagatgctggaagcttggtaaatgttcatccagatgcgggagcccctgcattgtggctctctgcgcagagctctctcaggtacctgtatctcgctgcctcagcctgctggactgggatgggaatgagaaaacagggtggcagctacctagaaaaggtgggcccttcaaagagccacagtgcaggtggcccctcatggctctttgcccccaaatggatgtgatccctccctgtgaggtggggcccaagggctggagtttggggctggctctgggatcgaaggaaacctactcatagcaggaagactccctgccctccaccaacagccaggcagacagagcagggctgaagtccagaatcctgcacttattctccagggcacctctctttccctacctcagtttctttccctgtaaaatgcttttgacgataacaaaaggccttcggcagacatggagcccaactcctcactctctcacacaggggagcaagcaggtgatgagaataggcctctcccatgaccccagctgtgcggtaaggtgagcttggtgcaggtggctattgctgtagcgtggatctgagtagcgtacgaccagactaaggatgaaaacagggaagctccggactaaaaattatcacagacagactggtcagatgtactgggagagaggtgggatctttatattcctaagaccttagcaagtcttactgtttggaaggaaaatagggggaggacagtttgatttatttgtgctaagcaagagcttttggagacaagggactggctctgaaggctttttaaggcctccttagttcttggatttcatgaaagggccacaggtgcacattatcagtgttagcatcgggttatgtttaaggattaagtgagaataagcatttaaagcactaagaatagtgcctggcctgtatcatttgtcgtgattataattattacctcttgtatccaatacagacccccagactgggcctcaagtgtgggttttcatctcagaatttttaattcctcttagtttcttctgtggcatccatagaagggctcctatgatgcaggctgacctctgtgtccagccttctggttcaaggccgctgtctgggaagtgtgcagtgtgagtcaggggtgtgctttgtaaaggcacaaagatctccaaccccggacctccctcctcaggggattcacatttgcccgccagtggctccacagtgtcctgccgaactgggtgtggctggacctgcggtcgggacacactggcttggggcgggggtcttgcacagtgtctaggaggcaggagatgtatctcatagccacataagcaaatggactttcgagcagcctcccagaaggggttgaaaatgacacagaatcggccgggagtggtggctcacatctgtaatcccagcactttgggaggctgagttgggcagatcaccggaggtcaggagttggagaccaccctggccaatatggcgaaaccccgtctctactaaaaatacaaaacttagctgggtgtggtggttcgcacctgtagtcccagctactcgggaggctgaggcaggagaatcgcttgagcctgggaggaggaggttgcagtgagccaagatcgcaccactgcacactccagcctggtgacagagcgagactgtctaaaaaagaaaagaaagaaggaaggaaggaaggaaggaaggaaggaaggaaggaaggaaggaaggaaggaagggaaggaaggagagagagagagaaagaaagaaagaaagaaagaaagaaagaaagaaagaaagaaagaaagaaagaaagaaagaaagaaagaaaaaagaaaatgaagcagaatcgactctccgttttacaaaaacagaggatgaacctgggccatgactctgggtccctgtggcttgggaactttgacaggagagtgtttagggcacaaagttgggggtgtgaggctgagtgtggtccttacccctgtttccaagctggtggttacatgggacccaaggtgagaggagaaagcagccctgacatggagagggagtgaggggtgccgggctcagccaggagggaccctgggaaagcccccctggagctctgctcgacatacgtcccccaagtggatgacgactgtccttttgtccttcattttccttttaatcctgcaagagaacttcagccaaagcatctgagacgggaagcagaaaaaggagggacagtttggagaagaaaaacgcagctgtgtgtgagtggggaggtactttggttggatgccaagggcaccaggatgctccagcatggatgggaagcagggggacgctggagtggggctggggtggggtgccaaggaagatcgaggagaagaacatccagcctctccagtactgaggcctctctgggattctttatcttttgtctgaaagcattatgaggcttaattcccataaaaataaaacacattccaaagccaaggccagggtttgggcattctctgctggtttatactgaccactcccccaggtcccgttcatgagcatggagaatagagaactgatggtaaggctgatattgtgcaggcatggccctttcatggaaacagagggctaaggaggccttaaaaagccttcggggccagtcctttgtctccaagaggtcttgcttagcacgaatagatcagaccactctccccctattttcctcccagacagtaagacttgctaaggtcttaggaatataaatattccacctgggccgggtgtggtggctcatgcctgtaattccagcactttgggaagttgaggtgggcggctcacgaggtcaagagatcgagaccatcttggccaacatggtgaaactccgtctctactaaaaatacaaaaattagctgggcatggtggcgcgtgcctgtaatcccagctactcaggaggctgagacaggagaatcgcttgaacccggcagcagaggttgcagtgagccaagattgcgccactgcactccagcctgggctacagagcgagactccttctcaaaaaaaaaaaaaaaaatccacttctttcccaatacatctgaccagtttgtctgtgacttccctgttttcattcttagtctaaccttacacaacacagatccatgctgcagcaatagccacctgcactaaactcaccacatcacctggggatcatgggaaagacctgttctcatcacgtatttactcccctgtgtgagagagtgagcatttgggccccatgcctccagaagacccattctagacatgattccatccctcaccttccctgaagccagcactgtcacctcccatctccaatccaaggaggctatcagtggcagtggcttccctcctgccctctcatgtccctggccaccccattcctgcagggcctcgccctcttccctggctccagccaggctaccccccttccctttggcattggggtgggctcagccttccttccctctgttcctcctggccactgctctgccagccctgttctgcccacctcccaatcccagcacatcaaaacagcagtcaagagtgggaaatgcatgttctgagccctgccctgcccctaaataactggatgaatcaggtacctcatctctctttgggccccaattttcacaaataaaaagcaggagcccaatcactgtaaccaactgtgatgaattctgtgatgctaactccatctggtagacctcacatcttggttatactcaatatatacacagtcgaatctttttttaatagacttcttggttgcaaagatctagatacgtcataggctaaatcatatccctttgcatataataatagtctagggtaaccatttagactaaactgtggggcccaggcattctgcggcctcataaaaggccccattccgggacgttctgtatgaagtgagacctcatctttcttagcagggcatcctgctaagacccaggcccggtgacccctcagagcttgtcatccgtgggctgagcctgcaggaaggcaagcaggtgggatgccaggggaggcgagtgaagcttcgggagcagggggagggagggatgaggatgagataatgaagtttcactgtaatttggagcctctgcattttcaagggaggttgtttctgagttattttcacaatggaactgggtattctgatctacctcactgctgcgtggaatcaaaaataatagagcatgttgctatatcatcaactagtggcttctctttctgagcagtttttacccagcaattaagtgaaattatgtgactcagtatgggaagataattgccggagaaactcttctgattgctttctcccgcacatgcagccagcaaccaagcaggaggatcagagaggaaaattaacatggaagtgctgcttccacccagaacctcagctgcttgccaatatggagataaacaagagcacagaaaggagaggaaaaatgagcggaaacagaattcgttctcataatacaccctagaggaggcagcaacgtgtgattggttccattctccagatggggagagtggtccaaatggtctagaggggaagagttggggagcaagagagtgaagcagccagggagtcccccactccagcagtgatgatttctcaggccccctgtgctggcgagccaggtcctcaggcccccaggcaaaggtccagggcccagtgcgcaggtggcggtgcatgccctgttcctgtgccctctccgctcacttcagccttggatctccttcccccagtgactcctccttcctgtcttccatctactccttagaatctctcgcccggaactgagatttttcaccacccagcctcttaccctccccaccccagccagcctccagcagcccagcttcctctctggaaggagggagaaaggaatgtgtggtcactgggagggtgggaggtgcagaggggtggtatatgagatggaagggaagccaagctgggtgcagcagtgagacaaaggcattctgtggcccttcaaaagttctgtgtatgtacttggccactcgactcaggggcagtgccaacgtaccaccgatgagatttttaaaaatgggtttaggcccccctcctccccgctcccgccaccccgaggggcccatgctgaggtgtggttgatgtagcccaggctgggacagcagcttgcaggagtagagaatgggtcacttttcaaatttgtgacagtatttcttttcacactgtcacttgatcagaaatgttttctttagaatacaaaggcaggtcttaactctttagcttggcactcaagagcctctgcaatctgattccaaccatcttatctgagttctcaccacccaccccatcatgctttagtccaactgggttgttcactgttttggaagatatcttacactagaaatggcagctatttggtaggttgctgtcacagccccctcctaggctaagcagacattactggtggatgaaggccgtctcctgttggacctcatttggggaagccactttggacagttactactgcatgaaatgcgttaaggctcatcttgaactgatcttgaacttgagctgaatcccatttgttgttcctactctctgtttcccctctcactgcttttgctcatgctgtcttctctaccggaatgcctttcctctgctctttccttccccctgtctatcaaaatcctaccctgctcttaaggttccgctggaatgtcagctcctccacggaaacttccctagctccctgttgagctctctgctccccttctctctgtctttctggactattgttgcatggcgtctgtacctgttgggaagttctcgtcatatttgctgatggatcagagccctttgccaccaaatcctacttctccttggtagctaaggctgtatcttgttcacctacttatcctttgcagaacccagaatagtatggccctttctaggagttcagtgttggcttgtgtaatggatttgaacctgagcatcaatggaggtgattgttggggtttgaagggaaggcacagcagcaacctgaactgctgcccattgtccctggtggcccagagccattgacatgtgctttccctattcccagggggcaggaagagccctattgccaacactgcactccctcttccggctagagctggtcaagaggccactgtgggaagcctggtccatttgtccttccctctctcacctcacatccaatattcacaccatggcccctaagatttgaaggccttaatgtgttgtttcatctaccttccacatcttgactccagtctccctcctcactggctaagcaaggagcaggtgtaatttggagatgggacttgggctaggaagcagcagtaaactggagaaagaaagagaaggagagagggagggagggaggtgttttacagatagcagatgctcaaaacttaccttatttcatactttgattgaagatattttaggactgtatgactgcctgaatcataaggggactttccactttaaaataattaatcccaggtttactattacacagcttggtttaaagaaggaatgaaaatcatccaatcttaagtcaccgttactctccccacaccaaacactaccaaaaagacaaaacaaaacaaaaaccccatgagataactgggccaggcatggtggctcatgcctgaaatcccaacacttaaggaggccgagccagaaggatcacttgaggtcaggatttcgagacccagcctggccaacatggtgaaaccctgtctctactaaaaatacaaaaattagctgggcatggtggtgcatgcttgtagttccagctactagggaggctgaggcaggaggatcactcaggaggcagaggttgcaatgagccgagattgtgccactatactccagcctgagtgacacagtgagactctatctcaaacaaaacaaaacaaaacaaaaactagcactggagtatgtgaagcttagccagaacttaagccatagttactcttagaatgcaccctcattgacattactgcattctgtaggctaatcagcattgagtccagcaaggttgggaagccaaacctgagactacctgcatgaagccaagaacccttgagaggggctaaagtgatctcaggttggtatctgctgcccccagcctccatgaaaaagcaaagcaaatgctctctgaaagaaagtgtcccattttaggactaccaatttcccacagattaaaatctagcaaatatgagctcacaatcgaatatattaccaaacacaggaaaaaacaagtcactgtgattgaaaggcacagaaacaaaaagtagattttgacccccaaggatttaagagtttggaattatcagatacagaatataaaataactgtaagaaatgttgaaagaataagagatgagaacacaaaatgagtgaacaacaaagactaacacaaatgcccaggcaatttcaaaaagaaccagatagaacctttagaaattaataatatgaccattgaaacacaaaagtaaatgagtgggttaagcagcaaataaaaacagttaaaaaggaagtcagaaaatggaaaacaaatatgaaataattacctggaatgtagcatagagaaggaagtggaaaatatgaaagagcagttaagcgatatggagaatagaatgaggatgtctaacctgcttctagtcacagtctcagaaagagaaagtggggagaatggaggagaggccatatttgaagagataagaatttttcataacgatgaaaaggatgaacctataggtaaaggactttcaagtctgatgaaactcacgacaatcagttctatgttgtgtttcagacttgtgatgaaacccacaacagcaaacacaaaaagaagaaaataaaaggaggcagagaagaaagataggacatctataaaggaatgatgatataagcagcagacttctcaacagcaatcatggaagccagatagcagtggaataacatcttaaaagtgcagagcaaaaataattatcagcctagaattgtgtacatagccaaactacctttcaaggttaggattgtattagttttctattgctgcataacaaacgatcacagacccagcagcttaaagcaacacatgtttattatgtaatggtttctttaggtcagaggtctggcacagcttagctgaattttctgcttcagcatcataccgaactacagtctaggtgctggctaaggttgtggtctgataagagaattgactggggaaagatctgcctccagactccctcaggttgctggcagtattcatctccttgtggtagaagaactgaggttcccatcttcttgctggcttctggccaggggcagctgtcagctgctagaggcttcccacaattccttatcctgtgcttctctccgtagcctgtctcatgacatagcagcttgctttttcaagccagcaagggagaaaattctcgagctccagcctgcaagattgagtcttatatgatataacaccatcatctgagagctgtccttttgccacttttgccacattctgttggttaaaagtgtgttgcagctcctgccagtattcaaaggaaagagattactcaaagcattgaacactagaaggctggaatgactggggatcgccgtagggtctcttgccataaaggtgaaatgaaaacatttccaaataaacagaaacagagtttctaacgaacagatcttcattaaagaaaattttgaaagatgttctttaggaataaagaaaatggcatgaaggatgactaacgttcaaaaacaatggtgaacaaatcagtacatatgttgtaaattcattatctattgctgcatagcaaattacttccaaactcagcagcctaaaacagcaaacgtttgatatttcacacagtttctgagggtatggaatcagggagaatcttcagtgggtggttctggctcaaggtctttcatgaagccggaagatctgtttccaagctcacttatgtggttcatggcaggctgtatttcttagcaggcttttggagtgaggccaccacatgggcctctccacaggggtgcctgaatatccttaagacatggcagctagcttgactcagaacaagcaatccgagagggagggagagagagagagagcacacaagaggctgtgttgctttttataacctcatatcgaaagtgacataccattacttctgccatattttcctggtcatacagaccaaccctggtgcagtgtgggaggggactgtacaaggatctgaatactaggagatactgggagctgtcttgcaggctggctactacacacatgggtgaatccaaacaaacatagttttcatgaagtacgaatattagtatctattttatagaattttaaaaagaactgaaatattctccaataatagcatatgtatcaggaaggggatgatttgtatttttgtattttcaaggagggtattctgcctaataactattataagtattaactctgaatttttttggtcttttttacattgaatacacatggaaaaattacaaagatgaccactaaaagattaaaatagtttctataatttctaaaccagtagagggagaaaaggaataagaaaaaaaaaaatcactaagctaggggcagtggctcatgcctataatcccagcactttgggaggccaaggcaggcagatcacctgagcccaggagttcgagaccagcctacgtaacatagtgagaccgccccccaaaaaaataaaaataaaaataactaatccagaaaaaagaaagggcaaggaaagaaaaagaaacaagcacattcccatagggaaaaaacagatggcagaaagcagaccaactacatcaatagtcacaataagtaaattaaatggggtaaatttgacaattaatacagaaagcctgacaatacagaatttttcaaaaatccatctctttgctgtttataagatgcacacacaacacataaggacacagaaaggtagagagtaacatagaatttaagacagggaggatcactacataattctaaaagacccaactcagaggacagtaacagttttaaactatctgttagaatattctaagagacatgttatcggccagcttcaggtctgttctgcccacactcagtaaatctcagtaaatcaatcactgtgacacagattttgcaaaagagaaaagatttattcagaagaccaccaagcaaggaggccggagaacggctctcaaatccgcctccccaaagataaggcttagggatatttactgttaagggaagtggggtggtctgaggcatagggaaaggtgattggcagtggggagaaatgaaatggcagattcattctgagcaagcgtagtcagggtttgtggcattccacaggacatatgtacaggaaatggtggcattagtgtgacctgagggtggagtttttagccctctgatgtcaaaggctacccttcggagcacttgcacatgcccagttgaagggtgggtggtctcatcctgtttgaactggacaggagctagcccaaattcctgaaaaacaactgaagtaaccattaccagggtgacctatgaatgttatctgtaaagtaaccagtgaaggttaagtttcagcatgcagtggcgaggccttcagctaccgaggccttcagctaccacggccttcagcttcatggaaaaaggaaaaaaaataaaatataataacaaaaagcaagcgaccaaaagcaagcagtgcaggcagacctgatcagattaacccctctgtttcaaatatggggatacatttataaatccttccacttagtggtagattttaaagtgctgatcttgatttttggtaggataaacagtcaaaaaaaaaaaaagaaatttaaacacagttgataatgttaatttataggcatatagaactttcttcccaaccatgaaggaattcacaattttccaagcacatatgaaatataattcttttaataactgaccatgtactaggtcataaagcaagtctcaacacgtttcaaggcatctgtacatcatacagaccatgttttgtgaccttggtgcacttaagttagaagtcaataacaaaagcaaataaaaatcactatatatttggatatttaaaacacacacttcttaatgcataggtaaagcaagaaattgtaaggaggtttaaagtatactgagaactaaacaacaatccaactatgatggagtactttcacccccttacagaagctttgaagtgtggttattgattattgtttagttcttagtattatactttaaaagcacttagagggaacattgcagtcttaaatgcttatattggaaaataagaaaagctaaatattaatgaactaggtatccaacataacaagataaacataaaaaagaacaatagaagaaacccagagattgtttaagggcagaattaagaaaattttaaaacatacaataaaaaggattaatgaaaccaagagttggtttcttcaaaaaaactataagcatcgttaaacctctggtgaaactgaccaagaagaaagggagttgtcacaagtaacattaggaatgaaaaaaacaggcataactttatggcaaaacatttgaaagcagaaaagggaaaattcctttaaaaattataactcactaaatttattaaagaagaaatagatatctggagagtgccataaccattaattaattgaatgggccatttaagatcttcccacaaagaaagtcccaagcccggatgattttacaggttagttccaccaaacactcaaagaacagataattcgaatcttctgcaaactcttccagggagctagcaggagagtggacacttgttctgtgaggccagtactgccatccccaaaccaggcaaggttaatacaataaaataaaaactgcagaccaatctcactcatgcacatagatgcaaaaatcctaaacaaaatgtcagtaagccaaatccatctgtttattaaaaaaaaaaaaaaaattggtttcatttcagaaatgcagggatgatttaacacttgataatccatacatacaatttacttcattggtagatttaaggacaaaaaccatagaaatagaacactcgttcataattaacataaaacagaaacagcttggaaaccaggattagaggggaactttcaaagcattagaaaaactctatttaaaatcagtagtaagactgtgtgtgagtgtgcacgtgttgtgtgcgtgtgtgtttgctattgtttttattctgcatttcactggaattcctacccagtacactaggacaagaaatataaataaccacaatgagataccatctcacaccagttagaatggcgatcattaaaaagtcaggaaacaacaggtgctggagaggatatggagaaataggaacattttacactgttggtgggactgtaaactagttcaacctttgtggaagtcagtgtggcaattcctcaggaatctagaactagaaataccatttgacccagccatcccattactgggtatatacccaaagtattagaagtcatgctgctacaaagacacatgcacacgtatgtttattgccgcactattcacaatagcaaagtcttggaaccaacccaaatatccaacaatgatagactggattaagaaaatgtggcacatatatgccatggaatactatgcagccataaaaaatgacgagtccatgtcctttgtagggacatggatgaagctggaaaccatcattctcagaaaactatcataaggacaaaaaaaccaaacaccgcatgttctcactcataggtgggaattgaacaatgagaacacatggacacaggaaggggaacatcacacaccggggcctgttgtggggtggggggagggggagggatagcattaggagatatacctaatgttaaatgacgagttaatgggtgcagcacaccaacatggcacatgtatacatatgtaacaaacctgcacgttgtgcacatgtaccctaaaacttaaagaataataaaataaaataaaaactataattttctaaaaaaaaatagaaataaacagcgtgagaattagaaagaaggaacaatatcatttgaagatgatatatctacagagaaaacccaaaggcatttctaggtaagttattacaaataattcgggagtttaacaagattattggatttaagatcaatatgtaaagatcagttgcttttctctctaccagcaaaaattagaaaacacatacaaggtgacattgaaagcagcaataaaaatgataaggcacttaggaatgaatctaacagaacatgtgcaacacctgtatgaaagcatttatggaactttattgaaaaggacctaaacaaatcaaaagatgtatttatagacaggggactcaagatcagaaatatgtcatttctccccaggttgttctatagataggtccattgcagttcccatgaaaatcctaacagttttagatgaatttgaaaagctaattctgaaatttgagagcagaaaaccaagaataatgaagacattcctgaagaaagaggaggagagggaagaggagaaaaaaagatgggagcttctcttaccatgtggcaagattactatgaagctatcataattgaaacacagtaattttaatgcagtacagacaaattgaccaagagacccaaagagatagcccagaaactgatgcacaccaaatagaaatcagatatgtgacaaaggtggcatagcccatcatgaggaaaaggggaggcagtctgcccctggaaccaggttacagtacaagttatcattacgggaaaaagtaaaactagactcctacctcacaccatacacaaacatcagtttcagatgtcaaatagatttaaatgtaaaagacaaaaccttggggtttttagatgaaaactctgacctcagggtgacaaaggatgtcttaagacacaaaaatcacagcattcaagtatgttaggattaagaaattctgttcaacagaagacaatttttaaaagtgaaaaaataagccacaaactggaaggagatatttgctatacttaatgacaaaggtttagtattcagaataagaaattaacaacaataataatgtcaactcacttggaaaacgggcaaacggcatgaaaaacatatcactgatgaagaaacaggaatgacaaataaacacagagaaaaaagtccagctctattacagtgtaatcacattaaagccatcttttacctctagattggcaaaaatgaaaatatctgacaacagaaaatatccacaacaggttgtagagtaatggggacagtgatatgcagctggtgggatattatcatggagatgaccactgtggaaacaattttaaatcattgtgtgaagtggacagtttgcatactatacaacccaatgaatgacttcagtcctaggctcatgtctagaacataactgttcaaactgccgagtgtgacccattaaggagcctggaaatgttttttgtaaagaaacagaataaaatagaaaagaaactatctcattcatagtaagtattattttgtgataattgcttctggttacatgaatctgtgttatgctgggttgcaatgtaaaatgtatttcttatgggagtggtgatcaaagaatcaaaaaactgtttcctcaaaattcttgcatgtgtgccctgagcagtatgcacaaaaatgtccacaactctatttgtaatagcataaaattgagggggaaaaagaaacagacatccattggcaggagactagagcactacatgatcatttacctgcacaatggaatattacaccacactgaaaatgaatgcactatagctaaatgtagtaagtcagtgaaccacagaagcataatgtcggacagaaaaagcaagtttcaaaagactataaacatgatatcataattataaagttcaaaaaagctacactaagcaacataatatttagatatatgtacgtgttaaatatatttttaagacaaagagcaaggtgaatatccatacagtggaatattattcagccataaagagaaataaaatatgcatacatgctacaaggtagatgaaccctgaaaacattatgctaacttgaaagccagacacagaagtccatgtattttattatttcatttatgtgaaatgtccagagtgggcaaacccattgagacaaaaagtagatgaatggtttcagggttgaagggaaggggagtcgggggtgactgccgatggatacaagtttcttcttgggaggatgaaatgtcttggaacccgagattggtgacgaatgcataagtttgtaaatgttctaaaaatcactgaattgtacagtttaagatggcaaacttcctgatgtgtgaattgtatattttaaattgtggaaagaacacttactatgagatctaccctcttaacatatcttgaagtgtgcaattcaatattgttaattatgctgtacagtgttatacagcagatctctagcacttactcattttgcataactgaaattttatatctgttgattggcagctttttagaagaagagcaagggaatgattaaaaatatgtattttcagccaggcgcggtggctcacgcctgtaattccagcgctctgggaggccgaggtgggtggatcacctgaggtcagaagtttgagcctgaccaacatggtgaaaccctgtctctactaaaaatacaaaaaattagctgggtgtggtggtgcatgcctgtaatccaaactccttgggaggcagaagcaggagaatcgtttgaacccgggaggtggaagttgcagtgagccgagatcgcaccattgcattctagcctgggcgacacagggagactcagtctcaaaataaataaataaataaataaaaataaaaatatatatttttgggatactggccacctctgggagagaggcagggggatggggtggagggaaatagaggtcactgcagcagtctttgtaaagctccatttcctaagctgctggtttatgggtgtttctattattactatgcctcattatatgtgtatgttacatatatttttatacatataagatacagtgtagcattcaaaggaaatacaagtgtgaaatgagacagcattgaaagcaaattaccaccttttgataaaggctttttgaatcaaggtttgggccttgacgtggctgtggatgcagtcgttctgacccctggtggccgagaggtgaagtgcagtggcggctgcttgctcaaggccggaggaaggtagtgaccgtgctgggggcaatcagggtcttggactggacggatgtccaggggttcaggccactgccagtttcaccccacatggaaaacagcacccagccttgggctttcctggttcaggaaaagcctctctgtctcctctctggctcttaaccatgctcctttaagcccaggagtgagatgtgtgtcctgccattgaaatctatccctgggtgccacctcttggccctgcctcctgcttccaccaggatagcccacctggggccatccacccagagaccaggactgatgagctcctgagcagagacctccgcatcctctggggaagcagaggctggggtgctgaggctcgtggaaccagccttcaaactccttttgtagaatcaaaccacctttctggaggattctgaaccaaagcctgtgggaagagctgacttggggacttttgaggtgggacgtaaagggtacctgaaggagggctgtcagcgcttcagggcccaggaaaccacaagtctcctctccacccagctggctagactagagggacactggtttactggccccatttagtctgatattaagagacatttctgatggggtattggctgtcagaatgaactagggatggccacagaagggtggcctggagagaaggacacagttgagatcttcaaagtcacgtcccagaggcaacgtggtggaggagttaccatgctgggttaggatctaggccctgctactcactctggtgcatgtcagcctcattaagcttcaggttctcggcctgcgttagttgtagtgcttgctaattgtactaactcaattgtgccaattgaattaatacatgcagagcattctctaagagtccaagaaatgtcaactggtggtggctcacgcctataatcccagccctttgggaggctgaggcagatggaccacttgaggtcaagagttcgagaccagcctggccaacatgatgaaaccctgtctctactaaaaatacaaaaaattagccgggcatgatggcacacgcctctaatgccagctactcaggaggctgaggcagaagaatcacttgaacctgggaggcggaggttgcagtgagccgagatcatgccactacgctctagcctgggcaagatagcgagactctgtctcaaaaaaaaaaaaagtcaactgcttgtgcttaggttgtttgaaccctcaccaagtcatgagtgcagagcaaagctggggatttggcttggcccctggtcaggctgacgcttggagctgacggatggaggcttcttagccagagaatcattttttcctccctctgtccccagacgccatggagttggtgctggtcttcctctgcagcctgctggcccccatggtcctggccagtggtaagtacccctctgggacctggctgtgacaagatgacaaccctgtccagccctctctgctggaaggttctgggccccttgggacattagggctgggggactctcacgttcttcatgtctagtcaggggcctctcccttcagtcagcagagaaagtcgtggaggtggcagctatttattcacagacctcagcacagcctgccccctcgccccctaagggtccggcagggagtagtttttaagccccgcaagctcactgcgcctctgtggatttgtggcctgaaccctgggattcagacctgcacatcagtctctagaccatattagcaagtgctggcctcgtgcaagtcatatgtccttccttggtctcggtttctccgtgtgtcacaagaggaaaactgaccctgccttctggggatgatgtaagaatacaaaggggcaatgaatgtgggtgttgcatgactcagagcctcactgagtttcgatgccttcactgacctcggcccttagggttcccctaaccccctaactggcaggcccgccctaccgtgcacctctaggcatctctgtttaatgggccctgctcctctggaattcctttgtggagactgaggtctgtgaggcaaggttagatatttgggaaccagtttgtgtagctttctttctcttgaccaactgtttgtttttgcagcagctgaaaaggagaaggaaatggacccttttcattatggtgagcgatggcaaccctgggtgcaggggtcagggggaatgcagccctgcctggcaggaggggtagggggaacagacaccctctccctggccccttcctctctcacccttggttcctttggcagattaccagaccctgaggattgggggactggtgttcgctgtggtcctcttctcggttgggatcctccttatcctaagtaagtttgttcttttgctcactctgttaagagcaatgactgaggctgctaagcaggtggggacagtgtgagagcctggttggtccctctcctggagaggaaaggaggctgcctgccctccgtgttatcttcacgacccagtagagtgctgggcacatagtaagtgctcagtaaaacagtgacacgggaacaaagaaaatgtcatatgacaatgagcatagataggaacgagcagggtggcttcccagtgctgtgtctatagggcatgaatggggcagtcacggaggaaggagacaggtgctgccctagtgtgcgagggatgtgcctccgagtttgttgttcccacatgagcctgatctgcacagatccctctttactcacatgatcaagagggctgtgggggtgtagccattccagctatagaatgtatttcctttgccccagaagaagctaccccatccgagggccactgtgtgcagctgtgcaaactgtgcactgcccaggtctagggggtgccatttacatagtcccacaacctgcacagacccttggccctgctgtggccaagccagcagcatgaccttggatggtttctttgcttttcaggtcgcaggtgcaagtgcagtttcaatcagaagccccggtaaggatgccgtggcagtggccttgggggggtgatactaggtgggacaggaagggacccctggtgtgtgacccccaaatgggcattctcttggattcttgtctcggaggcagaacgtgtgtgttgggacgtagggctggaagtttgaggactgccaggtagactctggggcaaaggagaggtcaaaacattgaaggtcagcccatcctgtctcttctgatctatgtgggggacggggagtggacaagaaagtactggaaccttttctggaggcccttgggacagttgagcttgggagaagggaagcagagggcttcctggcctctctagatgcccaggtcctctctacaggacctgcgacacagtccccacttgtcacctgttcatgaggctctttgagctgaatagacacttggaccttctttctactcccacatagaggtcataccccattagtttactataatagccaagggtagcttggaccccagaagtccaaagcgtgtggcaggacacacccaagcccccatgtggccctagcctccccttcccatgagggctgacattgaagggtgcctgtaagttccctctgagtctgacccttcagtccagacctttccctctgtcccatgcatcccacagcagagtgagctccagcccctcagggcactgggaggagcctgactgcaggcagctgtgccccagtgaggagcagaacgatgctctctgggtctgccctggagatctctgatggggctgtgtgtctctttctcctgcagggccccaggagatgaggaagcccaggtggagaacctcatcaccgccaatggtaactgtccgtgaccacctgcccaggtggaaaagagggaacagagagacccctctgtggctcaggaagggactgttgccaggtgcatggccagccagacatgctcccgcagtgccaggagagtgggtctccagggcctctgcagcattgccccctcactccaccaaacaggctactactagtgtcacctgctatttacagagcatctgcttgtgccaggcacagaccccatatcatttaatgggcacacagccctgaaataggcatcattgtccccattttgtaaccgagggactgagagaggttaccaggttcctgtaagcagcaagtagcagggccaggattgaacccagatcgttctgactcgaaatcccatgcccgtcacctctttgctcccccagagtcaggcagagacacggctgctgttgggggtggcccacgggggtgaggagtctatacactataatccattctggttttctttccagcaacagagccccagaaagcagagaactgaagtgcagccatcaggtggaaggtgagatgctcagtgcctggattggcccctgttgccatcaccgtctgcatcagggcctggacaggggttcaggcgggaaggatggggctagcttttgcagtgggcacagcttttattatgggccctgccctgaggagccttcaggagtctgaaaggggctgtgagagagaccaggactagaaacacccgaagtgtcccacacacatgcatgccaacaccaggaaatggggcttccacacagcccactggccgagtgcatagggcgtcatcccaagtgcaacatgggagaattagagttagtgaaatgctcctaatctcaaagtagcataaagataatggctttccgtggtgactcagaaagtactttagggccacttgtttttttaaacaccttattatgaaacttcccaaccctaaccaaaagtagagcaaatagtatatgatccttccctctccacatttaagggcactgattttagtatctatttccattgttcatcgtagggggcacaggagagtagtaactggcaaatgctgtacagttttcagagtgccaccacacacacagactcactcgagtctgccagaaaaagaggatgggacaggtggggtttagcccattttataggtgaaaccaagatgagagggaatagccccgtggagagtgacagcccggactgtgaactcaggcctttgcggctgtggttcagcgccactgctcccctctgtcctgtgcgtctcgctttatgacatgccctggaatatcctaagggaaaaggtttgtgttttgtcagctcacttctgcctttttttccccccatacaagtaaggcattatagaaaggtatataagtttatctcacattgtaaggtaaaagaggtttctggatgatgaagtgcccgatgcaccagctttgactgtgcgtaacaatatcgtgtgcctgtgtagcatttaaattctttcctaagtgcttttgcatcctcatagcggcccgtgatgggcagagcagggctcattactcccgtcttctggatggggctctcgaaggcaagtgatcacctaagtgcgaatggacgaagattccgatctaggaggcaggtgcccttcctggtagcttggtgttctgtctatttcatcacagactgagaatctgggaaggctcagaggaggcagcctggaaatgaaatgtcttttcattttttttttcccaaactagttctttctcagaaaccttttatcctaaggctcaggactgtgagcaaccactggggaggtcctgggtttaacaatttcctttccatgtctgccaggctccagcccacctgggagaggcttcttctgaggttcacccctcccctgtgtctttgtctcctttctctgcgtctcagacgaggctgtcataccgggaatttcagtgggcaggtgctcaaggaagggagagaagcagataaggataccagaggcagccgaagtgtttttaatttaaattatcctcctcctcagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaaccttccctgcttctgagacttcaatctacagcccagctcatccagatgcagactacagtccctgcaattgggtctctggcaggcaatagttgaaggactcctgttccgttggggccagcacaccgggatggatggagggagagcagaggcctttgcttctctgcctacgtccccttagatgggcagcagaggcaactcccgcatcctttgctctgcctgtcagtggtcagagcggtgagcgaggtgggttggagactcagcaggctccgtgcagcccttgggaacagtgagaggttgaaggtcataacgagagtgggaactcaacccagatcccgcccctcctgtcctctgtgttcccgcggaaaccaaccaaaccgtgcgctgtgacccattgctgttctctgtatcgtgatctatcctcaacaacaacagaaaaaaggaataaaatatcctttgtttcctagtg

SEQ ID NO: 38241 - DNA, 17850 bp, Homo sapiens
ggctgccggtctgagtgcagagctgctgtcatggcggccgctctgtggggcttctttcccgtcctgctgctgctgctgctatcgggggatgtccagagctcggaggtgcccggggctgctgctgagggatcgggagggagtggggtcggcataggagatcgcttcaagattgaggggcgtgcagttgttccaggggtgaagcctcaggactggatctcggcggcccgagtgctggtagacggagaagagcacgtcggtttccttaagtgagcatcctgagggcagcgggaaaaaggctgggatggaggccggacagggaccccaccaggagagttaagtgtcaggacgggacaacgtcgctgtctcagactgaaggggagggtgccgctaacggtctatgccgggagaccttgggaggcagtcggatgctttccctttcctggtcctgtacctctggaatgagcatggcaggcgctcaccccctgccatggtcagagcatggagtcagttatttccaaccttattttggccccatgtggggacgatcattcctgggccctggggacaggtggacccttattagtctcttgttggattcttttatatctcatctggtttccctagaacctagtcgttttttgcattcacttcagtcttttggtagcttgttattatgtagaaagatgcgacacaagtgggaattctcaaaacccaaagggcttctagtgacgacatagactgggaggctaatgttactgcttctaaaattaataggctctgaaatccctaatcaaagcactttttttttctttttttttttgcttgggggtgggatcgttgttcttttttacagttgaattcatcgagagatttgctatatcacacttgtcatttatgtgagactagggttcctctacattgctttcttgcttctgtcctttcatgctattagtggaagtgggttttctgtctatattaaaagacaggatgaatttgttagcactagttttgcagcagcctgcttttgaaatgtctaggcacgcgtatgttgttttaaatctttccacccttacttggaggtgaaactgtaaactgaaagcaaataattaggaagtatttcctttggtgggttcgtacaccagcaaatggtatctgaaaatcagacaacttaaatgtagacatttaaatccaaatctgatttacatatttgttcagatcatctaagtgcccttgagtggttattcaacctcagattaataaatagtgacaaatttacaaccagtattttactgctgtctgtcattaagaatctggcattagggcattcgttagagtttaccctaattaatgatgttttaatgataaagttctcattaagctttaggaataagccttaattgaccatttggccactcttctgtatacagttcttttaaaaagcatttaatttctgtttaaaaatagtatattagaaacaaagtaggaaaacaacccttaatgtttcattgtatctttctttttatttttttgagacaaggtctttttctgttactcagcctggagtgcagtggcgagatcatagttcatggcagcttcgaacttctgtactcaagtgatcctcctgtctcagcctcctcagtagataggactacaggcggacaccatcatgtccagctaattttttaattttttgtagagacagggtcttgctatgttgcccagtgtggtctcaaactcctggcctcaagtgatatttctgcctcagcctgtcacatttttgggattataggcgtgagccacggtgcctaccatttttccagcttcttttggaatcatatgacttaggtttttactagtaaaatacaacatgtagtagtttgtatcctgcctttttcacttaatatttttgaacagcttttgataccatttcatgttctttatttgtatgtagaaaggttgatggagaatttccaggcgcggtggctcatacctgtaatcttactttgggaggctgaggtggaaggatcgcttgagcccaggagtttcagaccagctggggcaacatagtgggaccccatttctacaaaaaataaataattagccaggagtggtggtgtgcacctgtagtccaagctactcaggaggctgaggtgggaggatcacttgagccgaggcggttgaggctgtagtgagctgtgatcatgccattgcgttccagcctgggctacagagcaaaaccccgtctctcaggaaaaaaagaaacattgatggagaattaatatgaggagtttatggtgataatcttattggaaaaggggtaggtaatttgtattgtagctgttttgcataactagcacacagttttgacttacatttgtgcttattggaggtggcttaggacttagttaatggagataaagggaattgggcctgaagactcctcatgccatttcttgctatcatcacaatgtatataagccataatttatttaaccagtcctctgtttttggacaggtggttttcatgtgtttttgtttgtttgtttgtttacatagtaatattatattctatacttttttgcactttttattatagaaattttcaaacatttatagaatggcattctactgttttgtttcatgtcttttgtgtacctcattaatttttttctgaaatatttttaaatggttctaagcataataggattttacttgtaaaagcattattatgtatctccaaaaaataaggacttaaacaaaaaccacattaccattattgattcaacaaaataatcatgccttaatatcatctaacagtcccatttttatgtttcctcagttttctcaaaaatattttttatataattgttctttcaaatcaggatccaataaggcctacattttgtagagtacatttttaaggatgaattttaaattttgtattgcaaactttatgttatttttctcaagtaaaatatttaccttaggatgataaatatatttgctttttctttaattatttctgatattatttgtgttccactgtcatcagtttgtttttttctggatctgaaaaaatgttttgaaattggttgagtcagggctgggtacggtggctcatacctgtaatcctagcactttgggaggccgaggcaggcggatcaccagaggtcaggagttcgagaccagcctggccaacatggaaaaaccccatctctactaaaaatacaaaaaaaaaaaaaaaaaatcagccaggcatactggcggtagtctgtaatcccagctactagggaggctgaggcgggagaatcacttaaacccaggaggcggaggttgcagtgagcagagatcacctcactgcactccatcctgggtgacagagtgagactctgtctcaaaaaaaaaaaaaaaagaaagaaagaaattggttcagtcagggtcccattaagaagtagaagatgcactcaaattagagtaattcaaggataatttaatgaaggcatcaaacagtgtagtcatggtgttgggaaacagccagattgtgcagtaccctggagcttacatcctcaaggttattatcaccacctctaatcctgaaggaagaggagagtagaggttactggaaccttgaagggaagaaaggcctgcattgaaagacacaaaccagtcccttaacacagccagtcagaggtggcctgtcagtgagaggtctggggggaaaatagactaagctcattttctttccttcctccagtctgcaaagaggagaaaggtagagagtggatctagagggcaaatggaacatgtccaggccaggcataagttaacttttttacatttcaattctggcttagtgtgctctggagtgacactttttcatcttacttttttttttttttttgagacggagtctcgatctgtcacccaggctggagtgcaatggcacaatctcggctcattgcaacttccgcctcccaggttcaagtgattctcctgccccagcctcctgagtagctgggactacacgcgcatgccaccacacccagctaatttttgtatttttagtagagacagggtttcaccgtattagtcaggatggtctcgtcatcttgctttttagtaactgttgtggatatcatcagtatcagttattcctttaactatgaaagagcctatgaggatttaagaagcattattttaatatattattatgatatcgggaattctctgatacagttggtcattttagaaccatttgttttcctgaaacataaactttttttcccccctcagaatagtagtttctcatttttcaaacaaattaattttgatctgtgaaatgaaattatcagctcttgataggatggttttctaagtctaggaagtttagaagaaatcagtaaggaaaagatggatgtttttaactacataaacattttaagcttctagtaaccaaagtaaatgggaattatttatagcaaatagaacaaatggtacttaaataccttttattatttgttaaaaagaacagaaaaccggccaggcgcagtggctcacgcctgtaatcccagcactttgggaggccgaggcgggcggatcacgaggtcaggagattgagaccattctggctaacacggtgaaaccccgtctctactaaaaatacaaaaaattaaccgggcgtgatggagggcgcctgtagtcccagctactcgggagactgaggaaggagaatggcgtgaacgcaggaggcggagcttgcagtgagccgagatagggccactgcactccagcctgggcaacagagtgagactccgtctcaaaaaaaaaaaagaagaagaacagaaaaccaaaaattgcaagttaaaactagaacaaaatgcctttttttttttttgttggagatggagtttttgctctggttgcccaggctggacagctcactgcaacctctgcctcccgggttaaagcaattctcctatctcagtctcccgagtagctgggattacaggcatgcgccaccacgcctggctaattttgtatttttagtagagatggggtttctccatgttggtcaggctggtctctaactcccaacctcaggtgatctgtctgcctcggcctcccaaagtgctgggattacaggcggcagccaccacgcctggcctgccatttttaacagtaagaagttgttgggggtgactggcaaaattggaaccctaatattttaataataatgtatattcaatgaagacatggctttagaatgggaattgtgtttctgtcacctgtcatctctacccatagaaggaaaataattactttctatgtcaggcttctctgctaccctggagtggtcttgggtattttcagaacctattcagtgtaattatagacactgaaggccggcacagtggctcatgcctgtaatcccagcactttgggaggctgagacgggtggattacccgaggtcaggagttcgagaccagcctggccaacatggtgaaaccccgtctctactaaaaatacaaaaattagctgggcatgatggggcacgcctgtaatcccagctactcgggaggctgaggcaggagaatcgctcgaacccaggaggcggaagttgcagcgagctgagatcgtgccattgcactccaccctgagcgtcgcagcgagactccgtctcaaaagaaaaaagaaaagaaactgaagcataggacaactttcgccaaggttttgtttgtttgtttgcccgttgcttttaatgtcatttttcgggagagttgatttgggaattagcaagtaagaaaagactaagctgttgatcagtagtagctaaacatgattttcatttttccaggacagatgggagttttgtggttcatgatataccttctggatcttatgtagtggaagttgtatctccagcttacagatttgatcccgttcgagtggatatcacttcgaaaggaaaaatgaggtgagggcacctgatttaatttttgccaaaagctaggctactgaataccttagtatatattccttttagaattaatagtttagatggaaaattctttttatttaaactacagctattccttaaaacacttaaaatatcctcgtttatttaatctgaacattgaaaaaattgtaaagttgagcttcttgctctggcttaaaatttattttaaagctcctaatatgattacataaagaaaaggtaagattacttactataggagctaaagtgctatgaaagttataattgaaatatgattattaagttggaaataatttaacttttctaaattagaaatactattcatcacctgtttttcactgggatattttgataatacctcttattacctatttgatacttcattgatctggaaatttctgtggtcctttctttatggaatcttttatgttcaatggaaatatagtatttctagggaaaacaattgaggtgaaaagaactatagtctaatttagactgtgagtgtggaatagcaaaacctatttgaagttgaaacatttgtatagtatctatagtcttcagagtcagcttcccattataatagaacacatttatttatttattttgttgtctcatggcaatagcatcctctttggtcaaatctgaccaggaaatatatgaagcaactcctaagtggtaatgtctcttctttaagctatcaaatatgactatgttgcagtaataaagcacaggtcatgcaaaggcaaaaacaatttctggaggtggaggactaataaataattttactactgatctttttggtgtctgcgcagcatatttagactgacttgtagagactcaaaattgagctgacacatgttcagttagtaccatactatttacatttgagttagtgtttactcctaaaatttgtaatttgtttcttctttctttgctttctttgacattgaaagttttaaaaatgtaatatgtaaatatgccataattcaaatagaatgagtcacacatggagttgtcccatcctttatcttagctgcgtgttagtccattggtggatttgacatcatttatataaccggctcctattgatagacaagcagtgatttctttctcttcttttagcatgtatactaaacagagacagttatcaagagaatattctttttttttttgagacaaagtcttgctctgttgcccaagctagagtgcagtggcgcaatcttggctcattgcatcctctgcctcccaggttcaagggattctcgtacctcagcctcccaagtagttgggattacagctgcacgccaccatgcctgtctgattttttgtttgtttgtttgagatggagtctcgctctgtcacccaggctagaatgcagtggtgtgatttcggctcactgcaacctctgcctcctgggttcaagcaattcttctgcctcagcctcctaagtagctgggactacaggcacctaccaccaacgcccggctaatttttgtatttttagtagagacgggatttcaccatattggccaggctggtctcgaactcctgaccttgtgatctgcccgcctcccaaagtcctgggattacaggtgtgagccacggcacctggcttgatttttttatttttttgtagagatggggtttcgccatgttggccaggctggtctcaaactcctgacctcaagtgatctgcccactttggcctcccaaagtgctgggattacagatgtgagccactgcacctgtccaagagaatattcttgatattatcaggaaagtaatactctaatgccactaatatattcttaaaaacaaattacttttcccccctactttgtagagagacaaaatcttgctatgttgcctaggctggagtgtagtggtttttctcaggtgcaatcatagcccgctacagcctcaaattgacctttagtgatcttcccacctcagcctcctaagtagctgggattataggcatgactgtaccactgcactccagcctgggcaacaaagcaagatcctgtctcaaaaaaaaaaaaaaaaaaaatatatatatatatatatgtgtgtgtgtgtgtgtgtgtgtgtatacatatatgtgtatatgtaaagttcttttatattaaatctgtgccttaaaggacttattcatgactttttgtatattttagaattgtaagcttggaaatggaggggtacgtggatcacagtatatgttatatatactgctttaaacattttttttatattgaaaacacaatattggacggaatgagagctgctacacaaaagggaatacttgtatttttttttaatcctttttactctggttaaattttgaataaaatagtcttagcaaataggaatattgttttaaatatagacggtccccagcttacaatggttcaacttataattttttttttttttttaatttgagacagtctcgctctgtcaccaggctggagtgcagtggcgtgatctcggctcactgcaacctccgcctcccgggttcaagcgattcccctgcctcagcctcctgagtagctgggactacaggcatgcgccaccactcccaactaattttgcatttttaatagaggcagggtctcaccatgttggccaggatggtttcgatctcttgacatcatgatcctcctgcctcggcctcccaaagtactgggattacaggtgtgagccactgtgcccagccctcaacttagaattttttgactttaccatggtgcgaaagcgatacacagtagaaaccatactttaagtacccataacaaccattcttttttttatgcttagtacagaatttagtaagttacatgaattaaataagtttcttattataaagtgggctttgtattaggtgattttgccactgttggctaatgtaagtattctgagcacttttaaggtaggctaagctaggctatgttgttctgtgagttagctgtattaaatgcatttttgacttacagtatttttcaatctataatgggcttattggaatgtaaattgaggagcaactgtataaagttttcattgcctttttaccttgagtaaagagtacttcctgctttagcacttatgaactggttgcagcagtgggattcatgttctcagatacattcctgatgattggatgtctgaagcataggttaaattaaaaaaaagaaaaaattatttaaaaattattttaataattagggatggggctgggcacggtggctcacacctgtaatcccagcactttgggaggccgaggcaggtgaatcacgaggtcaggagttcaagaccagcctgaccaacatgatgaaccccatctctactaaaaatacaaaaattagctggacatggtggcgtgcgcctgtaattccagctactcaggaggctgaggcaggagaatcacttgaacccgggaggcaaaggttgcagtgagccgagattgcgccactacacttcagcctgggcttcagagcaatatttcgtctcaaaaaaataaaaaataattgggggtgtgacagagtagagaacaaagtgggattcatataagatcctaattctttgtgtgtgtgtgtgtgtgtgtgtgtgtgtgtgacggagtctcactctgtcacccaggctggattgcagtggtgcaccctcagctcactacaatctccacttcctgggttcgagtgattctcctgcctcagcctcccaagtagctgggattacaggcatgtgccaccatgcctggctaatttttgtatttttagtggagacaggttttaccatgttggccaggctggtctcaaactcctgacctcaaatgatccacccaccttggcctcccaaagtgctgagattacaggcattagccactgtgcccagccttgaccaatattttataagcatgcagcatgcatgataaattagttttgaatatatgtgggattttcagttctgacattttggcagagaaatgctggataaaaatatgacgaacattttcttttattaataaatgcatagctccccccacaacaaaggaaatccctaggggataaactataaagcacttccccacctggagattttgatattctctaacccagaaggcttagatttaattagcaatgtgcagggaggaggcaagccatgggcttgcttggagtcagaattagatctaaaatttggtcctccctttgacctttggtactaaaatgcagaaggccctggattttcggagggaaaagtctgatgctggcctttgggggaaaaagtctcccctgaaaactgatagttacgctcctacactcattacaagttggggtatgaatttattactttctgcataatccaggaacttccaagctaagcaatgaacaaaatagtttctgtttataattcccaaattcctggcagtaacaaatgcataatctctctggaaggagataccctttgtatctctttacttaaataaaggtaaataaagtctactaaacttacaaagaacccaagaaaacagtctacattgagtcagcaaataaatcagacctctaagaactttaaatagtagaattattagatatagactgtaaaataatttaatgtatatttaaagtacttaaggaaataaaagactgccatagaaatgatataccaaaataggctatagatatttgaaaaaagaatagaatagaatctctacaatgaatataggcattgaaatgtacaactaaatggatgcattaagaaactgagcagaagtctgatgaagtgggagacagatcagaaaaaaaatttcccaacacagcaatgacagtgaaataggagaggcagttttcaaaaagtaaaatggatcctatgtaaacatggatgagaattttgattaaaattagtgcgtctttggtgaaaaatgtagcgttacctatagcactgctgcagtgctttcttgcattataacattttctggcaatatagccttaaaaattggttacatccaataatgcatttcttagaccatcaaaaaaataaaatccagtatttttgtatggtataatgaagtaaattcattactaaatataatcaaataactttagcaccagaaggattctaaaagaacttttgacataaatagaagttagggaactgatttaatcccacaggtctaggtaatgacagagctgcagctagaagattccaagtctagcgtttttttctctgtgttttgctgcatattttagacatgtagataaagctattttggtcagattttcaagatcaaaagtttaggttttaaagcattttggaaaaagctgaaagtgtgtataaggcattgctaatataatataagcagttcttttaaccagtaatgtttttaatggaattactgttgctttccccatgttgctttatcagagcaagatatgtgaattacatcaaaacatcagaggttgtcagactgccctatcctctccaaatgaaatcttcaggtccaccttcttactttattaaaagggaatcgtggggctggacagactttctaatgaacccaatggtatgtatcaggctaaaataaagcactttactaatacctaatttgcttctaggcagtggaaacttcaaacctctgtgagatagaaagctgaggtcagattggtggatgaaaggataattgtgaataatttgcagatttcagaagaatagtggctttgggaatacataatgaagagaatataatgagaattgcactgtagatttgattattgaaatgtgtaatagaaattggataaatatttatagcatgttttacatttcaaatagaataagaatactcagtaagtcagtcatacctggagctgtctcattcttcatactacctgcgtattttttgtttgtggtttgttttggctttttttagacggggtttcgctcttgttggccaggctggagtgcaatggtgcgatctcggctcaccacaacctctgcctcccaggttcaagcgattctcatgcctcagcctcccaagtagctgggattacaggcatgtgccaccacgcccggctaattttgtatttttagtagtgacagagtttctccatcttggccaggctggtcttgaactcctgacctcaggtgatctgcccgcctcggcctcctaaagtgctgggattacaggcgtgagccaccgcacccagccatactgcctgcatattattagtccattgatgaatgtgccatcatttattaaccagcccctattgatagcacaagtaaggatttcttcctctttttttaacatgtgtagtgaagagaaaagttattctatggtaatttaagtagttggcattatgaaccgatgttatgatactcactaataataaaacactaatagcatgcattctttaaaaatttgtttttatttttaattattataggtgcctaatagatgtacatttatgaagtacatatgatgttttgatataggcatacgatgtgtattaatcacatcagggtaattgggatatccctcaccttaagcatttatcatgtttttataaatgttaggaacataccaattccactctttgattgtgattttaaaatatacaataaattattgttgactatcatcaagaaaacagtttttagaaacaaatcgaccttttcttttgctgtttttaaaaattgaattgctgtcttagaatttgtctaagtaggccaggcgcggtggctcacgcctgtaatcccagcactttgggaggctgaggtgggcggatcacaaggtcaggagttcgagaccagcctggccaacatggtgaaacctcatctctatcaaaaatataaaaagttagctgggtgtggtggcggggacctgtaatcccagctacttgggaggctgaggcaggagaactgcttgaaccagagggggtggaggttgcagtgagccaagattgcaccaccacacttcagcccggggaacagagcgagaccgtgtctcaaaaaataaaaataaaaataaaagaatttatctaagttttggtcataatccttgctgatagctatttagatcacacatgatctgttttcagaggctgtatatcccctagggaggaataaattagtacctagaatctgtaatcagagataaagaggcggggggagactggatggaagaagtcagcagtgaaactccagagcttattcaccttccatgttctcatttctgaaattccgtggaagtgtatctagtgctccagtgcttgatgcttctaggtcatttttcaaaactggtctgctaaagtaggtcagttttccaagaaccacagtcacctgaaaagagcagttagcttgccatcagatcaccaatcccattgccagactatagattaaaaaaaaaaaaaaagggaatagatagttccatttgcaaactatttgtgttaaataacactgtaactctgcaaaaagataggtgggtggcacaactatgaagtgaggtgtctataaagtccaaacatacatacagaaaactttaatattctataatagtccaccatagtcagacagacagccccttgctatcatcagaactggctcagtagaattgcggtggttgctactagtgttattgtatagacaacgtttaaatctttaattttaccattggttgttaagtgcagtttttgttctattaactgtaaagtgggggaaaaacattttctggattttttttttctgcaggttatgatgatggttcttcctttattgatatttgtgcttctgcctaaagtggtcaacacaagtgatcctgacatgagacgggtaagatgatggtccagctatggatttttttttttttaagagatagagcctctgttgctcaagctggaatgcagtggcacaatcagtttgagtggcctcaaactcctgggctcaagctatccacctgcctcagcctcccaaagcactgggattataggtccgaggcaccatgcctggccccacctgtgggtttttgaaccgtattgtgatgtttgctctgtcccatcgtagctgggtagcttagtttttctcaattttattctagttcccaagccaaattaatctagaggttgtattaacatagtatcatgtttatggcttttaattagttgcttccattagactagataaattgttagttctgcctggcctggatctctttatgtagctaaaacatcttactgcatcctagcctctttgtgtgccttactttttaaatagctgaaatgtacaatacttctggtatgctgaatctaaatattttacaaagtgattgttcctgtgatctgcctttactttacaaaactctcttcagagtacatactcagtttatgtgttcagacacacagatagaccaagggggatggataagtagaagagtgacctttgaattctgttccacaaaaccatactggttctgcagagggagaggatttgctaagtaggatgcttccaatttagtgccaccacattttctctttgaatattggcttctatttgaactcttcattttttcaaaaaaccatcatgcatttttccgttcaaccatcaacaagtatcttctgagtttcaaggttccccattttatttagtatatagatgtggtgacattttattcattcctgagtaaacatttatcaatttctagggtctagatactggagatacagaaatgaattataggccatacctgtcatcagtaggctcagtcccagttaaatgtagaaaatagaatggatttatcaaatattcttcttgctatcaggggattttgtgactttttcttttcttttttcttaatagaaatttgtcttatttcttaaagaaataaggtaaataaaaatgtttgctaaggtagtaggtgattatgttctgtggaaggtaataaggggtatattcaaagcaggaatggcagaaaaagattcataggaaaagaaaggtttttgatatttcaaaatgttttattggtgaatgtttgcatttttgcttcagtgttagactgaaagtaatacatcctgtgcattccttgtatatgttaagccaattaactgtggcatcagtagaaggaaacatcagaagtcacatttgattaaaagttcattctggccgggcgcggtggcgcaggcctgtaatcccagcactttgggaggccaaggcaggtggatcacctgaggtcaggagttcacgaccagcctgactaacatggtgaaaccccgtctctactaaatacaaaaaaattagccgggcatggtggcgcatgcctgtaatctgagctacttgggaggctgagacaggagaatcgcttgaaactgggaggcagaggttgcagtgagctgagatcgtgccattgcactccagcctgggcaataagagcaaaactccgttaaaaaaaaaaaaagttcattccttgtgaagtgctttgcacatagtaagcatcttaaaaagttgattcaagagcttcagaagctctcttccttggcactgcctgcagaggtggcaccatctcctacttggcatcatggctgccctcagatcctttgtgaagcccaagatcatcaaaaagacaactaagaggtttatctggcaccagtcagaccaatatgtcaaaatttagcttaactggcagaaacctagaggtgttgacaacagtgttcgtagaagattcaagggccagatcttgatccccaacattggttatgggagcagcaaagaaacaaagtacttactacccagtggcttctggaagttcctggtctacaacatcaaggagctggaagtactgctgatctgcaacaaatgttaccgtgctgagattactcacagtgtttcctccaagaaccacaaaaccatctggaaagagcagcccagctggccatcacagtcactagtcccaatgccaggctccacagtgaggaaaaggaatcaacggctctcatgcatgttttatttgtgtttaaataaaaccacaaaaactgaaaaaaaaaaaaaaaaaaaaggggagcttcagaattgaacagattcaaaaatagagttgatatatgtttgcagggactcaagagctgttaccatatacatttatttcttaattattggggcatgttaacatacttgatttatgtttacaatatttctttcgctagccttatttgtaaaagcaacttctcctttaaaatttaggaatcaattctacctttgtgggaaaagctcaagctaatatcccaacagtgttcaatttgaaatggaagcctagtgctgtgctgtgtgcctatagtcccagctgcccaggaagctgaggcaggaagatcacctgagcactgtctcctaaaaaaaaaaagaaaagaaaaaaatgaaagaaatgatagataatatagtatttgctatctttttcatgtatgaatgaactaaagtcaattttaagttcactttgagaatgtcacttaaaatttaaatgaagcagatgttacattaatattatataactatcaaacagtactttatagatttttggctcaattaaaggggaggacaaatactcaaaagtgccaagtcctatcctgttttgccaatgacttctttgtaacagtgtgttgcttgctttagagtctaattgaagtcatgcaagccatacagcattcatagatttactactgaggcttataaatgaattcttagaaatattgcacttattttccaaactgtactgataccttgatatatagttaaaaattaatattctggttatatgcatctaaaggaagcatgaacttaaaaatgtactcattaaaacaataagaaatcactttaatcagaaaacataaaataagagaggaatatgatcaaatatattcagtatcagaaaaaagtgttctttattaagacaagcagaatcacacgaaagggaacatcacacacagggcctgttgtggggtggggggaggtgggagggatagcattagaagatatacctaatgttaaatgatgagttaatgggtgcagcacaccaacatggcacatgcgtacgtatgtaacaaacctgcacgttgtgcacatgtaccctaaaacttaaagtataataataaaaaaaaaaaaaggcaagcagaatcaaaccctaggcagtcatttattggacatttactaagagtcaaaatgtctagtggtataaaggagatatggaaaatagttactaatgatatataggtgaagtactactgagtatgatgttgcatcattgctcagaaccagtacctttcacttgttctactcctttactttttccttaataggaagtgttaggagttaaaagactcgaaggatcctacatatcattgtgccttgtcttcttgcaggaaatggagcagtcaatgaatatgctgaattccaaccatgagttgcctgatgtttctgagttcatgacaagactcttctcttcaaaatcatctggcaaatctagcagcggcagcagtaaaacaggcaaaagtggggctggcaaaaggaggtagtcaggccgtccagagctggcatttgcacaaacacggcaacactgggtggcatccaagtcttggaaaaccgtgtgaagcaactactataaacttgagtcatcccgacgttgatctcttacaactgtgtatgttaactttttagcacatgttttgtacttggtacacgagaaaacccagctttcatcttttgtctgtatgaggtcaatattgatgtcactgaattaattacagtgtcctatagaaaatgccattaataaattatatgaactactatacattatgtatattaattaaaacatcttaatccagaaatc

SEQ ID NO: 38242 - DNA, 139018 bp, Homo sapiens
gccggtgcggctcgggtgttgaaacgggtgtcccctccccctcctcccctcccccacgcggtggtctcccctcccacccggctcaggcagagccatgtctcggggtggctcctacccacacctgttgtgggacgtgaggaaaaggtccctcgggctggaggacccgtcccggctgcggagtcgatacctgggtgagcgggggccccggggcggaggcgctgaggtcgccgcctagagtgggggagggggcacgctgccgggtctgttggaggtgggacggcgtctcggtgggggcgcccggagactctggggtgttgggtggggccttggttgccgaattccgtgccggtgcctcccccagtcaagccccctgtgcatgctgccagccgccgcccttgctgggtttttctcggagggccgggccgtgggcagaaggtactggcttgtaaaggtgttggggtcgctgatgggttgggactcgggagacttgcggaacctccaggagctgccgcgtttagagcaaaagttagctcttttgctcttttccagcgcgctttccccgctcagccgaagaacctaagttgttgcccaccctctccttcaatctccagagggtttaggtgtcggctgcgacgcgttgaccaccctcagggacttcacgctccagacagaatccgtgtaaactgtttttgcggcgctgagccaaaacctaaaagtgatagctgagctctccccacccccgcgcgctctcccagttccactctgctcttcagttcgttttgaccgcttaaaggtggtgtagggtttcacgttcctcttcccacccctggaaaacacacttggcatttacagtttcgtagttaagctttctaaaaacaaccttcagtacttgggggaacagtattccacttttttcgttttgcataacattttttttttgaggattctaggtcacgcccgagtcaactaaaaagtttggtttcttaaaaatggacgtacttagtaaaggtcttttttgtttcttcctgtatactcttcattactctttctttctatttggagatacggcaaacaacatcataaaatttttttctttccagttttgccacttgctagttaaaaagtgtttgttgctctcatttgtttttgatttcaagtaaagagaagaaaatgaaatctcattacaaccaacagttctggtttgtaaattatttaagaaaagttagcatgcaattttttaattctttttagtgtctcaagtaaaatacgaatacattttgtttataaaaactcaataaaaatgaagcaaaaatccctttgatccctcccattcaatttcactccgccacccttagaaataatattttctgttttctgaatattcttccagacctttttgtttgcattcttacaagtacatatgtacatgtacaaatgctggggtgtgtgtgtgtttgtgtgtgtatgagagagacacctgagtgcatggtgtcatattgtaaacattgttttcacttctccacattttggagatctttccatggcagtaaaaatagattgattctgtcttttaaattattacatagtaggtaacattatgaagtaccatagggtactcaacctttcttctttaagtagacgttcgcccttacagcattttaatgaacatcattctacaagcttctgtgcatttgttgtaggataagtacctagagtggtgattaatcattttaaaattgaacatagctggagtctggtttttaaaactatttaccaaaaaaagtgtgcagtatttcttttagaatttatttgcggagaaagaacttaattttagcttaataaaacaaacgttaacattgttttgcatggatacatttataatttggtcctttatctcagttggacagtttaagtacttgtatatagttctatattttagtgttttcttttggttcagttacttcagctatatctacaaacgagttaattaaaatataacaaaaccatatacctgcttttccccctcctactccaactccctaatggaaatggaatttgtgtattgggtctaggggaattgaagggttcactgactatattagaaagcctgaattacagtttttcaaatgtgtatgtatacatacagggagttctttatcttaaataatattttagatatgataatatatactcttaaaataggacatttttggaatgacttcctttaaaagtggttttctaagtacttgaaaatactttttgaaagtatcgaaacttgaaaatgtttgcaaagaactaatttattggcctttacccttagtagacctttacactgttattcagctcttctatactacagtgctaatcctggctttgcattcaggaagcagcaaaatccacattggtaatgtttgaattagtgatggttttttttaaaaaatgactttccctcccagttttattggggtataattgacaattaaaaattgttatatttaaggtgtaggacttgataacttcatatacaatcaagttaattaacatatccatcatgtcacataattaccatctttttttgtgtgtggcgataaaatgactttatcattattattaattttatttttattattagataaaatgactttttaaagtacagtactcttggccgggcgcggtggcttacgcctggaatcccagcactttgggaggccaaggtgggtgatcacttgaggtcaggagtttgagaccggcctggccaacatggtgaaaccctggtctttactaaaaatacaaaaattagccgggagtggtggcgtacgcctgtagtctcagctccttgggaggctgaggcaggagaatagcttgaacttgggaagtggaggttgcagtgagccaagattgtgccactgcactccagcctgggcgacagagggaaactctgcgtcataaataaataaataaataaataaagtatggtacacttataaagccttccttttaaaagtcaaattccaagttaggattttcctaaggaaatagattccttttttaaaagacttcaatatttaaacattacgattgtctatctacagggttgtagatttaagtatttttctgatacattttcattatttgtatttctacagattttttagcagtgaattactgctaaatagtaaaattgggatagaacaaatagataaatttttcttgtagcctttacatttccagttatttcaccatagcatgtgccctttcaatgttaatattcaagctttgtaattgattttacttaaactgattaattatctcctttcttcccatcaaagaaaattatacttcagaaaacttcctattatgttgtgggaatgaagatgaataatttcccagatgttatttatgattaaaagatatgtttacttagagctcccaaatccacaagattcacctgggccaacagagtgttgttttagactagcatggatttagaggataggccagggattttaatctttgtgagccctatctaaatttcaatgtaggattcttttttttggtgggaggcggggggcagggtgaggcagggttttgctctgtctcccaggctggtgtgcagtggcaccctcatggctcactgcagcctccacgtcctgggctcaaggccatcctcccacctcagcctcctggaattttttttttttttaaagaataattatcaaagtcagagatacctgtaggtttaaatgtttaaatgtaatagtttctcaaattactgtatactaggtgtagagtagtgcttttggaaatcagtgatttattagccacacagattttattatcccatatatatacggttttgtaaagataaacattgttaataaaataaacttatttcaatacattgcttgtttctactcatatttctttccttttggacagacactcctacaactttctaacccttctaaattaaaagatagtaattgataaaaaagtaattttaaggtacttctcaagggagttatttattataatgtataaaatgtgtaaattatgattaggcagccagtgacaattttttagtggagattgaatctcatctttttgtaaggagtttatgaagtcagtgtcctttgaatatcattagagtcagtatgtactgaaatggataattttgcgtgtcgattactctttagtgcatcttgaatacatctgcattctagattaccaggttcttcataatatgttgccaagttacagtgtatttattatatgaagattagtaacttctgacttttgcctctttttttagccattggggaaaagttagtgaaatatttgtattttgtttctttagtcttgaaatttcagtgaaagctgaaaaatgtatgattttagtattgaaaaatgacggtcaattgtgacaaacgtaagatatactgataattccttaaggcaggacaccaaaggcatataagtaatcataacaaccatagacactatgatagctctactgtgggtttcattgcttcctaaaataggatgaatcaagttataagtgcttagaaggtttagaagcttctggtagcatggagcttatgttacaagtatgctttaggtcagtgtttttaaaatgttttaaaaatgatccatgataaaagtacatttatgtggcaacctgtgatatacacaacgaaaataaaggattctctaggtgtatatataaaccttactagatgggatgcattctgttttttttcatattgttacaactgttggtgttgaactggtagagtacgcactaatgagtctcagcttgaggtttggaaaattgttctagatggtgtgtagttcttgtaatttaatgttgcttcaggtttaaggtgggcaggcttccccaagtacttgaaggagattaaaaaaatttttttttaaacactgctgatggctccacagggaaaatgtaaatagtgaaacttcatgtacatcttggacaaaataactagggtcgaacacttttaaatagatatctattgtgggattgctgacttgtatggtaagtatgtttaactttataaaaaacttccagactgtcttccaaagtaattctaccatactgcattcccaccagcagtatatgagagttccaattgctccacattctcatcagcatttggtgtagtgagtcttcctaattgtagccttcatggtaggcgtgtagaaatatatcattgttttaatttgcatttctctttttttgtttttgagacggagtttcgctcttgtcgcccaggctggagtgcaatggcatgatcttggcttaccgcaacctctgcctgctgggttcaagagattctcctgcctcagcctgccaagtagctgggatatgggcatgcgccaccatgcccagctaatgttgtatttttagtagacatggggttttgccatgttggtcaggctggtctcgaactcctgacctcaggtgattgacctgcttcggcctcccaaagtgctgggattacaagcatgagccgctgcgcctggcctttaatttgcatttctctagtggttaatgatgttgagtatcttttgtggcttttgtttttgtcatccatatagtctggttaaatgttcaggtttacctttttaatattgtaagaattctataattctttatataacagtccttaatcagatatgtactttacaaatattttctgtcagtttatgtctttttcttaacaggttcttttatagttcatactttttatgtcctatctaagaatctttacctaatccaaggtaacaaagatttttactttttttttcctggagattttatctttttacctcttacatttaggtctgtgaacaatttcgagttaagttttacatatgttgtaagagtcaagtttcatttctttgcatattaatgtgcaattgatctaacagtgtgtggaaagactacttttttccctttgttgaaaatcaattgaccataaatgtttaagtcaatttcctagccacattccattgatctagcttcatgtctttataccgaggattgaaatcagctagtgtgatactttaaacttggtcttttttttgagacagagtcttgctctgtcacccaggctggagtgcagtggctcgatcttggctcactacaagctccgcctcctgggttcacaccattctcctgcctcagcctcccgagtagctgggactacaggcacccgccaccacgcccggctaatttttttgtatttttttagtagagatggggtttcaccgcgttagccaggatggtctcgatctcctgaccttgtgatctgcccgccttggcctaccaaagtgctgggattacaggcgtgagccaccgcgcctggccgaaatttggtcttttttaaaaaaatttatagttatcctggctattctgaaccctttctatttccataaaaattttagaactagcttgtcaatttctacaaaaagacttgggattttgtgttgaatctatatattatttcagggagaactgacatgtttacaatatgaatcttctcatctgtggttctggtttgtctccgtgtattaagcattctttgattctctcagcagtgatttgtattttttggtgttaggtttatccttaaatatttcatatttgtaatgctattttagatgatatttttatttatttttactttttatttgtacaaatttatgggtacatatgcagttttgttacatgcatagattatgctgcagtcaagtgagggcttttaaggtatccatcacctgaataacgttctttgtcctcattaacgaatttctcatcatcctcccacctcctcattcttccactccattatgtatcattccactctgcatctgtgtgaacacgtttgtttagaacacacttatgagtcagaacatcatacttgtctttgtgtgcctggtttgtttaacctaagataatgacctctagttccatccacgttgctgtatatgtcatgatttcattcattttttttttgagatggagtctcactctgtcgcccaggctgtagtgcagtggtgagatctcggcttactgcaagttccgcctccgaggttcacgccattctcctgcctcagcctcccaagtagttgggactacaggtgcccgccaccacacctgactaactttttttttgtattttcagtagagacagggtttcacagtgttagccaggatggcctcgatcccccgaccttgtgatctgcccgcctcggcctcccaaagtgctgggatcacaggggtgagccaccacgcccagcctgatttcattctttgttatggctgaatagtattccattgtgtatatataccacattttctttacctgttcatccattgatggacacttaggttgattccatatctttgctgttgtgaatagtgctgcagtaaacatactggtgcacatatcttttagatatattaatttcttttctttttgtaaaaatctagtagtgggattgctagatggaaagatagttctatttttaattcttggagaaatctccatactgttttccatagaggctgtactaatttacattcccaccaatggtatataagagttccctttttttcacatgataaccaacattgtctgtctttttaataaaagacattctgactaggataaggtgatatctcattgtgaatttgatttgcatttctcttatgactggtaatgttgagcattttttcatatacctgttgggtgtatgcttttgaaaaatgtctattcatgtgttttgcctactttttaataggattgttagatttttttggttgttgaatcgtttgagttccttgtgtagtctggatattagtcccctgttggatgaataatttgcagatattttctgtcattcaacaggattggttgtctcttcaatctgttatttcttttgccatgcagaagctttttagtttaattgagtcccatttgtctgttttctagtatctttatagttttgggtcttacacttaagtctttaatccaccttgagttgatttttatgtattagtgagagataagagttcaattgcattcttctgcatatggatatctaattttctcagcaccattgattgaagagggtttcgtttccacagtgtatgttcttgtcggctttgtcaaacatcagttggctgcaagtatgcggctttatttctgggttctctatgctgttccattgacctgtgtgtcttatttttataccagtaacctgctgttctggttagtatagtcttgtaatataatttgaagttagataatgtgatgcctctagctttattctttttgctcagcattgctttggctattggggcttctttttggttccatatgaattttaggattgttttttctaattttgcaaaaaattaacttggtattttgatagggattgtatagaatatgtaggctgctttgtacagtatggtcattttaatgatattcttctgaatatccagtgatcatgggatgtttttccatttgtgtcatgtataatttcttttagctgtgttttgtagttctccttgtagggattttacctctggttaaatatattcctagtttgtgtgtgtgtgtatgtgtgtgtttataatttcttttttctttttttcttttttgagacggagtctcactctgtcacccaggctggagtgcagtggcacaatctcggcttactacaacctccggctcccaggttcaagcacttctcctgcctgagcctccagagtagctgggactacaagtgcgcaccactatgcccagctaatttttgtgtgtgtgtgtatttttagtagagacagggtttcaccatgttggccaggatggtctcgatctcttgaccttgtgatccacccaccttggcctcccaaagtgctgggattacaggcgtgagccaccacacccggcctttttttttttgttatttgtagctattgtaaatgggattgtgttcttgatttggttttcattttgaatcattattggtgtgtagaaacactactaatttttgtatgttgattttgtatcttgcaagtttactgaattcatttaccaaatctaagggtttttttttttttttttttgagacagaatttcattctgttgcccaggctggagtgcaatggcacaatctcagctcactgcaagctctgcctcccgggttcaagtgattctcctgcctcagcctcccgagtagctgggattacaggcatgtgccaccacacccggctaatttttgtagttttagtagagacagggtttcaccatgttggccagctggtcttgaactactgacctcaggtgatctggccacctcagcctcccaaagtgctgggattacaggcatgagctaccgcgcctggcaaatctaagagtttttgtggggagtctttaggtttttctagatataagatcatatcatcaggaaacagggataatttgactccttcctttataattttgatgccttttgtttcattctcttgcctgattgctctggttaggacttccaatactatattgaagagtggtgaaagtaggcatccttgttttcttccagttcttaaaggaatgctttcatcttttccctattcagtatgatgttagttacaggtttatcatatatggcctttattattttgaggtatgatctttctgtgcctagtttactaagggtttttcttatgaagggatgttgaattttattaaattcttttttcgcgtctattaagatgatcatatggtttttgcccttcattctgttgatatgatgtatcacatttattgatttgcatatgttgacctatccttgcattcctggtataaaacccacttgatcatggtgtattatctttttgatttggtgttggatttggtttgctagtattttgttgaggatttttgcatttgtgttcattaatctgtagttttctttttattctgtatcctttgttttgtgtccttctttggttttgttatcagggcgataatggccttatagaataagttagggagaggcctgtccttgattttttggaatagtttcaggagtattgatattacttcttctttgtacatttggtagaattcggctgtgaagccatctggtactgggcttttctttgttgggagattgtaaaaattactgattaattcttgctgctcattattggtctattcagattttctgtttctttctggttcattcttggtaggttgtgtttttctgggaatgtatctatttcctgtaggttttctagtttatgagtatatagttcattatagtctgtgatgatctttgtacttctgtggaatcagttgtaatgtctcctttttcatttctgattttatttggctcttctcccttcttttcttggttagtctggaaagtggtttatcaattttttttatctctttgaggaaccagcttttcatttcattgaccttttgtgggttttttttttcagtccatatttcatttagttctgctctgatctttatttcttttcttctgctagttttgggtttggttttttcttggttttctggttcctcgaggtgcgttcttagattattaacttgtaatctttctcctttttgatgtaggaatttattgctgtgttcttcttagcactgcttttgctgtatcccacaggttttggtatgttgtgtttacattttcatttgtttcaaaaacatttttttaaatttctgtcttaatttcttcattgaccctattgtcattcaggagcatgttgtttaattgttgtgtatttgtaaggtttgtaaattttctcttggtattgatttctagttttattctgctgttgtctgagaaggcacttgatgtgatttcagttttaaaaaatttgttgagactttgttttgtggcttaacatatggtctgtcttggagaatgttccatatgctgatgaaaatattgtatattctgcagttgttggatagaatgttttgtaaatgtctgttaagttcatttggtctaaagtccagtttaagtccagtgtttctttgctgattctttgtctagatgatctgtctaatgctgtaagtggggtgttgaattttcacactattgtgttgcagtgtatctctttctttaggtctagtaatacttgttttatgactcttagtactccagtgtcgggtgcaaatatgtatttagaattgttatatattcttgctgaattggtctctttaatattatataacgactttcttagtcctttttttttttttttaactgtttttagatggttttttctcttgccatttttaggattcactcttcactttgacttcagacagtctgattataatgttgccatggtggagacctttttacactgtatttgtctggtgattgctgagcctctcatatctggatctctaaatctcttaactagcagtcatctgtcctgtgccaaggatgaaataattttgtgttttgtctctccttggtagagtttgtcacccccaagtaagaactaaggctctgagaaaataagttttgcccaacctaagtgtagtatgttcaagtcagatatttaaacctaatccaacatttcttgccccaaccatctctataagtaataattctcaactagtctagtaaaggagataggtatgtgaataaataacttacaaagttgtaatttatttaatggtttaatgattacacaaccattaaaaatgagcaatagctgtatatttattgtcattgaaatacattcaccatgtgttattttattttatttttttgaggtggagtctcactctgttgcccaggctggagtacagtggcatgatctcagctcactgcagcctccgcctcccaggttcaagcgattctcctacctcagcctcccgagtagctgggactacaggtgcccatcaccacacccggctaatttttgtatttttagtagagatggggttttgacatgttgatcaggctggtcctgaactcctgacttcaggtgatccacccacctcggcctcccaaagtactgggattacaggtgtgagccaccacgcacagcaatcaccatgtgttattgagtggtaatacagattccagaacagaatgaatatcatgatcccagtcatttattcactgattcagcaaacgtatattgaatgcatactttgtggcaggcactgtattaggtatttggaatacatgggtcaataaagcagtgttcttatggagtttataacctattaatataaaagaatgccagagtagagtcagaattataagaggcagcttgaagtacagaaagacttgagttggaagccacaatggtaagttcatccataacaagtgtgtaattcttgggagaagattcttcatagctctttggatttctgaacatcttcggagcagaggcactagtcgttttgttctggactatcttctcagtgaggtttatatagtgaatagccttggaatatataacaattctaaatatatatttgcacccaacactggagtactgagagcctcttgagccaaggacaaatttgttgttcagtttaataatgtctccttagggataaaggtcgggcaggtttgcttgataaaagatttaggttccccaagttcaagattcctcagctgtgattaaaacccattacatgcacagcatctatccaggcatcttcaagtttccctatgagacttggattacaggaagaaccaatgtaaacctgaagctcatactgcttgccatacatgagtagtaaatttttttgcctctgacttaggagtttggtgtcttttgctagcatccaagaaaggtagcagtccaattggttaccttgcaaataggccagactcttcacagcttttaatagcattcagatgtgagtttattttaattttaatttgaggaggctcagttttattaaggtactgttcttattttgtggtgggtttttgcttctatttcttggtattacatttaattactaaaagggtagtggatgtttttgctagtttgctctagaagcacactttatgagatgtctggacgatgcaataaattttatctccaaagtcatgtataaaaatgtcattcaaaagctatctatttaaccacaatgtgttatgcctctatacatgttctaatgtgcaaacgtcatatagaagagttcttgctaaaacagcttactttatcttctattcttaggttctgccaccattttctccagactgaagtggctagagccatgtttcaaacgcaggttttaaaattttgacaaagtttccaatactttaatattttaatgtgttttaattgctgtcatattgttaatttgaatactttgtttcttaactcgtataactcaatgagattaccaatcctttgaccaaaatgaaatgagtttttaaaaatttatcttttttactgaagttagaatctttttacaagcgaaaatcagatttgaaaagttaattacctgaagtacaacctacttcatgaaaacatgttactgaatttctctaggttgttttatttcagtaagtttagaaaccatagagcatctccctccccaaaataaaagcccccataattatccataatttttttttaacttatatgttcatcctttacctagccatcttaccagttaaataacatggagaaagaagtaaaacaaattggcttcaagaggctcttgattttgacatggaatggcaagaaagtgcaatagagaaatctgccctttgtgacagtatacagaaagtataggcagatacaattttatgagagatctcatcagcctgattacttaattattgttctttgttgtaaattcagccttctttcattacagcttctgaataaacatgctttttgatctgtgtttggtaaagatgattcattccttaaagggacagatttctctttttcaaagaaggaacttactctgtttttgcagtatttaaactgttctgctattgatggacatttatgctgatttttaatgccatatttcatcattgtaatgttaactttaacgtttctgaaattgagaaatgcttaaaaatagttggtacttactattgctgtttgccatcctatttaaaattaaaaaccttactccctacctgcagtcatcttttatctctttttcctgctttatttttctgcatagcactatactaacttatagcacttacaccgattattgtttttctcctctcataagcaggcagaaatctttttgttttattttaccaccgtaaaatatactttacctgacacagagtgagtactcaataaatatttgttgaatgaataaatgaagaaatgtacgagtgtttattgtggtccagatactgtgctaagccctttctgtccttaaaataactacaggccgggcgtggtggctcacacctgtaatcctagcactttgggaggccaatgcgggtggatcagttgaggtgaggagtttgagaccagcctggcccacatgatgaaatcctgtctctactaaaaatacaaaagttagctgggcgtggtgctgtgtgcctgtgatcccagccacttgggaagctgaggaaggagaattgcttgaacttgggaggcagaggttgcagtgagctgagatcatgccactgcactccagcctgggcaacagagtgagactgtgtctcaaaaaacaaacaaacaaaaaactgcgtgaggtagaggtattctaatgaggaaactaagtcttaggcggaggttaaattgcccagtatcactcagtttataaatggtggagctgaaattagagcatgaatttacttttcatgccagatcctaggctcctaatttctgtgttatatttttctcagtatttgtgtgatttatttaatttgttctttctttttaaacaggaagaagagaatttatccaaagattaaaacttgaagcaacccttaatgtgcatgatggttgtgtaagtaatagttaattctcaactctgaagggatttgatactaagtgtttaagtgtttgatgaaatgtcccaatcctcccagaaaggattgtgactataataaaatgggagaataaagttttacattaaaatataaaattatattttgaatctagaagagtgtatgcaagattttttaaagtgcagatgagttttctaatattatcgaaaggcttccatctcattcactgtactgaaactgcttttgtgacttcatgtctccaaatgtggtgttcacttcttagaaactagacatatcactcaaacatatcctcttttttttcatacttttttttgtttgtttttgtttttgtttttgagacagagtcttgctctgttgcccaggctggagtgcagtggcgcaatctcggctcactgcaagctcagcctccctgcaagctccgcctcccgggttcacgtcattctcctgcctcagcctcctgggtagctgggactacaggtgcctgccaccacgcctggctaatttttttgtattttttagtagagacagggtttcactgtgttagccaggatggtgttgatctgacctcgtgatcctcctgcctcagcctcccaaagtgctgggattacaggtgtgagccactgtgcctgtcccatatcctcttttttgaaatactttttctcttggcttttgctaacaccatactctcttggttttcttcctatttcaatccattgacttgctacatcttctctgtctcagctgactcctccgcatatgttccttcacatgttggttgcacgaagaccctgtcttggtatctcccaccctcttttctctccagctcaaaatgaccctatctagtcccatggctaaagaaaacatgacttctgcctcttcccagagtttttatatccaactttctacttaacatgtccagttgcatgtctaataggcatcccaaatttagcagatccaaaacagagctcttttcaatttttattataaaaatttcaaatgtacttttcatgtacttgtgacctagacttagtaattatcaagattttgccatattttcttttctattttattttcttcccccatccaccttgctgaagatccaccttgctgaagatccgccttgctgaagatatattattttaccttcatatgtaagcctaaaaagcgattgacattttcttatataaccaaaatgccattaggtaatttaataatattgactgttttttcggtattaatctaatatatagtccatattttctttgttttaaaatgtctttttattgttatttgttcaaaagatgatccaaggacacctctgccttgtatattttatgccttatacctagaattctcttctctcacttacctgtaaagcttaccttctcattttatttagctctcttttcaaatgttgcctaccaaagcagcattccctgaacaccctaattaaacagcatgccacgcctggtcagtatctttctccttacattattattattattgatagtgcttactatctggcattataattaacaaaccaatttatttgttcatagtctacacttttgcccccctgccttggcatattggaccaaaaaaataccttcacaaatttattttttaaatttactatcaacaggaatgcctgaaacagatgtggcactttatgaattattcattgatgagacaaagagtatattatgtgttagattaattattattattattctttgatatggggtcttgctctgtcaccaaggctggagtgagtggtgcaatcttggctcactgcaacctccgtctcccgggttcaagcagttctccgctgcagcctcccgagtagctgggattacaggcacccaccaccacacctggctaatttttgtgtctttagtagagactgagtttcaccatgttggccaggctggtcttgaactcctggcctcaggtgatctgcccgccttggcctccaaaagtgctgggattgcaggtgtaagccactgttcctggcccaacatttttttcaagtttaaacatacctttgttctctgctttcgtacttcattggtgatctgagtggatacaggattctaggttggacattattttcactctgtagttttttgtttgtttgttttgagactgagtctcactccgtcttccaggctggagtggagtggcacaatctcagctcactgcaacctccacctcctgggttcaagtgattcttgtgcctcagcctcctgagaagctgagattacagtctgcaccaccatgcctggctaatttttgaatttctagtagagacggggtttcgccgtgttggctaggctggcctcgaactcctgacctcaggtgatcctcccaaagtgctgggattacaggtgtgagccactgcaccccacccactctgtagttttcaaggtcttacacaaatgttttctagtattcacttcagctggtaagactgttgccagcctaattactttttgttattatataataactttaattacttttgtgaattacccctagatttgtgcttaaatttttattttttatttttttatttttttatttttttgagatggagtctcgctgtgccacccaggctggagtgcagtggcacaatctcggctcactgcaagctccgcctcccggattcacgccagtctcctgcctcagcctcctgagtagctgggactacaggcacccaccaccaagcgcggctaatttttggtatttttagtagagacggtgtttcactgtgttagccaggatggtctcgatctcctgacctcatgatccgcccgcctctgcctcccaaagtgctgggattacaggcgtgagccaccgcacccggcaaatttttgtatttttaagagctttattgagatatgatcagctgtacatatttaaagtgtactatttgatatgtttaacacatgtaaacatacacaaagtcatcaccacattcatgatgataaaatatcaatcatcccctaaaagtttgcccatgtgccctctcattccttacacatcaccctcaaccccagtcaaccaatgatctctattctgtcactataaatcagtttgcattttctagaattttaaataaacggaatcattgactatgtatccttttttcatttggctttttttactttaaattttacttagaataattattttgggattcatgttgttgagtgtatcaataatttattactttttattgctgaggagcatttattgtatggataaatcataatgtttatctctgttcacctgtcagtggacattgggttgtatccagttgaggactattacaaataaagttgccatgaatattcgtgttgcgtctttgtatgaacatatgcttttattcttttttgataaatacctttgagtggaatgaatgggtcatatggtaggtacctgcttaactgttaagaaaccagttgttttccagtatcgttgtaccgtttaacattcccagtgttagtatgtagaaattccagtgggtccatgtcctcaccagcatttggtgtggtcagttttttttttttttaaagacattctaacaggcatctagtagtatcatgttgtggttacatttcctgccccgttaatttttagatattcatctgtattctggaaacttcctgaactctcatattcattcaagtagcttttttttttccttaagattttataggatattctatgtaaataatcaagtcatctgagaattaagttagttttacttcttttctagtctggattccttttatttcgttttcttgacttatttcactggttagtattctattataagattgaatagaaggagtggaatcaggcatccttgtcttgttctgatcttagaaggaaaacagggtctccctctgtttcccagattggagtgcagtggcacaatcatagctcactatagcctcgacctcctgggctcaagctatcttcccacctcagcctcctgagttagctgggaccataggtgcatgccaccaccccagcaaatgtgtttgttttttgtagaggtggggtctcattatgttgcccgtctggtcttgaactcctgggctcaagtgatacctcccacctcaacctcccaaagcaaagtgctgggattacaggtatgagccgctgtgcttagctaagaacattgtctctttctatttagtatgatgtcatcagttttttcatggatgcttgttgtcaggttgaggatgttctcctctattactaacttgctaagagctatcatgaatcattgctggattttgccaagtgtcttttttttttcctgggaaatgtctaactataattccatttatttagtaaaaataaactattcagggtatctatgtcttgagtgaaccttgtttaatatgtgtgcttcactgaatttattttatgtaaattattgaatttattgacataaaattgttcataatattcccttatgtttttaagtatctgtagaatctgtagtgtatgttactgtgtttctcattactgatattggtaatattttctccatgttttttcctgattagtttggctagaggcttgttaattttgtcttctccaagaaccaacctctggtctcattaattgtctccgttgtttttctgttttctatttcattgatttctgctaatatatttattatttgagtcttctgcagactttgggtttcatttgctctttgttttgtaattttttgagtggaagctgaggtcattgatatgagaccgttgtcttttctaaaatagaggtttctttggtgctgtaaattttcttctaaatattgttttagctgtaatccataaattgagatatgttgcatttttattttcattgagttcaaaatactttttaatttattttgtaatttcttctttgaccatctgttatttctatggccatctgttatttcttagttttccaacgtatctttatgttaatgatttctgatttaattccattttggtcagagaacatactttcaatgacttgtagtcttctatttaaatatattaaggtttgttttgtggcccagaatgttgtctctattggtaaatgtttcttgtacacttaaaaaatgtatattttgctgttttttagttgttacaagcatgatgataaacctggtccatgtgctgacatgttgactataagtggacatttattttttttttaatttagatgtgctcacatactataaaactgacgcatcttaagtgttcaattcggtggtttttagtgtatttgtaaagttgtggagccatcaccactatttaattcctctaattttatcatctgaaaaagagtaccaattatcagtcaccatttcccctctatttagcagttagcaatcactaatactttctgtctctaccaatgtgcgtattctgacatttcatataaatggaaccatacaatattggctgttaatgtaagggttctttcacttagtgtaatgttttcaaggttaatccatgttgtagtatgtgtcagtatttcattcctttttatgattgaataaatatttcattgtacacatataccacatttaatatttcattgtacagatataccacatttaatctgttcatcagttgttggatatttgggttgtttccattttttggcaattatgaataatgctgctgtgaacatttgtgtacaaatttttgtgtgttgtaagttttcaattatcttggctgtatacctagttgcagaattgctaggtcatatggtaaactgatatctcactttttgaggaggtatcaaaactgttttccaaagagctgtaccattttacatttctgacagcaacatacagggttccagtttcttgacatccttgccaactcttattttctgtttctttaaaaaattattataatcatcctagtggatgtgaagtggtaatttgttgtgattttggtttttatttctctgatgactaatgatgttgagcatctttctatgtgcatatgaaggtatgagtcatttacataccttctttggagaaatgtctatttaaatcctttacctatttttaattggattgtttgtctttttgttgttgagttgtgtttgtatattctgggactcttgtcatgggactcttatcagatatatgatttgcaaatatttcccttcattctatgggttgtctttttgccttcctcatagtgtcctttaatgtacaaaagtttttaattttggtgaagtctaatttctttttgctgtttgcttgggctgttggtgccgtatttaagaaacttgcttaatcactggtcgtgaagatttatacctgttttcttctaagagttgtatagttttagctcttctgtttagatatttgatctattttcagttaatttttatatggtataaagtaggggtccaaggtgtttttttttgttttttttttggtggcgattatctagttgtctcagcaccatttggtgaaaagacttttctttcattgaatggtcttggatctcttgtcaaaaaatcacttgaccataaatagaagagtttatttctgaactcttaattccattacattgatctgtatgtgtttgtttttgccagtgccacacagtcttgattactgtagttttgtaataagtttttctagttttattttaggtgacttggttttatgcctgtgaacactaaataaattcaaataagtaaatttacacagtgaaacttaatggctcagacatttcattgtaaaatatcagaacattgtgtttactaaatgacagtcaatatttaacgctttattttgaatttttttagagcagttttaggttcatagcaaaattgagaggaaggtatgggaatttctcatatatcccctgcccacatacttgcatagcattttccattatcaacatcttccacctgagtggtacatttgctgtatttcatgagcctacattaatacatcataatccatccaaagtccatagtttacaatagggctcactcttggtttcaggcatcttatgagtttggacaaatgtatagtgatatatatccaccattatagtatcatgtggagttgtttcactgccttaaaaatctcctgtgctctgcctatttatcacccaccttctgaactcctgatgaccactgatctttttatagtctccatagttaagccttttccagaatgtcatataattggaatcacatagtatgtagccttttcagattagttttctttcacttagcaatatacatttaggtttcctctatcttttcatagcttctagctcatttctttttagagctgaataatacttcattctgtagatgtaccacagtttgtccattcacttgctgaaggacatcttgggtgcttccaaaaattggcagttatgagtaaagttgccataaacgtttgtgggcaggtgttggtgtgcacatacgtttacgttcgtgtgcaggtgtatgtgtggacatacgttttcagctcctttggataaataccaaggagcatgctgtattgtgtatgtttagtttttataagaaatcaccatttgtccttcaaagtgactgtacaattttgcattcccaccagcaatgaatataagttcctgatgctccacatccttgccagtatttgatgttgtcagtgttctctattttggccattctaatagatatgtagtacatttccctgataacataggatgtggattatcttttcatatgctcgtttgcaatctgtgtatctttgctgaggtgcctgttatggcctttggctcatttcttagatgtttcttattgtagtgttttaagagttctttatttattttagataacattactttatcagatgtgtcttttgaaagtatttcccctgtcttgtcttcttgttttcttgacattgtcttttgcagggtggaagtttttaattttaatgaagtcagtcttatcaatgatttcttttatggatcttgccttggtattgtacttaataaattatcaccatacccaaggtcatctgagttttttccctatgttatcttctcagaggtttatagttttgtgtttatatttaggtctgtgatctattttgaattaatttttgtgaagggtgtaagttatgtgtctagattttatttttatttttattttttttgcatgtgaatatccagttgtagcagcaccatttgttgaaaagactatctgcattgtattgactttactcctttgtcaaaggtccgatgatcgtgtttatgtgggtctgtttctgggctctgaattctgtttagttatctgtttgtctgctcttttgccaataccacactgtcttatttggtgtagccttacagtaaaatttttattattatttatttatttatttatttttttgagatggagtctcggcctcttgcccaggctggagtgcaatggcgcgatctcagctcacggcagcctccacctcctgggttcaagtgattctcctgcctcagactcccgagtagctgggattacaggcacgcgccaccattcccagcttatttttttgtatctttagtagagatggggtggtctcgaaccaccagccaggctggtctcaaactcctgacctcgtgatcttcctgtcttggcctcccaaagtggtgggattacaggcactttatagtaagtcttgaagttgggtagtgtcagctgtcttgggattctccacttatctttctgttactgattttagtttaattccattgtggtctaagagtagacactgtatgatttttattcttttaaatttgttaaagtgtattttaaggcctcaaatatggtctgtcttggtaaatgttccatgtaagcttgagaagaacaactttgttcttctcccttaatatgtgttggctagcccgagtctttggcatctcttataaactttagaatcagtttgtcaatacccacaaaataatttgctgagattttgataggaattgcattgaatctatagaacaagttgggaataattgacatcttgaaaatactgaatctttctatttattaatatggaatagctcttcatttatttaattctttgatttcttttaccagagttttataattttcctcatagaaatcttatacatatttcattcaatttatacctaagtgtttcatgttttggagtgctaatgtaatggtattgtgttttaaaattcaaattccacttgttcatttctggtatttaggaaaataattgactttttaatattaaccttgtatcctattactttgctacaatcacttattagttccaggagggttttattttgttttgttttgtttgttttgaaacagagtcttgctctgtcgcccaggctggagtgcagtggcgcgatctcggctcaatgcaagctccgcctcccgggttcatgccattcttctgcctcagcctcccgagtagctgggactacaggtgcccaccaccacacccggctaattttttgtatttttagtagagatggggtttcatcgtgttagccaggatgtcttgatctcctgaccccgtgatccgccctcctttgcctcccaaaatgctgggattacaggcgtgagccactgtgcctggcctccaggagggtttttaaaattttattttccatatagatgatcttgttatctacaaagaccgttttatttcttttccaatcttcatacttttcctttgcttttccttccttttcttgtcttactgcattagctaggacttaaagtatggtgttgaaacgaagtggtgagagaggacatccttgtcttgtttttgatattctacaggttgagtgtctttaatttgaaaatctgaaaattgaaatgctccaaaatttgaaactttttgagtgccacatgatgctcaaagtattttggatttcagaaatgctgtaaaatttcctctgagaactactttgttgcacctcacagattttaattagtcttgttttgatttcattgaattcagaatcttttaaaatttctcttgagatttcttctttgaccgatgtgttattttgaacttgtgtgtattttgggattttccagttatctttctgttactgattttagtttaattccattgtggtctaagagtagacactgtttgatttttattcttttaaatttgataaagtgtattttaaggcctcaagtgtggtctgtcttggtaaatgtttcatgtgagctttagaggactgtatattctgctgttgttgaatgaagtagtctataaatgtccgttatattcaggtaattgatggttttgagtttaactgtgtccttactgattttctgcctgctaggtctgtctgtttctgatagagggaattgaagtctccaggtatcatactagattcatctgtttctctttatagttctgtcagtttttatctcacatatttcgatgctctgttgttaagcacatacatgttagggattgggaaactatgttgtcttggggaaactgacctctttatcgttatgaaatacccttctttttccctgataatttttcttgctttgaactctggtctgtctgaaattaatgtaactactcctgttttcttttgatttgtattagtatgatatatttttctcaatccatttacttttaatccatatggatctttatatttaaaatggatttcttgtaaacaacatatatttggatcttgttttttgatccactctgacagtctctgtcttaatttttaggctgggtgcggtggctcacccctgtaatcccagcactttgggaggtcgaggtgggcgatcacctgaggtcaggagttcaagaccagcctggccaacgtggcaaaactctgtctctactaaaaatacaaaaattagccacgcatggtggcacatgcctataatcccagttacttgggaggctgaggcaggagaattgcttgaacccaggaggcagagggttgtagtaagcggagatagcaccactgcacgccagcctggcgatgaagcgagactccatctcaaaaaacaaacaaacaaaaatgttgccaggcgtggtggctcacatctgtaatcctagcactttgggaggccaaggcgggtggatcacctgaggtctggagttcgagaccagcctgggcaacatggtgaaaccctggctctactaaaaatacaaaaattagccaagcatagtggctggcaggcacctgtaatcccagctactcgggaggctgaggcgggagaatcgcttgaactcaggaggcggaggttgtagtgagctgagatcgtgctgcttcacttcagcctgggcaaaagcgtgaaactctgtctcaaaaaaaaaaccaaaataataatttttaatttagactattgacattcaaagggattactggtatagttggattaatatttcctatatttgttaactgtttctgctttttgtctttgttccttgttcctatttttgttttccattcttctgccttttgtgttttttttgtttctgttttttttttttttcccttttgagatggagtctcactctgccacccaggctggagtagagtggttcaatctcagctcactgctacctccgcctcccaggttcaagtgattctcctgcctcagcctcctgagtagctgggatgccaccacacccagctaatttttgtgttttagtagagatggggtttcaccatgttggccaggctggtctctaattcctgacctcaagtgatccacccaccttggcctcccagagtgctgggattacaggtgtgagtcaccatgcctggaccttttgtggttttaattgagcatttcatatagttttttttttctccttccttagtatttattagttacacctattttttaaactttttaattatttgccctaaagttttcactatacatgtacaacaaatctaagtccactttatttcaaataacactataatgattcacagggagtgtgagtacaaagtaattttaaatcttccatcttataccttgtactatttctgttattcatttcacttatttataagcactcataagcatatttttgtatatgtgctagatataagcatagatgatcaaatacattgttgctgttattttgaacaataaaataatttgttagctcaattaagaataagtaaaatgaaagtttgtgttttatcttcacttattcctccttcagtgctccttctttctttatgtagatatatgtctctgacctatgtttattttccttttctttaaagaactccttttgtaatttcttgcaaagtaggtctgctggcaacaaattccctcaatgttaatttatctgagaaaagttttatttctcctttagttttgaaggataattttgcggggtacagtattctaggttggttttgctttgttttgtttccgttactgctttaaatatttcactcttcttgcttacatgatttctgaggagatgttggatgtaattcttatctttgctcctctatagataatgttttttcctccagcttctttcaggattttttcttatctttgattttctttagtttgaaaaatgcttgcctagctgtagttctttttgtatttatcctgattattgttctctgagcttactggatctatggtttggtttctcacattcatttggaggaaattatcagtcattattatttcagatattctgttcttttctccttctcctctggtattcacattatacatgagttatgccttttgtagttgtcccacattccttggacattatgttttgttttgctttttttcagtctttgttctttttgcttctcagttttgtacgtttttattgatatatcctcaaggtcagagattgtttcctcaattgtgtctagtctactaatacgcccatcagaggcattgttcctttctgttacattgtttttgattgctaccatttcctttttattcttaggatttccgtctctctgctgacattgcccatctcttcttacatgctgtctactttatccattggaactcttagcatgctaatcatagttgtttcggattcctggtcttacagttccaacagtcctgctatgtttggttctgatgctggctttatcccttcaaattgtatttttgccttttagtatggcttgtaatttttcttaataactggacatgaagtacttattaaaagtaatggtataaataggtccttaggaatttactggtaaagtgtaggaggagaggaagtgttctacaggcctatgattaggtgtctgtcacttaaagagcctatacgtctgaactgtgggcttcacaagggattatcagcacctcctattcccaactgaggtggaacaggttagtagattaggctggagttatgtattttccttccccaatgcggaaggctggaattgggtatttctgtttgtctaggtcagttaggctctaataaaacctcagtgggtaggctgtggtgaaatagcttttcttaagggcagatcttgttaagaaagttagagtactctgggatacccaaaatggtttctttttccctccctctgctggatgtacaaggtgattttaatctgaaatttattgtgaaaatctggttgagctctgaagttaaaatcaaatcacaaaaacaccctctgcaccatacccccaccgcatgactgggttccctggagtttttttcttttttgagacagagtcttgctctgtcgcgtaggctgggtgcagtgacacgatcttggctcactgaaacctccacctcttgggttcaagcagttctcctgtcgggaggctgaggcctcccgagtagctgggattacaggcgcatgccaccatggccggctaatttttgtatttttagtagagacggggtttcgccatattggtcaggctggtctcgaacctctgacatcaggtgatccacccgctttggcctcccaaagtgctgggattatagacgtgagccaccgcgcccggccttccctggagtttttaacattcagacttaacgctttctgaacctccaacaattcatcaattatagttcaggttttcctaccctagctctgtttctcacagaggtttctgctcatgagtctgtgctctggtaagccaagactccttgtgtttacctgttcatctctgcaatctagggggtagcattttgtcctgtgtccttacctctctgaaggatccaagatcagttattgattttacagtttgttaactttttatttgttgttagtatggagtggcaactgctaagcttcttacgtgtggaactggaaactggaagcttgtttttttaatacatcaactattaaatcaagcttgtctaacacacggcccgtgggctgcatgaggcccaggacagctttgaatgtggcccacataaattcataaactttcttaaaacattatgagatttttttgctatttatttttagctcatcagctattgttagtgttagtgtattttatgtgtggccggagacaattcttcttcttctactgtggccaagggaagccataagattggacacccctatgttaaatactttttaacgtataacctcattagtggtaaaaattttgtaccgccaggtgagtgaaagatggcatattttcttttatgtccaatttgcttatatttcttttttgctttctctttaggttaatacaatctgttggaatgacactggagaatatattttatctggctcagatgacaccaaattagtaattagtaatccttacagcagaaaggtaaagtagtttaaaaaatctgtaatttaatgagagaaaaaaaatcaagaaggcagaaatgaagaaactgtgaacagtcatagaatgggcatttatattagaatatcctccctattttgctgaggtttattgtataatttagaggttcttaggtacatgtgggtctcttagattacttagggaaacaagattttattcagccttgggatctagaaaatttaaatatactttatttaaatggttaataattggtacaagtgacattatttcaataacattttttgggggaaaatgtgccataaataaagtatgagttaatgagaaaattacttttatgtgttaccttaatatattatcttaacattctaaaaagttacttattttaatgttaagaatagtgtgggtaaagctgccaactttggtcattgtttcgttttcttaaaaatttgaaatttagtcttttagaaaatttacatttaaaacttttaaagacaaaaacagccaaatgactgcggtgtgaatagttcttgaggtactgagaaaattaaaatggtttcaatgaagaaaaaaattaccataagctaataaactccctcactagaaggcaagagatatctaagaattaaataattttctaactctcaagtaactttaattactgtttcaaatagcattccattttatccacagaatgtttcctttacaaggatggtttcagagaaattaagatactgaatgataaagctataaacagctgactgattgtaataaaaagaaagtgtgtgatgttctttacacttgacataacagttaaatgagaaaccttctgttttagaaatatgactaaatagttattttaaaatttgtaagatcttaaacattcaacacatcatttaaagttccagttaagaataggaatatgtatatttcctagctgcctcccaactcacatgatacatttttctctcctgattgtcttaaatttcctgtatcttttttttttttttttttttttttttgtggcaaggtctcactctgtcacccaggctggaaggctggagtacagtggtgcgatctcggcttactgcaacctctgcctcctgcgttcaagcgattctcctgcctcagcctcccaaggatctgggattacaggtgtgtgccaccatgctcggctaatttttatgtttttggtagagacagggtttcaccatgttggccaggctggtcttgaactcctgacctcaagtgatctgcccacctcatcctcccaaagtgttgggattacaggcatgagccaccacgcccagcccaaatttcttgtatctttaagtcttttaacatctattattttaatagtaattccaaaaatgtactccagcttttaattttttatggtagtagcaaccgtgtattggtgattgtatcagtcgggttctagtcaaagaaaccacacagtaatttcaatagggaaagtgtaataaaaagaattactacctatatcaggagattggagtagtaaaggcttggctgctaaaaagtaaaaaggtctctataaaatacagaaataacagatactatgaaccgccactaaccctgggactgagataaaccactgaaaagaagagacccccccgtgctgagtgctgagatttagaccttattgaagagggtgtcatggctcactggatggcagggaagtctctgtgatgtcatgctagtgtaacttgttgcgaattcccctctggaacttggtggaacacctctctctagagcactgagaaatactttttaaggagaggtttctcatcagaggtagtatgctacaaaatgtctagggacgtggggaaatgaggcaggagaagctgtcgggtgttgaactgttcatttagtaggtgggccctggtgaaactgcaggactctggtgctatggtgttggggaaactgcccgtgctggaagaccctggcactggaaaacctgtgcatggttgcaggagctcccattagagataggaagcaaactccgttttcctgcattattctttcagtgctttttactggcaaagcttaacatcatgccaactggcaaaggaaaaatatttgaaggactcagttccattgcataatctataaaagtgaagggtaaatttggaactgagaggaaataatttgataagtggcacagtagtcttacctttatctgcttcttggtattattgcaatgtgaaatttacttcattaatatttaggtctttgaatgaagaagagttccatgaaaattttaaaattatattatgattactataatggcaaatatagatttatatgttggtttttttttaccattctgaccaagttatttaaactttccttagcctttttcttcatatattaagaaagtcattatgtctaaagtcctttctaatattaatattttatatttgtttctaaaaatgttttaaaacatttttgtctattaatttaggttatatagtgatgtttgaatgggcctggctggctgtttgaagctggatcttacaggttatgacttactcttttaggctcatagaatgtaatcttcagccaagtagtttaagaaactggatttttatcagtttacaaacagtggctaggttctagtgaaatgcttcatgatatacaattcgataagctgggataacatatgagttctaattaggttaggattatgttctgattttcattggcttttagcttctgagttcatatatagaggaagtatacagctgtttttatatctgaaaacatggtattagcagtccaaagtgtaatttaaaattttcagttttacagaataaattgtttatttcttgtttttccacacttaataagatatttaaataagtgtgtatcatctatcagctgaaaaagaagttcatattgaggctgtctttaatgggtcgtagttttatttcattaagttttacttaattgtcctggcttagcaaaaaaagcttgatgttttcaaatcctacttctcttaggtcagtaattacaagggtaacacttttcattttattttttattattcttttttgagatagagtcttgctctgttgcccaggctggagtgcagtggcacgatctcggcccactgcaaactctgcctcccagattcaagagtttctcctgcctcagccttccaaatagctgaggctacaagtgtgtgccaccacgcccggctagtttttgtattttttgtagagttggggtttcaccatgttggccaggctggtctcgaactcctgagctcaaatgatccacctgtctccacctcccaaagtgctggggattacaggcgtgaaccattgcgcctagcccccttttcttataatagagaagatttcctgaaataatgtatatgtagaaagctttttgacgatcactattcagaattttaactcttacattatacaaaataatcacttgggtaccaaaggaatgattgttaaaagacctgtttctgttttatttgcttatttttaaagaaatgacgatccctttgatgtatgatttccaatagaatatgtatatttgaaaaaatgatactctttctcatttccagcttgagaaatgattagtcagattttctttttaaagattataatcataggccaagtgtgtggctcacgcttataatcccagcactttgggaggcccgaggtgggaagatcgcttgaggccaggagttaaagaccagcctgggaaatgtagtgagactctgtctctacaaaaaatttaaaagctggatgtggtggcacatgcctgtagtcccagttactcgggagggagtggcaggaggatcacttgagcccaggcgttccaccactacactccaagtctggatgacagcaagagctgatatcttaaaaaaaaaaattattatcataagcctttatagggctttttaaaattttaaaacaccaatgattcattatataggaaaaaaagctttttgaccatgagtcaaatactacctgtttttatagtttgattatttttagatcctatgattttgtgggaacattaatttattgaaaataagagttttgaaacacttagttttttaaaaaaatagatttaagagactggagatattccttattaatgcaattatattttaattatatatagcatagagactccccatcatatactggggagtcccattagggtaccctattatggcataggtgaaagagaaggaagcccagagatggtcttgcaatatcttttgtaaaataaattccaaatatatactgtatacatgatttttcttgatttggcctcagccagctacttatagtcctcagagcttaaaaagttttcattactgtgtgcttttgcttatactcttctttctttctgagatcacctgctttctcgggtatctcccatctacttggtaaatttaaaattcattcttcaaatctcagctcttttttgtgatatttctctaacatttcctggacacatgtagccactccttcatctgtgttcctgtcttgtggataactctattattatattgtattatatttgtttgcatgttgtgcttagatggcaacttctttgagataatgacaatttcttttttctttttgcatcctcaacacttaacattatttatttacctctcatatagttggagcccactaagtcttagtaaaacgagtgtataaatctgtatattcgatacctcagacagggttatgggtcaggtttgaaagggggttgtttttaccaagggattaaaaaaccatcctctactatttggatacttttggactgagcttcaagttttgggagtgttgtacgtgacatgattaagaaggaaagagatgccaactttggccagctatttagtcaaaataaactggtaatcagcagaatgacagatgttacaactagaccaccttaacgtatagtaatcattgcaattatcaatatgttattttcatctcagattaagttactctggcaattatacctctctagggcattatccttagggtgttttcagaataactcataatgcattgatccaaggaaagcacaactaagaagataaatccatcaataaaaagttattattgttattgtaatttttttttttgagacagagtcttgctctgtcgcccaggctgcagtgcagtggcgtattctcagctcactgcaacctccacctcccgggttcaagtgattctcgtgccttagcctcccgagtagctgggactacagggatgcgccaccatacccggctaatttttgtatttttagtggagatggggtttcgccatgttgggcaggctggtctcgaactcctgacttcaggtgatccagctgccttggcctcccaaagtgctgagattacaaggcatgagccgccatgcctggcccagctatcaaaaattataacttcccaagtacacataaatatttttaatcagccttattgctgtttatctgcagtatcatacatacccatattggctgtatagatttggtttcaacaattaaagaacaaattctaaccttcattgaaattaccaactatacatacataacacgaataataattctttgaacaattattcattaataaattagagagtggtacaaaatgaagttcaaatgataggaatcagataagcttattaaggagtttacattttagtgtgatttttgtggacagtcactgtagggttttaaacatgtactgatatgatttatatttttaaaagatagctctggctgcttttggagggtagagtttgaactagattggaagtaggagataggaggccattgaaataatccaggtaagagggaaagatgactcaggcacagataatgacattggagttggtgaaaagtaatttgggatgtattttggcatggctctgctggtggatttgatacagcagatgagggaaagaaaaatgaaaaaaggttccttagtttttgacttgatcaactgtatgggtggatactgatgccattgagatggagaacactggaagaggggagtgtattttgagaggggcatctgaaatctagagatttgttcaaaggaacgggcccccaattttttactcactaaattttaattagtttatttaataagggaatgcttttcaatttatgagtgactgatgaagcagtgaggctcctgcttttgttactgaaattataaataaacctcttaagtggaggtaaatcataaatttttaagagtaatgtctgctgaatgttactaatgcacagccaaagccaatggcctaacaaacgaagtaactaatggctgtatgtagtgtgtagttagctacttggtaaaccaccctaaatctctgacagcgttaaagaacatgatatttatcttgtttaaaggctttacgttaattactctctctgtttcatgacattgacatgtcaggctagttattttacagaatgttgctccatttggatttgtctgattgtttcttcatgagtagattcagattaaacatttttggtgagaattctcaggtgatattgtggtacatgatgttatataatttattcccttattggagatgttgtttgatccctctattttgggttaccctttgtaactaacaagctgtctgtgaagtggcatgttgagactgaatattctttcctaacagtctttcccccagtggtttttatattaattgatgacttctgtttgaatcggttgttgtaatgtcacaaaacagtgatttttaaattgtcatttcttctacatttattaatttacattcttcagtaaataagagcattttctctgtccctagcaccttaaacatttttttaattcagtgttttatagtcaatcactgatgttattctttttgatactcaaattgtcctaaatttgttccatggagatttcaagccaacttagtgttggtgttttgacatttctcttttttcttagcactttaaaaaagcacaacagatattccccactcacctctctattgtatatctgttatggggatatactgtagtttattcaaccagtctcctgtgttttactgttataaataactcagtaaataatctttgacattttttttggtcttattggaagcatatctttggggtaaattcctagaaatagatttgcctagtcaaagagtaagcacatacgtagttttgtgagatattgctaaattcccttccactggtattaccgtttagcattcctaccaacagtgtttaagagtctgttttcacataagcttgtttgtagagtctgttgtcaagctcttgaatttttgccagtctgttaagtgagaattgatatctcagcataatttcaatttgcatttcccttatgaatgatccaagttgagtattttttactatttttaagggccatttgtatatctgcatgtatactgtctgttctggtaccttgcccattaaaaaaaaatcaggtcttgtcagttatttttcctctcaattttaaaacactactaggagaattagtcctttatctgcaacaaattatacaaatattaaaatatcaattttaaactttattactgtcacagtaattctggtcttttaaatattattaattggatgtagggacttctgctgtgtcttatgtgtaccatttcattactttgattttatgaaaataattaaaattcagtttattgttttgtcatcctgaaagggaataacttaatcatttagcatacagtaaatttcaaaagtcagtcaaagtagttcgttgttatttattgagattttatgagtgagtcagataaactaaataaatggaaatatgcatgttttattttcatgatactgttcctgttgatggtactcaatcttattcacatctcacagggaacaaaagaaaatatatgggattctgatttttttaaattataatagcttgcagtctagtgataatctttcactgagatgagaatgttaatgagaatgtattactggctatgattatattaaaaatgaatatttctaggaaataataagttaccattaactgctttctttgtgtgttttaggttttgacaacaattcgttcagggcaccgagcaaacatatttagtgcaaagttcttaccttgtacaaatgataaacagattgtatcctgctctggagatggagtaatattttataccaacgttgagcaagatgcagaaaccaacagacaatgccaatttacgtgtcattatggaactacttatgaggtatggtattattatgattatatgatatatatgtaagtatgtatatttttgattaagtacatacatgtgtagatgcatgtgtgtacatgtacagatgtgtgtgtatgcacatttgatgcatataaattattgacaatatctaggtgtcagcagagcatttgagaaaatgtatcttgataggcttctggataaagttaagaaataagatgcaagtaatagtactctaagatgggtttgtaattgcttgagcaaccatgctgtaagcaaacagacgtttacctttaaagatacctctgttattgtgctgcatgactgtactaggctttacccttttaaacaatcgcttgcttgtgtaaagtcatagccaacatgcttatcaaatttttgtaggatagaagggactccagtagacaaaagaatcagattcctaaaggatattaatgagcttaagacctgagctgaattaaataaggtggaataaatttaagactcaattttagtgctttatgtggttcagaaaaaatgtacaactgagttctcttttatttatgatacagggtcacactgtcactcacactggagtgcagtggcatgaccatggctctctgcagcttcaaactcccaggctcaagcagtcttctcacctcagcctcttgagtagctgggactacaggcatgtgccaccatgcccaactaatttaattttgttgttgttgttgtggagacagggttttgctatgttgccagggctggtctccaactcctgagttcatacaatcctcccaccttggcctctcacagtgccaaggttatagatgtgagccactgtactagcctccagagtgttcttctgaaatacttgcatgtcatttttttgtatcaaattattgataggtttcccattttttgtgttaaactggtatactttttccatcatttgaattccagttcttttatgtcctcatgtttttgtatgtacttatatatatagctagattttgttttcttatccagtctcacagttttggggttttactggagatttatgaatttacatttattgtgagttctgatatatttggatttgtttctatccctttgttttctactttttaaaaaaagtttccaatctccattaaccctcctctccttttaaaagtccacctttggaggccagacgtggtggctcacacctgtaatctgagcactctgggaggctgaggtgggcggatcacttgaggccaggaatttgagaccggcctggccaacatggtgaaaccctgtctctactaaaaatacaggaatcagctgggtgtggtggtgcacgcctgtaataccagctacttgggaggctgaggcttgagaattgcttgaacaacctgggaggcagaggttgcagtcagccaagactgcgctactgtactccaacctgggcgacagagtgagactgtgtctcaaaaataaaaaataaaaataaagtctacctttcgaattacttgagtattttactttttgtccattgtgtttctgtttcttgcttctaagatagacattcatttttgttattctggaggttaccccagctactttcacaagaatatcgaacaaagccaaatatcagtaaatatttctactcttctcttgaataaaggaacttggaacataccttgttccattttatgtgattatattgttcaggatttagttatattctgttttctctcatgaattagatgttattggtttactgttagtgttgtttgtttagatttacctgcatatttactaatacctttggtttacctttccttcttcccatcacacattttccatgttgtatcattttgtactgaaggtacatcctttagcagttttttttttttttttttttttttttttttttttgagacggagtttcgctcttgttgcccaggctgaagtgcaatggcatgatcttggctcaccacaacctctgcctcctgggttcaagtaattctcctgtcagcctcctgagtagctgggattataggtgcataccaccactcctggctaattttgtattttttttaggagagatggggtttctccatgttggtcaggctggtctcgaactcccgacctcaggtgatctgcctgcctctgcctctcaaagctctgggattacaggcatgaaccaccgtgcctgggccacagttttttttttttttttttacatgagagtttgttgatagaaaacaatttcagtttccttttctttccttcattcattctttcctttcttccttttctttcctttgtgaaaaatgtcttttttttttaaatgccagttcttcaaagatagttttgctgggcatggatttcatttgatagttactgtatttcagatggtattccattatattctgacttccattgttgaagttgcaaagtcagacatcagtctaattgtggttcctgtataggtaacctgtttcttttccttgactacttttaattttgtttttctttgccgggtttttttcttattttatgtcagaacagtgtgtcttgatgtgcattgttttttattttttatacttgggatttgttgatgttcttgatgtgagcaattggcatcttgaaaaatgtaagaaattttcagtcagtaggtctttggtttactacttcattattctctccatttttttgtagtctggggaaattctgattagccatatcagacctgcttattagaccttattccatccactatttaaaaattttaaaattgaaatatagaacatataggaaaagtacctaaatcctaagtatatggcttagtgaattatcacaaagcaaatctattcatgtaactaccacctagcacattaagtatcccaaaagctccctttattctgaattctaacactggagttttctgttttttctaatacccctgtttttctgtttttgaacgttatataaatggaaatatggctttttgtgtctttgttgttgtttttgtatctggctttttttgctgagcaaaatcttaactcatttgtgaaattcatccatgttgtgtgtaactataatttgcccattttattactgtatagtattccattatatgaatataccacaattgatttatctgttctatgctgttggaagtttggagaacattgttttacgtgtcttttcagtacacaaatgcacacatttgttagggtgtatacttagcagtaaaattgctgggtcatagaatatatatttggttattttagagataaagccaaatagttttccaaagtgtagtaacgacttacattcccaccaacagcatgtaagaggtcctgttgcttctgatctttgccaacagttggtattttcagctctactttggtggatgtatagtatcatcttaattggtttccatttgcctctctgtgctgatactactgaggttgagcatctcttcaaatgtttgttggttatttggatgtattcttaatgaaatgtgtagtcaaatctcttgcctatttttttctgttgggttgtttgtcttattttattttgttattattaatttataggagtttttgaaaaaatatcttctgcatatgagcctatcttttcctattctgtggttatattttcactctcctagtggtgggggagggtgcggtttgtgtgttttgagagatggggtctcactttttcacccaggctggagagcagtggcatgattatagctcctgggttcaaggaatcgtcttgcctcccaagtagctgagactacaggcatgcactactgcacctgggtaattttttttattttttgtagagacggggccttgctatcttacccaggcttgtctagaactcctgggctcaagcgatcctcctgcctctgcctcctaaagtgctgggatttcagcctaaaatggtgtcttttgatgaagaaaagtatttaatgttgtctaatatgttggtctgctcctttatgattagtatcttttgcatcctggttaagaaatcttttcctatcccaaagttatgaagatattcttctactttaatttcattgctttgtctttagcatttagatctgtaatctatctggatttgacttttgttatagtatgacttgagtcaacttttttttttaccccatatgaagttttttgtgttaacataatttattttttagaaaattaaatcaaaatccaaaacagcacacaaacaaaagaaagaccattttaacatgatagacccatttacccaagatgttttttgccaaatacatatacacactttaattagcatagaatttttttttttcaaaactgatactctgcatctatcaacagctctcctttcttccttatcctagtccctggcaaccatcattctactttctgtttctaagaatttgactattttagatacctcatataattgtaatcatgcagtatttgacttttgatgactgactgatttcacttagcatgatcatattgtagcatatgtcagaatttatttcctttataaggcaggagaagattccgttgtatgtatataccacattttctttattcatttatctaggctgtgtgctgtggctcatgcctgtgatcccagcactttgggaggccgaggtgggcagatcacttgaggttaggagttcaagaccagcctgtacaacaagatgaaaccgtgcctctattgaaactacaaaaattagccaggcgtggtggcaggtgcctgtagtcccagctactcaggaggctgaggcaggagaatcacttgaacccaagaggtggaggatgcagtgagctgagatcatgccactgcactccagcgtgggtgacagagtgagactctgtctcaaaataaataaacaggctgggcgcagtggctcacacccatcatcccagcactttgggaggctgaggagggcggatcacgaggtcaagagattgagaccatcctggccaacatggtgaaaccctgtctctactaaaaatgcaaaaattagctggatgtggtggcatgtgcctatagtcccagttacttgggaggctgaggcaggagaatcacttgaacacgggaggcagaggttgcagtgagctgagatcgtgtcactgcactccagcctggcgacagagtgagactccatctcagaaataaataaataaataagtaaataaataaattcatctagtgatggatatttaggttgcttctactccttggctattgtgaataatgctgcagtgaagatgagtgtgcaaatatctcttcaagatcccgtttccagttttttcggatctgtacccagaagtagagattgctggatcatatggtaattccatttttaagtttttgaggaccctccatactattttccatagcagctccactattttacatgcctaccagctgtgtgcaagggtgccaacttctccatttccttgccaacacttacaatttttttttagtgggcattccagtgggcttgaagttttatcttactgtggttgtgattttcatttccccaaagattactgaagttgagcttcttttcatatgcttcttggccatctgtgtatcttctttggagaaatctcctttgcttttttttaatctgcattattttttgttgttaacataggatttctttatatattccgaatattatgttgttaacataggatttctttatatattccaaatattaacccttttttagatacatggttcacaaatattttcacccgttccatggattgtctttttaccctgttaagtttgatgtagttccacttgtctgttatggctttgttaactgtgattttgttgttatatctaataaatcattgtaaaatccaatgtcatgaagcttttctctgaattttctttttttttttttttttttgagctctgtcacccaggctggagtgcagtggtacaatcgtggctcactgcaccctctgcctcccaggttcaagcaattctcctgcctcagcctcctgagtagctgggattacaggcgcatgccaccacgcccggctaattttttgtattttagtagagatggggtttcaccgtgttgcccagtctggtctcagactcctgagctcaggtaatctgcccgtctccgcctccaaagtgctgggcttacaggcatgagccaccgctcccggcctcccccatgttttcttctaggagttttatactttcagtttgtaggtttagatctttaatccgttttgaattaatttttgcatatgtagggtaagggtctaagttcattcttttgcatgtagataaccagttttcccagcagcttttttcttactttatggattcatttttttcctcaacttttattttagattcgaggggtacatgtgcaggtttgtttcataggtagtattgcatgaggctgaggtttggggtacaaatgatcctgttacccaggaactgagcatagtacccagtagttagtgtttcaccccttccttccctttctccctccctgctctactagttcacagtttctgttgttgccatctttatgtccacaagtatccagtgtgtagctcctacttataagtgagaacatgctgtatttggttttctgttcctgtgttaatttgcttaggataatagcctccagctgcatcttagttgctgcaaaggacatgatttcattcatttttgtggctgcatagtgttccatgtatatgtaccacatttgcttcattcagtccaccattgatgggcacctaggttgattctgtgtctttgttattgtgaatagtgctgcgatgaacatgtgagtgcatgtgtctttttggtagaacaatttgttttcttttggatatatacccaggattgggattgctgggttgaatggtcattctaagttctttgagaaatctccaaattgttttccatagtggctgaacgaatttacattcccaccaagtgtatataagtattcctttttctctgcggcctcaccagcaacttttgtttcttgactttttaataatagccattctcactcatatgagatggtatctcattgtggttttgatttgcatttctctgagattagtggatgtggagcattttattttgtgttcgttggctccttgtatgcctttggcgaagtgtctgttcatgtcctttgctcattttttaagggggttatttggtttttgcttgtttaattttttaagttcttttttttttgagacggagtctcgcttcatcgccaggctggagtgcagtggtgcgatctcggctcacagcaacctcctcttcctgctttcaagcgattctcctgcctcagcctcctgagtagctgggactataggcgcatgcaaccacgcccagctaatattttttatttctagtagagatggggtttcaccgcgtcaaccaggatggttttgatctcctgacctcatgatctgcctgcctcagcctcccaaagtgctgagattacaggcatgacatttttttaagttctttgtggattctggatattaaaccttcgtcaggtgcatagttggcaaatattttctttcattctttaggttgtctgtttactttgttgatagtttcttttgctgtgcagagctttttagtttaattaggtcccacttgtcaatttttgtttttgttgcagtggctattgaggacttagtcataatttctttctcaagtccaatgtctagaatggcgtttcctatattttcttttaggattcttatagttcgaggtcttacatttaaatctggaatccatcttgagttaatttttatatatggtgaaatgtaggggggtccagtttcattcttctacatatggttggccagtgatcccagcaccatttatttaatagggagtcctttccccattgcttatttttgtcaactttgtcgaagatcagatgactgtaggtgtgtggctttatttctgggttctctattctgtttcattggcctgtgtgtcttgttttcgtaccagtactatgctgttttggttactgtagccttaaagtatggtttgcagtcaagtaatgtgatacctctggctttgttctttttgcttaagattgctttggctgttcaggctcttttttggttccatgtgaattttagaatagttttttctaattctgtgaaaaatgatgttggtagtttgataggaatagcattgaatctgtaggttgtgttgggctgaatggtcattttaacgatattgattcttccaatccgtgagcatgaaataaatggaaaaacattgttgctgtttgttgttgtcattgctgtttgtttagtgattttcctagactaattctgttaaatctgcattctttttcaggtgtaggcactggagtctgttcttggttagcttagttgtcagctaagggttagatagagatttctttaaatgccttgaaccaataagccttccagtctttgtcaaaggggcctgtgtgtttgggttgccttcaagtgccttggaaatttacaactctgccttagctttcacttcttgcttgttcagagcctcaaggtcagccagagatgttagagtagggccttcttgggtccttctttggcatgtgcacattcttatatatgtgcataatttctaaattcccagaaatgttttgttgcttttcaaattctactattaatgtctaattcttacttttacttttaactttttctggtcagcttcttgtttccctcacctagtattactgcctcaagcaactgtgatgttaaatcattgctgttgattatttttgacaagcacccttaggatggggttgaatatggtcagattcatgtaagtccttaaaaggcagcttttccagggaacttaaggacagattaaattgtgataagtctttgaggatagggcatttgggggagtctcaaacttgttttgtgacttacagtggctgcgaagttactgttttttacaactaccatagtcgcaaggctgctgttgacttagggaaaataccacaagttaaagtggctcaaggctcactattctttctgagatccagttatttgtcttgaataaatgtttcttggattgttctaatcccttggttaaatttcacagttctaaaaaagttgattttgaaattttgtagtgttgtcagtgcttttatggagaagtatattttcagaggtcttattcagccattgcagaagtgcttcttctgtaacattcttacacttttcccctccttcttgaggaaggttaaattgtgaggaaaggttcctaaatgattcagatttctgaacatatcttataaaggcattaattataagaaatagatacatgttttaataatttaattttataatagtgtgagtacagctcatagttcattaatttgattatcaaattcagtattctagtttttaaaaataaatatccttggaaatatatgcttccaatgatttcatttatagacagtagtatacaaagcagaagtgatcattttacttaataaagtcatcaaagctaagtcaataaattacataaatatttcttactgataaaatagtttcataagtaaactgctgacttgattagatggaatactaattacattttcacaaatatgaaatgagtaaaaattctcattttccttgaaatgtatacttatttaggttgaatatactttttatatattttttgcagggtataaatcttattattctgtgttcattgcaaaattggttcaattgaagcaaaggacattaatagattgaagtttggtaaattaaaaattatgtatagttcattttcatgctgctaataaaggtatacccgagactgggcagtttacaaaagaaagaggtttattggacttacagttctgtgtacctgggaggcctcacaatcatggtggaaggtgaaaggtgaaaggcatgtctcacatgacagcagacaagagaagagagcttgtgtggaaaaactcccattttaaaaaccatcatatctcatgagacttatgcaccatcacaagaacagcatgggaaagacctgcccacatgattcagttacctcccactgggtccctcccacaacacgtggcaattcaagataagatttaggtgagatcatagccaaaccacgtcgtgtgtgtgtgtgtgtgtgtgtgtgtggtgtgtgtgtgtgtggtgtgtgtgtgcgtgcgcgtgtgcacgtggcttaaagtaacaaatttattatcttactgttctggaagtcagaagtctgaaataaggtgtactgggctaaaatcgaagtgttggcaagtgtgtattccttctggtcttgccttttccagcttctagaggctacttgcattccttggagcaagtccccttcctctatcttcaaacccagcaacatagcatcttgagatctctttctttttctctctttttccatcatcttgtctccttctctgactctgactctcctgccttgttttgctcagtaagacccttgtaattatattgggcctctgtggataatttaggataatctccttatggtcaaaatccttaattaatcacatctacaaaatcctttttgcagtataaggtaaagtattcgtaggttctaacaaataggatgtagatatctttgggctactattattctgcttaccacaataatagtaaaccttttaagacaaaagttttccaagtaaatttttaaaaagtataaaacacctactgaaaagtgctggcatcgtgtatttgtgcaacttgattaattttcacaaagtaaaatatatatgtactcagcatctagaacaagaaacagccccccataagtcctttgtaccccctcaaagggtttactgctttctaggctcttaaaagtacaggttagtttgggcctttttacgattttataaaaatgggaatcatactgtgccttctcttttgtgtctggcttttttcacacagaaggtttgtgagattcatttatgttgctgagaatagtaatgatttgttcattattactgatgatttagtactttattttaggaatagataacaatttaatcccagtttattgttggatatttgggttgtttcaagtgtttggctaatataaatagtgctgctgtgaacattctagtgcatgtttttacatgccccatgcaggcgtttatttttagtggaactgctgggttataggagaagcatatgatcagctttaatagatattgatacatagttttccattgcaattgtaccattttatactcccatcagcaatgtgttccgtaactccacatcctcatcaacacttgatattataagtcttttcattttggccattcgggtatggtatagctgtatatctttgtggtggtaatttatatttcctcgatggctgagtttgaatacctttcatatatacagtgtttcaaacataggaatattgtatacagaaaaccatgtatagcagaggcaccaggaactggtttcacaggagacaatttttccatggagtggggatggttttgggtttaaaactgttatacctcagatcaccaggcattagcttctcataaggagtgcacaacctgtgagaaacagttcaccatagtgtctatgctcctgtgagaatctaatgccattgctgatcctacaggaggtggagctcaggtggtaatgctcgctcacctgctgctcactacctgctttgctgctcacttcctaacaggctacggaccagtactgggtctttgggacatagggagagaagaacttattgaggcagggtttatagagagcctcaacttacaatattgtcattgctaaattagaagtggatacaggcatatctaaaatattgtacttcattaaaaaaggtttttatggtagtaaaatacatataaagtttgacatttaaactattgttttgagagtacatttcgttgacattaagtatattcatgttgtataaccattaccacaattaaaatttttctaagaggtgagttatgcacttaaatcatttcagcatcccacagttgtcttaaacgttaccagagaagaaaatttgcttacgtatttattgtacaattataaactcacatagataaaacataaaaattaagctttgaatagtttgaacaagctacctaggggagaatcattcttccctagttgttagaagtttataacttcagataactttttatctgaagttaagttaatgctaatcttcaaagtactgaatcatattaattcaacaattacttcttatctatttctatctgtattgtaccattctgaatcatagtatgggtaagccatgagtaactaaaatgcatggtttttgtaacctttaccttaatcattttatgaaatagtaggaatgtttttcagagccgtctgtttaaatgttcgtatgattatctgcacttttcttttcatcttcagattatgactgtacccaatgacccttacacttttctctcttgtggtgaagatggaactgttaggtggtttgatacacgcatcaaaactagctgcacaaaagaagattgtaaagatgtaagaattaaatttttatacaaatgatgcagaaaaaattaaggttataattaaaattggttataattaaagttataattaaggttataattaaaagtaagttatgtggatggtaagattatgggtgaatttttaaatttttgttttgctaaaatatttaataagcatatagtttataatcagaaattgaaaaatgtaaaatgttaatattgaagttggagaacttatattttaattgtacatttaaaatatatttatgaaaattcaaataatttgttcagtatatactgtctaatataaaaacctgaagaatttatataaatgtatctcatttactcatggaaacagctttgacttatcaaatagcagttataaaagcttgtggtagttgtctttttttctcctgtcttttaaaccaataattacatgttatcttttttaaaaagaaataataagatagcatgctatcaacatgtttgttcaaatttagcccactttcctaaagataatatctctactatcagtttcttatgctttaatacaattaaattaattaattaattttttttgagacaaggtctcactgtgtcatctcaggccggagtgcagtggtgcaatcctagctcactgcagcctcaatcttctgggctcgagtaatcttcctgccttagcctcccgagtagctgggactacgggtgtgtgccactatgctcaactaattttttttttatttgtagtagataggaggtcttgccatattgcctaggctggtggtgtcaaactcctaggctcaagtgatcctcccgacttggtgtcccaaagtgctgagattacagggatgagccactgtgtttgacttttaatactattttaaacttacaaaaggcctgagaaatcattcagtcttttgaccccagacaagtaattccaagtgatttttcctgacatacattattaagagcacagtagtttttccttggatcattttgaagtagtaaatgaaataagaaagtactattcaaaatatgtttttactgaaagttacaaaaaaaaaaggtactactgttaatcaggttaagtgcttgctaactaaaccagttaccaactggttaacatgctttaggggaaaaagattattttatatatttgaaacagaaataaaacaaaaagtagaaattgaaaaacctttaggctgggtgcggtggctcatgcctctaatcccagcactttgggaggccgaggcaggtggatcacaaggtcaggagttggagaccagcctggtcaacatagtgaaaccctgtctctacaaaaaatacaaaaaattagccgggcgtggtggcaggtgcctgtaatcccagctactcgggaggctgaggaaggagaattgcttgatcctgggaggcggaggttgcagtgagccgagatcacaccactgcactccagctcgggtgacactgcgagactccatctcaaacaaaacaaaacaaaacaaaaaaacctttaaacatacagtttaatcagtttttttgttacgtatttgtatatacacagatatgcaaatagggaagcattgaactaaactcagaaataagcttaaatatcacgttattagggttgtttgatatacctgttccttagagtaagtggtgggtactaaattttgttattgcaaactctcttaaactattttagtgtttcagtgtagtaagatttagttgtgtttttctaaacaaaacccccaggaaaataagaaaacaaatctgataagacgtgaaagtagtctttccttagtaaaacttttcctttatgtataaaagtgaaatgaagcagagagtataaagaaaaactggtaactagagtaatccttaactactaaaaacttagaattatgaaaggcatttggttaatgaattctatgtaatgagagtaatgttctgagattagtaattgaacaaagtataaggttaaattgacttaaaaacattactgaggggccgggcgcggtggctcacgcctgtaatcccagcactttgggaggctgaggcgggcagatcacctgaggttaggagttcgagaccagcctgaccaatgtggagaaaccccatctctactaaaaatacaaaatagccaggcgtggtggcacatgcctgtaatcccagctactctggaggctgaggctggagaatctcttgaacccaggaggtggaggttgcactgcactccaacctggcgacagagcaaaattctatctcaaaaaaaaaaaaaaattactgagaagaatgaggagtgagagtcattagacaaagcagtatggaatcaacagagtaccttcaggatatgtttggggtactagctcttacattttctaattcttctacagagataagtaataacattatagtaagacctgtcttttgcagggtttgtatttatatgtgtactttatttttgagctggttaaggagaaaggttttataagtaaaaagtataaaatatagaagtcagttaattttttgttatattttaatagcagtgattacaattaaaatattatgaataagcctaggcaacatagtgagaccctatttgtacaaaattttttttaaaaaattagcctggtatggtggtgtgcacctgtagtcctagccacttgagaggctgagacaggaggatcacctgacctcaagagtttgaggttacaatgagctgtgatcacaccactgtaagcctgggcaacagagcaagacatatctcaaaaagaaaaaaaaatatgaatactatataaataatcaatagttatagacagtatgagagatttgtcataggtagattataactccatctttgctgtcaagtggaccaataatagcaggcatttctaatggtactaatgacttagtgatacattatataggtaattttgaattttttacatttctaaagatgttcattattcatgagtatgggaatatttaacaggcatttttgagaaataattcaaattgtattataacattgtatgaaatgtagctagtttagaaagagttttaattgtcacataaatatgagtttcttggattattaccatctttttgtagctggcgctgttctagtataattactcagtattttcagtcttatatttgaaagtaatttttattttttcctttttagaatgtatttaattgctcaaatactgatcattttaaaaatctgtattttaattaagtttagtattttcatattttttcttactttaattggtttataaggaaagtctacaatattgtggtagaaatcaatcaattttggagttgtatggccaactataaagaaaagagtatcttccttagaaatattgattgagtatatttattttgatttcacataggctgaatgtattagaaatatttctagtagaaatccgaaaaaaaagttaaaagaaagccgtattgtttttccgctcattgtcattcttgactgaattaggagttctgagaatggttattctaattactaatgagaaaatattttaaatataatttcacctctgctgtataactatatgtaattggtattatgttatgttttgtaggatattttaattaactgtcgacgtgctgccacgtctgttgctatttgcccaccaataccatattaccttgctgttggttgttctgacagctcagtacgaatatatgatcggcgaatgctgggcacaagagctacaggtaagaagataatattagagaaaatataggactgtcagttcaaagagtaaatctctatgacattttcagttttaaaatttcttgtttgttataaaatttcagaaaatagtatttgtttaatatggattattataaaaaataacatttcaccaagtgtttatgaccctttgggatgatacttttgcagtttaaaaagttgtaacatttgatgtattagtttggcaggactgccataacaaatgaccacaaactgggtatcttaaagcaacagaaatttattctcttaaatttctggaggctcagtgtctgaaatcaggatgtcttatgattggtttctactggaagctctgttcgatgccttctcccctagctcatggtggttgctgccaatccttggcatccccttggtatagatgaatcactcttaatctctgccactctctttacatgcaattttccctgtgtgtgtctgcgtttacattttcctcttagggcactagtcatactggatttgggcccacccctaatccagttagggtgaggtgggccctggattaggtgggccctaatccagtatgacctcactgtaactaactacatctgtaaaggtcacattctgaggttctgtgtagacatgaattttggggagactctgctatttttcaatcaagaaaacaatggtaaatgtggtagtaagaaaatttaaaacagtgacttgggtatgtattaatgtgtagcatatatttattcctgcttaccttaaagtgctgttaataatgctgagtactgaatttgaatctaatataaactaatgctctttcccttcactcactataggatcaaagtacttccaaaataaacaattagaagtcaacttccattcacattttttcagtaaaggaaggccaggattacacacacacacacacacacacacacacacaaacaccgaatgcacattcatatattcacatattttatattgttaaaaataaaggtggacttgggcagaaaccaacaatgtcagtaaagatggacatagattattgagatgggaataccagatgagatctttcttttcggaactgtgatagcttttatttatattgctacattaagtcacatatctaataataattgaggagtccagtctatttggatatgtacatttaggggaaacagtaatataatatgaaataataggcttaattattgtttctcaacaggtggacacaattgacattttgagcatgataagacttcattttgcaaggttatacagctttgtgggattcttagaatttagcattcctgggcccccagggcacaaagtgccagttgtacacctatctgtcatattgcattgaagactaccagagttaattaaaattggaatagtattcttaactctgtactatataacaggcaaatttcatggcaatcagaaatttttttaaaaagtaaaagttgtatcatcttaaggatattgcatacgttgcatactaatgtatgtagtatgctaataagtattagctttttgtaaaaatttgttatcttaatttggggggaacttttggaagatgacttcgtgtgattgtatttataaatcattttccttgattaactcatttcaacaaagcatacgtaatctggaattctagacaatcatgaatttttttggtagaggtgttacctttataccatattcttttttgttttgttacaaaatctgactgcagaggaagaacctctactggaaataaacgtgatggcttttatttgtattgctacattaagtcacatgtaataattcagattaagagttttaaaaaatgtttttctttaaaacattattaattttaaataacttcttgtttcttttttagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagaggtaggtttactcaaaaccatgtcctttggccgggcgcggtggctcacgcctgtaatcccagcgctttgggaggccgaggtgggtggatcacctgcggttgggagtttgcaaccagcctgaccaacatggagaaaccccgtctttactaaaaacacaaaattagctgagcgtggtggcacatgcctgtaatcccagctactcaggagactgaggcagcagaatcgcttgaacccgggaggcggaggttgtggtgagccgaaatcacgccatcgcactccagcctgggcaacaaaagtgaaactccgtctcagaaaaaacaacaacaacaacaacaacaacaaaaaccccatgtcctttattcaattcagaaaacaattcagtgactcttggggcctaaaggccaaaaaaaaaaattaattttcaaggcacttacagttcagaaaacaaaaaacatgagacatacttgaaagaatagaagctaataaattactatcagttattactaattataattagcaattagttactaattactaatagttactaattactaattatagttagtaattagttactaataatttgtaattataattagtaatgacaaaaatagtatttttgtaatttgtgttataattaatagtaaataattactagcgtctattcttaataatgtattagtaataataaatcactaatttattattggtattctaaatactatttctaaaaccttatccctaacagtgaattattagggataaggctttagaaaaaaatattttaaattatttttaaggagaatatacttgatagcaaaatgtttatcttaactttgtagatgtacagcagcagcaagaaagatcaacagtgctaacacttgcagaaaaggcgattaaaataatagaaaatatgatgataaatttccaagagactaaatgtgtatgtccatggatcaatagaagttttacgtattaccatttactcttcatatatggacagcaatccctttctgtcccaattgtgcctctttcacagttacatactagtgatttataacagtaaccttaggtatattttacaaaataaatataagtgggaaaaagataagttaaagtagttgtatatattgaaaagtaggtgaatgaattactttcacaagactactagaagataatgaatttattatttataaaaggggaaaagtagaaataaggtatctttgacagtacacagctgtagaaaaatgtttgctttaacctgtttaagcttctttcctcaacatgtttttcactttggcttttttattttataatgtcctgtgttattcactttgaactttggcttgtaaaagtcttttgaaattaaccattgatttttattttcagtgaccttttggtattggctcaatgcctattaatacgttttaaaggttactaataacagtgattttggaattcctacgagatacaaaactatattcattcctcataatttcaggtgtagagggctgtaaaattagaaatcaggattactttataaatatactttgagatttttatccttgcagtgtatttatttgaattaggaaattgatgaagaagggtatgatggctaataaaatgatttttgagtttattctggttaaaaacatgaaatctgctctgtcattttgttactgctatgcaaatttccccttgaaatacatgggtaagtaaagttatagtcaaactgtgattgttacataatgaaagagttggaagtccatagacattttaagtgggccaactagttttgataccatggaatacttagccaaaagatatttatataatcagagtgaatgaggctgagtcatgaacatttttttttctgggagacttttccttggtcttgtttgttgcattaactaaattaagaaaaacaatgctgaaagtggatttaaattatgcttgttggccgggcgtagtggcttacgcctgtaatcctagcactttgggaggtcgaggcgagtggatcacctgaggtcaggagttcaagaccaacctggccaacatggtgaaaccctttctctactgaaaatacaaaaattagctgggcttggtggcaggcgcctgtaatcccagctacttgggaggttgaggcaggagaattgcttgaacccaagagaaggaggttgcatgagccgagatcacgccattgcactccagcctgggtgacaagagcaaaactcagtctcagaaaaaaaaaaaaaaagcttattataacaaaccaaacaattcagaggtatacatagaataaattaataatctgtcttatttgtaattctgacacattttggtgttttatactgaaactttgatgatagtattcagacaaacttaactcaccaaatatttattgggtgcctactatacaccaagtcctctacttaactttggaaaatgaaggatgaccagacaaagacatgatctcttacttaaggaattcacagcttagtggaagtagaggtacaagtaaataaatatgtaaaacttaatatagaattatgtataaggactatgttctgtataagtagaacaaagtagggaataattaatcttgagtaaagcctgaggaaggttttaaagcatgagtaaaagtttgttgtatgattttgtcttatgtttccataatatttttgtattttctcaatttgtggaggcctttctatttccttaccgcctctaataatttctttcatttttttcccccttctttctttggttcattcttttgtcttaattttttttgtactttctgttttcccttatttttctatccttttttctttttatcatctctcttttcttctttttgacagtttaccacctgccctaccccattattgggcttctttgttgaattcattctttcattttcttctggtccccatagcttgtgcctaaaaatatactccagatctgactactgcttaccaccacccttgctgcattaccaccctgatccgagctatcagcatctctggcatgacctatccccctttgtagttgattttgctagctttctaaccagtcttcctgctttcacttcctacagccctatagctatacagcattcaaagtgatccttagaaacataagttaaatcatgccgctcttctcatcaacattctaagtggctccctgtcggacctaaagcaaaactgaagtccttatggtggcttcaagatcttatattatctggtcctaattattacttctactgttttcttctttactgtgctctaaccacatctacttgcttagtaactcaggccaagcatgactctattttaggattttgcatttactctgcctgaaatgctcttccctggatacctggattttttcttccctgtgtatttcaggtctttgcttatgtaaccttcttggtgaagccctacttcaccatcctatttaaaatcacggcctttaactgatactacctatccccttttctactttatttctctccataacagtaactttctatgtatattttgctttttcatttcatgtgttgtttgctccatcgggctgtaaattctgtgacattggggattttttgtgtgttttgtccattgttgttttccaatacctgtaatagtacctgacatataaaaggtgctcaaaaaatatttggtgaatgaaacgccattttcagtattcttgcctaggttatttcacatactcagaaagtcaaatttgagattgtttttaatttgaagattttattctataaataattgctgaggttgtaaaaccagttctttggctatgtaatataaaaattcctctctgttgaaaccatgaagcaagattctattatattgttttaagaatagttcgtatgaaggatgaagccctctccttttgggagtgattagttgtttgagaatttgcacagctgccacattaagctttgttctggttattccctgtcacacacttacgtcttcctgtgtagattttactattctcagttgcctttagccatacttacacataatatggaatttatggggatttttttttctgtctcctttgctcaggatgcaaagatttttttctattcatgttactaggtatggtttccagaagaaatcagaaaattcactgttaagtgtcaccaagtttttatcaaaacctgtttaattttcaggaaaaaaaaatcaatgaatgctgtttttaaaaaataaataaaaataaaaagagtgacccacaggatgggagaaaatgttttgcagatcatgtgtctggttacagtttagtatccagaatgtataaggaacacttacagtgcaacaataaaaagacaaatatccaaacttaaaaataggtaaaggatttgaatatataatacttttttttccccagagaagacatataatagaaatggcaataagtacataaggagatactcaacgttattagtcctcagggaaatgcagatcacaaccacagtgagatatcacttcatacccactaggatgactaaaataaaaaagacagacaataacaagttttgacaaacatgtagagaaattggaaccctcaaaaaattagagttattatatgagccatacttctcctcccagatatacaggcttctcttggagatattgcaggtttggttctagaccattgcaataaagtaaatattgcattaaagcaagtcacacagatcttttggtttcccagtgcatgtaaaagttatgtttatactgtaccatagtctgttaagtgtgcaatagcattatatcttaaaaaccaatgtatataccttaatttaaaaatacttcattgctaaaaagtgctaacaatcatctgaacctcagtaagttgtattctttttgctggtggaggggcttaccttaatgttgatcactgctgactgatcagagtggtggttgctgaaggttggggctgtgacagtttcttgaaataagacatcagtgaagtttctgcatcgatagactcttcctttcataaaagatgtatttgtagcttgtaacggtgtttgatagcttcttacacacaatagaacttttctccaaattggagtcagtcctttcaaaccctgctgctgctttatcaactaagtttatgtagtactctataatagatccttttgttgtcatttcagcagtgttcacagcatcttcactaggagttgcttcttacggatgagcaaagaaagtggtttgcgcctcaagaaaccactttctttgctcatccataaggagcaactccttatctgttagttttatcatgagattgcaacaattctcacaccttcagtctgtacttctaattctagttcttttgttgttttcacctcatctgcagtgacttcctctactgaagtcttctacccctcaaagtgatccactagggttggaattaacttcttccaaactcctgttaatattgttattttgacctcccacgaatcacaaaagttcttaataaggcatctagaatggtcaatcctttctaggttttcagttgacttttcacagatccatgagaggaatcactatctgtggcagctatagccttacaaaatgtgtttcttaaataagacctgaaggttgaaattactctttgatctatgggatacaatgaaaatgttaatctccatgtacatctccatcagagcccttggatgaccaggtgcattgtcaatgcccagtagtattttgaaaggaatctttttttctgagcagtaggtctcaatagtgggcttcaaatagtcagtaaaacatgctgtaaagagatgtgccctcatccaggctttgttattccatttatagagcagattcaattaaacataattcttaagggccttaggattttcagaatggtaaatgagcattggcttctgcttaatgtcaccactgcataagcccctaacaagagaaccagcatgtccttcgaagctttgaaggcaggcatcagcttctcctctctagctgtgaaagtcctaaatggcatctgcttctgatagaaggctgtttcatttgcattggaaatctgtcgtttagggtagccactttgatcaattatcttagctagatcttctggataacttgctgcagcttccacatcaggacttgctgctttaccttgtacttttatgttacagaaagacagcttctttccttaaactgcatgaaccaacctctgttagcttcagacttttattctacagctcccttacctctaacagttttcatagctttaaagagatttagcgccttgctctgggttaggctttagcttaagggaatgtgatgactggtttgatcttccttctagaccactcagactgtttccatatcagtaataaggctgtttcgttttcttatcattcatatgtccactggagtagcacttttctaaaagttccttccagaacttttcctttgcatttacaaatttgctaactgtttggtgcaagaggcctagcttttggcctgtcttggctttcaacatgctttcctcacttagcttaatcgtttctagcttttgatttaaagtgaaaggcatatgactcttcccttcacttgaacacttagagaccattgtagggttattaactggcctaatttcaatattattgttgtgtctcaagaaattggaaggctcgagagggagagagatggggaaacagctggtcagtgaagcagtcagaatacacataacatttgtcaattaaattcagagtcttatatggatgcggtttgtggctccccaaagcaattacaatagtaagatcaaaggtctctgatcacagatcaccataataggtaggataataatgaataagtttgaaatatgagaattactgaaatgtgacacaaacataaaatgagcacatgctattggaaaaaatagcaccaatagtcttattcaatgcagggttgccactaaatttgtaaaaaaccacagtatctgtgaaattcagtgaagcaaagtgcaataaaatgaggtactatgtttcaattcttttgggtagttctcctgtatacccaagagaattgaaacatgttcctacagaaacttgtacatatgcttaattcagcattattcataatagccaacaagtggaataagtttgttcgtcaaccaattgacgaatggatgaacagaatagggtatcttgctaaaatggggtattatgaaaaatgaagtactgatacctgctacaatatgaataaaccttgaaaacataatactaagtgaaagaaaccaaacacgaaaggccatgtattgtatgattatttatatgaaatgtttagaaaaggcatatccacagagacaggaagtagattagtggttgccaggagctgagcagagggatgagtggggagtggctgatgatggtttgtttctgggatgatgaaaacggtctggaattatataatgatgacggttgtacctctttatgaatatacaccactgaattgtataatttaaaattatgaatattatggtatgtgaattatatttcaatacaaaaatgtttaaaatggatcagatgtggtggctcatgcctgtaatcccaacactttgggaggcagaagtgggaggattgcttgaggccaggagttcaagaccaacctgggcaacatagctagactccatctctaaaaaaatttttaaaacagctggttgtggtggcacatgcaccaactactcaggaagctgtggctggagatcttattagctctggagttggagcttacagtgagctaggatgggaccactgcaatccagtctggagaagagtgtgagaccctgcctggaaaaaaaaaagttaaaaatgtaaacattaaagggagcggtcaagagtgataggtgccataaacatgtcaaataagctctgaaagatgctgtttgagttggcaattgattattgatcatattattgaacactttataattgatcagtgaacttggcaattgatcattcactggtgactggtgagaatgaagttagtggaaagataggaaatcaatggaaagattgactacagtggattgaaggaggagtggtagattgaatatagaattttctcaagaagcttaagtaaagtgatagcaagagaaaggactgtagctgtaaaactgagattttatgaagttgaaatattgttttttttcttaaaaatgataagaacctttagcatgctgtggcaaagagccaagagagagaaaatggatgtaggtatagagaagagagaataattggtcaagcaagatactcaaggagttgaaggaatgaaataaaaagcacagatggagaaattaggcttaaatagaataaatgatacacccttcaagaaaggctggaaggagttagaaagttgtagatgtagatttaatttatagaattcagctgaagaaaatgatgttatttttattttctctgaagtaggaggaaaaattgttaagagggcaagaatgagggcagcaggatggaatagatagcctgaggcaagtcataaagggtcgcaatagattctgtttgggaaccgaagagtaaattgtcaataatgagtaaattgtcaataataaataaaaataatgatggttcccattgttaattaggtatgtgggtaatttaactagactatatttatcatcacaatagaaaactaaggctcaagatggttaaaaatatcttccttttgtcagctggaaggtgatacaggtgggattagaaatcacatatacatgatttcaaagttgcattcaggctctttaggttgaagatattagatataggctgtcaacatcagtggatatttatcctcagaatgaatgctttaaaagactgacgcttataccagtgtctttcatattttcatgtagatctaatttgcatactcaagaagtagggagatggaaataaatagacataaagtatgctttaagagttgagagtagatgagttttagacttacatagaatttacccgttcttattttttagttgcgacaaccaccagttaagcgtttgagacttcgtggtgattggtcagatactggacccagagcaaggccggagagtgaacgagaacgagatggtaactatactttggtcagcttttctttgtatatggtattttaaaattaatattttaacttccagtttcttcactattataaattattctgtaatgaacattcttatacatataggtatacttatgcaaatatatcttaggataaattcttagaagtggaatggcgcagtcactggataagtaccttttaattttggtagttgttatcagattagtctccaaaaaagatgtgctaatttacattcccactgaaagtataagaatgcccattaccccatagtacgttgggtattgtcagactttgcagtttttgcctttctattagatattaagagaaatgaaaactcagcccaagggttttatattagcacataaaatgttttctatcaagtgcctttgataagcataagaatcaaccctgggagctttaagatagcacacttgaaaatagaattaatctatgaattataattctatattattatgttttattaaattggtctgtaaccaaaatcttactataatgacttctgaaacatctcttgtgatcaaaagcatattccccaatatatgagctacattatataaaggcaataaagtgtaaaagaaactctgatttcacagaaaatgtaagaagaaccgattttcattttaaattataagactatagaatagagttgtcacattttgaatttgacattacacttttaatttgaaaatacccttggaaaaacttgtttacttgcaggaggaaaaggagtgagggaagagacaaaatactttctggttccagttaatttcaaatatctgaaatttgcttacagtaaatgatgttgaaaataaattgactttaaggaaacttcatgcaaaagcataaggctattttgtgtctgtacttgattataatgctttagggagagggaaaacctttcttttaatctattaaacttagaattcatgagcctttcttggctgggtactcttagaactaaaaatttaggttgaggtaggaagtgggaggtttagtggtacctaagaataggcaaagatgaaggagaggtgagccctgttctcaagaaaccttaccatacacatggaaagtcactgatataaacaattactataaaatgtgatgagagctctaatagatttatatacattcatacaatttatttaggaaatttgatttttaaaaatatgctttcattttaaagcccttcaaatctaggtttttgtattaatgaaagattctgacttattactaaactcactgataagacctatattgtaataggagagcagagtcccaatgtgtcattgatgcagagaatgtctgatatgttatcaagatggtttgaagaagcaagtgaggttgcacaaagcaatagaggacgaggaagatctcgacccagaggtaatttttaatgttaattaaagtcatcagaaagctggcaaaaactacttattgaagccagtttttatttctatcatgtaaattataccatgttttacatctgtaataatcacaaggttcttattgtgtggtgtgaagtagtagagaataaaagatattggatataatttgtcccttctggtgccattggacctagtgcgtatcttttgcttttctcaaagtaaagtagaagaatctgaggtttcctattttaagcctttttttaatgcactctgagaatggaaatatataaaattctgtgtataaacaagttttatgtaataggaaagattgattgctttaacaagaatatgttgtagataagtttttatccctcttgactggcctattttgtcaaatgggccaaatcaccagtagttattatcactgaaattatatatttgtgtgtgtaaatataaatgtgttttctgagcatatctgtttagagttgttggttttagaaaatatttaaaatttgaatttgccttaacatgtgttttgaaggtggaacaagtcaatcagatatttcaactcttcctacggtcccatcaagtcctgatttggaagtgagtgaaactgcaatggaagtagatactccagctgaacaatttcttcagccttctacatcctctacaatgtcagctcaggctcattcgacatcatctcccacagaaagccctcattctactcctttgctatcttctccagacagtgaacaaaggcagtctgttgaggcatctggacaccacacacatcatcagtctggtgaggataagtatgctgtggttcatctaatgatttttgatagtgaaaatttctttactggctattttgaaagatactaaatcacatcaacttcttgttggaataaatgatcaaaatgacatgtaatatatggttatgtaacttaaacacaaaaattaattatgtcttacttgcatgaattttaacaaatagcaggaatcttcaatttatataaaacaattgttttaaaagtacaagtaccaaaagatagtgttttgacatagtttaatgtgcctgacttaaatattattttatagattattagagaccaaaatatctttctagatttatttggttttatgtctatattaaagtgattatgaaaatatcagtattagtttcactttgcttatattcttgattatttccctcaaataatgcagtacttttaatatactctctatggtggatttgatatggtcttttgtcaacaacatataatttaccaaaaaatttgtttctctagtatttacatgaaaaagaattattttaccaaatgcttatcttcttgatacttgatgctagtgaaaataacctctacgttctgttaaaatgctatttttttctcagtattataagtctttatggtcaacttttttcccctaactatggaatgtgctagtatttataatagtaattttcagcagatgtatctacagtttactcggtactttaaactatatacatgtaattataaaaaccaataagatatttattcatagttttctttggttcttctaaggaagaattttactcaatatagagccagaattattagcaactagaaatatagctggcaggcctaagctgaaacctataaaaaaatttctaacagcttagctgccaagctgtcactttattcttacatctctggaaactgatgccagattaccaaatatgggatgttttaatttaagcactcttttatcagtatataccacttttagtaattcattttcagtttctatgggaataaaagccagagtcagttacataactgttaacactgtatacattttatccataataataagctaaagctgagctacagaatcaaggttttcacactcagttgacatagcattttaatttatggaaaaataaaatattttggaagatttgggaattaaaagcagaagtagttaaaagtttgtttttcaaagcaggtaaaattgggaaaagcaagaatttttaaagtgatattcttgaacatattgatcaattataagtttttaggaaaacttagcaagaagactctagcttacattcagcttccactgaatctcaactaattctagttgtttcttaaatatatttatgagtaaagtatttggaactttattttttaaagctatctaatgcattttaattactgcatttcaaattgctaaattcctttcaatatttaatgtaagtattaaatgtgacaatcatttgaattattgaagaagaaaaaatatctttggtggtcatgtgatgattattgaaacattatgcagtacttttactcataaattatttataggaagtaaggaaatatttttaactgggagattattgagagaattttggttgactaagctatagataattagaatatttccatgttatcaagacattatcactattgagaaaaatgatttggtgttagatgtaacatctgaaggttatgactgtagttgttctgataacagctttttcattattctggagttcaacgtttcaggagtaaggacttaatttgtttctgtttttgttttttgtccaatctcttttgcatttgccatagcctaagtccaaatgtgtttgtgaatattgggaattgtccattgggtgaatgtagtagatggaaatgtcagcttaggaccatgatttctattatttccctgcatagagatagagaaaatgataaagtatacttctgtctatgcttgccttgctgtggatacctttttatgtaaatgtttatccctttacatgtcctccctcatttttactgatatcaaagaaacggacaatgggaatatgaaaatttgctacgctccatctctggttgaacctaattgtctgccttctcttagtctacagtggaatcactgaatgataatgaagaaagttatgaccacaaatttcaatgggtgctcaacactgtgcatcagagcagcctcacactgttgctctccagctgtacaaaatgactattttacactttcatgtctctcaaactttaatacttcccttcatccccgccccacttccagattctaacctttcattcacaatgaaaagtactcgttttcctactgtcaataatttcccagctttccaacatctgtactcacattgtgatagaagcagaaagctcctatcaaaagctagtcaatgtagttgctatccctttccagcttctcaaagatttcgccccttctcttgcattatcattgcctttttttgccaaattgtttcttttggccttaacatgctcttattatctcctttctttaaaaattttctcttaattatctcacattccccttcagctattgccttatttctctgctgctttcgtaatgagaatcctcagaagagttgttgatagatgctctctccattttcttgccatccttcatttatttattaaccaacccccatctgcttttcaacccccttttcctctgaaacttttaatcaaagtcactagtgacattcaccagtttaaaggatatttctctgttagtaccttactagatttttcgacccggttgcatttaacataggctgtcactccttcttgaaacactttcctttcttggtatctatgatatcatatttgcctatttactcttattaattctggtgggttttcagtaactgttgttcgtgtttcttgttctatctccttctgaatattataatcaaaccccttagtttgggctctcttctcttctctttacatacactctttctctgggtgattgtgtcagttcctcatagcttttaatatctcctgtaaattcatgactcacaaatatatatatcagcaatctgatcttctaccctgaattccagacccttatgcctgatgtctgactgctattttgacagtatgtttttgttattgttgtacatctttttttttttttttttttttttttttaaagacagtctcactctgtcacccaggctggagtgcagtgcacaatctcaggtcactgcagcctccccctcctgggttcaagcaattctcctgcctcagcctcccaagtagctgggattacaggttcctgccaccacacccagcaaatttttgtatttttagtagagatggggttccccatgttggtcaggctggtcttgaactcctaacctcaagcagtccatccgcctcggcctcccaaaatgctgggattacaggcatgagccactgcacccggcctattgttgtacgtcataaatctacatgttcaaactaaaacttaatgcagcctcctacccttcctgttccgtaattggctccttcttggtccatttgcttatttgaataacctgtgagtttttcttgattccttccttttcctcaagtcccatgccagctcatcagcaagttcttttgttcctgtatctaaactataacctgggtcttttcatctcaccatcatttcttgtctcctaattaatctgcctgtacctactgttgttccattataatgtattctccatgcaggagccagaatgagtattttaacatgttaaatcagattatataactttgctgtttaaatcccttcagaagttcctaattgcatttggaaatacaactacaaaagaaaaaaaaatcaaactcctcactgtggacgtataagaatttatatggcctgcccttccctgtctctctagcctcatctcattcaattttctcagtacttgatgattgttacactctagatgtactactgatttctttcggttatcagagaatttccgtgccaaattctgccctgccctgccctgccctcccccgccccaccccgcctccaccctgcccccaccccctcccctcccccctccctccctcccttcctcccacttgcttgctttctctctctctctttctctctctcttttctttcttttcttccttcttttcttttctccttccttcctttctttctttttcttctttttagacagagtcttgcactgttgcccaggctggagtgcagtggcgtgatctcggctcactgcaagctctgcctcctgggttcacgccattctcctgcctcagcctcccaagtagctgggactacaggcgcctgccaccatgcccggctaattttttatacttttagtagagacagggtttcaccgtgttggccacgatggtctcaatctcctgaccttgtgatccgccctcctcggcctcccaaagtgctgggattacaggcgtgagccactgtgccctgccattttcttttctttctcttctcttctcttcttctttccttccttcctcccttccttccttccttccttccttccttccttccttccttcctttctttctttctttctctctctctcttttgtttctttctgtctctctctctttctttctttctgtctctctctcttccttcctccctccctcccttccttcacttcttccctcccttccttccttccttctttcctccatcccttctttccttctcctctttctcctttttctcctttcccatctttctctctttcctgtcttttcttttctttccctctttccttcttacactttgttcttagtgttattctctgtatgcttgggaagcccttgtcctggcttatcacttggccaacttccttttccttgagtctcagctcaaatgccatataagacaagtctttcataactaccctaggtaaagtcctctttcctttttcttcttgctgaaattttattctcttctatataaccctgtttattttgtgaaaagcaattataaaaatttataattttcttttactatgataagctctcttgaagacaggatattgtctatcttgttgtctctgagtaagcatcttttttccccaacaatattcaccctctaaagatacgattaaaagtgtgatgagacattttgttatctttaagctgatatagactagatagggtatatttagctttattttagtctttagattatacttttagccccagtcatttactctggctgtttccattaagtttccaaaatttggtaacacctagaagagagatgctgtgattagctgtctaaccatttatcattttggatccattgtttgcctttgactgtctagaccacataggactgagtagataattgttcttaggttgttctgaagacattttaaggtaacttacagaaatactttaaaaaattgtctcattatatatatatatatttgtttgtgctttttcactcatgtatatatgggtgaatatgggtatgaaaataattaattgaagcagtgagtgagttgaatacgcaaaatgaatgccctgaagaatggtaaatctagaggggtcacagtgttggctttggagttttgtagctaaattaggaaggtaagtagactgaaatggaatttaaaatcagttgatggatttttttttttgctttaccctttgtattcttgaattttattttaattcatatgtcagaccatttgaaaccacgttctatatacctcgcccagaatttgaagatattttgatttttatatatcttcttttcttgaacatttaacaaaagactgctttttaaaatgtgattataaaattatatgtttaaaaatgagaaagatacgaccatgagctaaaactgtataggttaaaatgaaatcttcataattttatttataaaaaatatttcaaaataactatgaatattttcttctcagtaaggcctatcagacatctctttcagttatttcttaagttaagcctagaaatgttttcatttagttcatgatttgtaaattattctcatgttaagaatcttttcataatgaaagagtattaaatgaggcatttttccaagtgtgctatttaatttttttctttggtttcattttaacctatttaaagaatatgatttagagaagctggtaactttgaagtggatggggatatcagtatatataaaattcacctttagggctcatattgagaagtgaatcacttaaagcttccctgccctgtgtttttaattaaatagactactcagaccatcagaattttttttttttttttttttttttgagatggagtcttgctctgtcaccaggctggagtgcagtggcgcgacctcggctcactgcaacctctgcccccgggttcaagtgattcccctgcctcagcctcctgagtaactgggactacaggcacatgccaccatgtctggctaattttttttgtattttagtggagatgggatttcaccatgttggccaggatggtcttgatctcctgagctcgtgatccacccgccttggcctcccaaaatgctgggattacaggcgtgagccactgcgcccgacccagaattttttaaagatagcatatgatgtggtctgtgtgtggattcttgcttatttagtcataaacaggaattacaaatttattttggcctatgtagaattattatagctaaattgagctttgtagaaaaattgctggagaagaactctgttgtgcaccatatcaaagcaaacctttcaaagccccaaatccaaattatagcttccttaaatgggataaaggtctagtctagtctagtcagatagatataggccatttataggttagaaacaagtggagagaccaggtgtggtagctcatgcctgtaatcccagcactttggaaggccgaggtgggtggattacctgaggtcaggagtttgagaccagcctggacaacatggtgaaactccatttctaccaaaataaatttgttgtgcgtggtggcatgtgcctgtaatcccagctacttgggaggctgaggcaggagaactgcatgaacccagtaggcagaggttgcagtgagccgagatcactccattgcactccagcctgggcgacagagtgagcctctgtctcagaaaaaagaaagaaagaaagaaagaaacaagtggaaatattaggtcaatggccatttttggggaaaccaaagaagagaacagagaaacatggaggtcagtgaagaagtgaccagtcccaggagaaaaaatgcacaaggatcattaccaggacaagaaataagttgggactagaagacagatttatagcaggcagataaagtgccaccaaattagatataaaaatgatccagagtccaggacaaaaatactgtatgtattgtagaggcaggatgtgaggttagaaccaggtggacctttgttgcgtcaactgtagctgtttttgttgttcttctgtctcactggaattaagtcattaggagaataacctgtaatctttcagaagaaaacaagaatagggtttgtagtttgaggagatgacaaagtacaattttcctgtggcagtttataataccttgttgaatttttatcatcgttgtttttaaaattcaacccaaggtatttattgtattcaattttcagtttgggtcatgttgacaaaagctaattctccaagcatttatctacatttataaattatgtatgtttgtgatatctttttaaaggatgtaatatgtgtgtatgttgactgctttaaaatttcaagctgctagcagaactgttatttagtctgttatgtctggttgaattttttaattcaatacttgcttttcctagttaacagctatgtggtgacttctcttctgagcctgattttgtttttaatccaaggagaaaaaagccaccatacaagcagctttcaaagcagataaattcttatttaaaaagcaccggaaatattgaataaatggttcataagattatcacaactaaatcttgatttttttcaagttttagagcatcactacatgtactgagatcttgctgtttgccacttcaccaagtgggttctgggatggagatttatgtcttcataaaacatttggtaactcaatagagagggttgacactccaatgaaattgatggtatttttctgcttttttagcaaaatttgacatatatggcctctctcatagatttcttttgaagtgtgaagtgacaaactttatggctgtataataatgctttattttatattgctaaaagcattactattatgctgactataaataaggtgtctgtacctacctgaaaagaaagcagtatgccactgagcatcaccatttgtttgtcaatgaatactaccctattggtactggatcattttctaggaagaactaacagtgagtgagtatgatgttatgagttattaaatcttaactaccaattgggtaattgaataaaatgctttataaatagaaaccatcgtaacaagaaattagtacctggcgttattgatttctgaaacagtaaaccaaattttttactcttagtatctggagaggctgaaagtttatttggtagtttgtataatttcatgctagtgtcagaaattctctatgctcctaccaccaaatctcactattgacatctctgtgcatattttctgcctccctttgattataattaatgaggtttttatgcacctattcaaaaccaattcctcctctgatacactggaacttatctcctttagtttactcagggacatcattcctgtggttttccgcttttttttaagcatcatctttctctctccttcagttaaacattctccatcagaatacagacgtgtgtattagctcccaaactaaaaccacaaacttctcttgattattattattattattttttggtgggtcttcctctgttgcccgggctggagtgcaatggtgcagtcgtggcttactgcagccttgacctccctggctcaagtgatcctcctacctcagcctcccgaggggccacaagtgtgcatcaccatgcctggctaattttgattttttgtggaaacaggatctcactgtgttgcccaggctggtttcaaactcctgagctcaaagtgatactctcgccttggtctcccaaagtgctgggattacaggtgtgagtcacggtgcccttcctgccttcccttgattctttataaccctgacaatgattatccaatttatctgttctccactaatagcaagagttgtacaaagaatatatatactttgtgtctctacttcatcacctcccctttctcttaaacctgctgctatcagattttggtccttattatttaactaaaatagctcttgtcgaggtcatcaatgacttccatcatacaaaatccagtgattagcccttagtatctcttttagtatactagcagcatttcacacaactgcttactccatcctttttgatacaatttcacgacttagcctacagagctctgatcattcagttctccagctctctctctggcttttccttcttactctttctagaggttctttttcctcttaaacatttgactgcctcaagattcagttcttagacctcttctgtgtcatcccttactctttaggggacttaaaatgacatccaaatttatatctctgaattgtagacttttgtattcagtccctacctaatttctccacttggatgtctattcattctttcccccaacactacttgtttctccattgttccctgccgtaataaattggttacttgtttttcccgttacctaggccaaaaactttgggatcactctgcatccaaactatcagcaaattctactgcttttacctttaaaatgtattgcacattcctatatgctttccccttgagtatttgcacttgctcttttctccacctggaacactcttcctccaggtatccatgtggtttactcgcttatttcctcgaggtgtttgttcaagtggtgccttatgagagaagctttcctgagttgccatatataaaataacccttgccctgtcatcattattcactatcccctttaccttaccctgccaatttaattcatagcagttatccccacgtgacacaaacacatatgttcaacatcatgtgtgcctgtgtattcgcaaatgtctttttctctcagaacattaactccacaagaataaggactgttttgttcaatattttatttatccctagagcctaaaacaatgcctcatacatagaagacattcagtaaatatctctttgcagaatttaatgttatttttctacttttcatctgtgatcacttcagataaaggttaagaaaatattgattatgtaaatctttttgaacttaaaaaattttttaaaatgacaattctaacatgaaatatttagctgaagaatatataactcacttttttagagctcttctcaataaattctgagttgtttctaaatgcataagtttttatccttttaattgaattttgttatttgattgaaattaacaaagcagcttaaatttttgtgtataaatcagatgagttaactgattgttttcaatttctgtttctttcctagtatcattttgttctatgttcattttgaaatcttttgcttatggaggactttttatttccatttggtttaattacttaaatattcctagagaaatatatgtatctaattcatcgtagttaaatagaagcatttggttgtatatgtattgtctcataatttaatgaccagtaattttttatcagtaatttgtttatagtattcctctatgagacatgtgttttgtttatatccttcttcttttttaatgtataatcaaattcttattattttctattttattactgtcttttcacctttcttttcctatttgtgtcagaatttttaaggggccctgagatagctttgcttcgtaagcgcctgcaacaactgaggcttaagaaggctgagcagcagaggcagcaagagctagctgcacatacccagcaacagccttccacttctgatcagtcttctcatgagggctcttcacaggaccctcatgcttcaggttattaatgtcaagtgtccttaagcagctgatagaattgttttttaatactgctactgtgtaataaggtgcttcccttttcccattcaaaaagagagctaatgcgcttgcagcttacccctcctttccttgcatatgggtggtattcaacatcacgtgttagggggacagattggcagcagcatctgccagagaggtgaatataaaataatcaattttaaaagttgtaatatatttggagaggggcaaatatttattacttttaaagctgatgacctctttttgaataattagtgaatttagagcctgcattgatctttctattgaaagtttgcatatgctgaaatgaatctatgctttatggctcctagctcttcttcttcttcctctttgaatgttagccaatattcctaaaacctagtaatgctagattttagaattatagtattatttggccatactagcatgctgactaaattatttccttctgtcattatttgaaaattttcaatatttgctttcttattcctctatacgtaatcaactttctgatgtgtagggcagcaaaagtactccacagtctcatgttcttattatgctataaaactgtgataacatagtaaaaattgtcactctttttttctcaatgagtgttttaatgccctgtcatcttatgaccagaaagttcatgatgctcaataaacatttgttaaaagaattaatgaaagatatattaatagcacaaaataatttgtcaacttagttatttcaagatgggtaatagatactgtaaatcctatagtattatataaatactatagtaggtataataagttatttaggaacaagaatgtctaggttctcatactaatcagtttataatgctttgtttgatatgctttcttctgctaccctaaagagtgatgagtttgggctttgagagttctaatttgattatttggaactaatttatatattggtagaattggacaacctgcactttataaatatctgttctagtaagtgctgtggtaacaaaagcacattttatatgtggtaaaattaaataaatttaagtcattgtaatatagatatgatgtttgggataaatcataaactttatttttaattcaatgttatattaatagagggagtatcaggcagaggcctctgatttttttttttcctatggggaaatattttcctatactttaacaattaacaagaaaatttgaccagattacaataatgacatttaataataaaacatttttgtttttttttttgctgtatataaacgtctagcaaacatgttttgaaggttaaaaaatcatgaaacctaaaagtcaatagaaagaaaaataaaatgtccctacgtatataattatttttaaaatactaaaatttagcagattacaaacttagtattaaaatgatcttgagtataaaacaaaactgtctaacaggaaagaagtatacattgtagatgttggaaaaatattttgagattcactaatcttttgtaactagttcacggatttgaattgaagcaagctctttttagaatcagaaagctttagagtgaatgtgtggtttctgtgaagtaagatgctgtctttccaactcttaagtgttttctaattaaatatctagtttggcaacagtagaaattaaatttatgaaattcagcaggagggtaggttttaattgagtaacaattataaaactttatcttatacataataattaaatgcagttttgtatatggacattaattgattcattcttttatgatagatgttactactatctacccatacagaaagcaccaaaattagcctcctagattttaatttattaataatagaagaatgtgcgtttctcatatgtaagaagcatatttttccttcatactttggtatctttagagtatcaattagtggtgatagtgccagtaaaacatatttctgttgtcttctcacctatttaagtgttttagctataagatgttcaaaggagacattactatgatttggaaaccaagaaattttaaaaagtatagaaagaatttctgcattacattgtttggcaaccattttattctcttttcaaaatatatagaactcatgggaatattctgtgaaatcagtaatacctaattcctgtaggaaagttagatcaaaccttgaaaccactttgtagaaataatcacctacatttttagtgggctcaaatgggaaggggcctgatgctggtttaggataatcccagatggaatattatctatttagttgctgatatttcttggcaattgaagactaaaacaccattctaaggcaccaaatgatatcaccttaagtttcaaactgtttaaaatgagctgtataaaataggtattagaagatgttaaacagtggttttttatttatttttggttgttcactctttgtcatcagtcttatgtggaaattccaatagaaagtatataaaagtagcactgttgggacttaaacatgaaacaaggagcgactacccacctgcttgctcctcctgctacccctaaagctcctctgctccctgaagcccagtttgaaaatcagtgctttaaaagaatttttgacacctgtaaatgataattctttagaactaatttccaaaaatatggttttaaaaaattagaatatatcatttaaaaatattttcacttgttagttttttaaaagtatatcttttctaggaaatacaccacaactcatttaggaaatacaccataacttgttttctagacttttaggaaatatgcaggaactcataaaatccttagcaattttttttaaccaaaaagaaatgaatttgcctttatcacatcagtgcctgggaattagattggctgaactcttgtccctggctttatgactagatgaccttgggcaggtcatttgactgctttatgcctcagtttcccaattattgatttatttagatagtgtagcttgctgtaatttacagagaccatgtaaggatgggttaaggcaatacagtatatatgaagttacctacctgaggagagcagtacacatgataatgtactctctcttttttttttttcttttttgagatggagtctcgctttgtcgcccaagctggagtgcagtggtgctatcttggctcactgcaacctccacctcccgggttcaagtgattctcttgcctcagcctcccaagtagctgggattacaggcatgtgccactatgcccggctaattttttgtatttttggtagagatgggatttcaccgtgtcagccaggatggtcttgatctcctgaccttgtgatccacccactgcagccacccaaagttctgggattacaggtgtgaaccaccatgcccagccaataatgtactatcttaattgtagtatgttgtttgctacttaaaaatgtcctcatataaaggcccccataaggttgatagcattcagggttttgaatgagctatatgtacatgtatcagatgaatgtcctaaacaggtatggcagaggcattcagcatatggctgattttaagcccaactctttttttccatttcaggtcccctgaagtcatgggttgctggctcctgctcagagtgacagcaccctgtggagtctgctggtactgacctaaccaccacagagccccactggagcatggagccagcctagagagggtcaggtaggaactgttttttcactttatggcacggttttaccaattggaaaaaagtaatttttataccccaaaagggtgtaaaacattggtgattatttttgaaaaagggcttttcaaaactgagccatattggaaaaaatcagcacttacccgatcctgtgcaagcaggctctaaacaacaccagatttcccacagtgtccataatgacagtcacatggcagcacttctcagatggatgcattggatctatgtgtttgatgtttataagtagttaataaattagatatattagtctggttctgccagcagtccttaactaccttgaatgacagagtccaaagcaaaacagtgatgagtcttttagaagtttaaacataatacgctccagatgtttcagaacagctttgtaccattatttttcattcaataccatatgtctgaaaaataggcaagtaatgataaacattaaatgacccattcctatgtgctgtctgaatattttacatggattatctcattacatcttcagaagaacattatgtagtagatattgtgattatcctcattttacagatggagaaactgagacttagacaagttaaataacttgcccagggttacaatattactgagtagaaaaaccacatttgaacccaggaagtgtggctgaagaatttttgtgatttacctgttagactataattgtctattttttctacagtggagataattctggtgtcaaggggctaaagaattttctcaagaccaaacaacacattttttggaaatacacagtaattgaccatgagacatgctgagcttagtactgagtgagcttttgcttaaagtgtatctttaccttaaaaaaaagttacaattctaaacacttcaaataagctgaccaaccatattacatgttacaataaactaccattggaccatatattcaggtttttagtttgtgattatattctctagaaggtatttcccagagaggtagagtagaatatgccagtaactgaggcagtcagcttaaactagtaattacttttttaaatattagctattctaatggttattatgttaatatttgaaaatatttatgtaagataggagttctaggtattgtatttatgaatagtggttaaaaaaacatgtcacttaaaatgttcatatgataggaaaataatccttcccaaaggagttgtgtgttcccaagattacaaatagaatgaaagcagtgaccaggaaggatttcttcataaaattaatcttcaagatgggaggaacagcaaatgcctcagaaatacacaatgtctatggcagagtaaaaccaaaaaggaaacccttttagtttaatactttctgtcttaacatagctttaatattttaaatacttcaagagtttgaaaatagttttgtagagatgacagcattctatatctttcattaatagttttttccccgtgacttattctttcttaaattttattaaaaataagatgcattttatctgaacaagatttgtacatttcatggtattttttagaaaaaataaatgtttgaagataagatttcttggagagtttatagttttcttacggctcttaaattgttaaatgagggcataatgaaatgtataacaaatccaaatggatgaaaaatatttttcacagatttttaggagagtttcccaatatttatttcactgtgagtcacatttttcttgtttttttaaagagtttaatttgttttctaaagaccaatttatctgttctttaaaaacaacatagatggtagtgttgaatccaactgtgaaatggataaatgagaaggcatcttaagaaagtaaagcacgaatagattagggaactgattgaaatgctattgttcccactttcttttttgtgtactaaagatttaactgttctgatgaaaaagtgataagtaaggataagtaaaagctgttattcaaataatgatcatgttttgtcaaaatctagtaagagaaaaatacatgaacaaactggtgatactagaagatggaagatttaaagttgattgaaatggtaccactagcaggattcagacttttaaatgtacaaatgcaagcaatcaaatcctataaaatcaatgtgaatccaggatatattggaaaactcagctatccagctaagggcaatcttaaaatacctactttttgggaaaaatatgccattatgagcagaaactggtgttggccaaaagtattttgttaacatttgctaagaactagagcacaggatattagaaactgggaattattcttattggttggggagagttgcgcttattacctatgtttctcttttactgtagccctactggaacacctattccccagtgtcttgcttaggttactagatccccaggctgattagagagtaaggagaagcttgggcctaaaaatgttgctaattactgtcagaatcaagttaagaattaaaacttactaacttctgatgagtgctctttccattttattatgctgcctgccttaataccagtgtttttcaaacagtagaaaccgcttataaagtaaattcttacatagaaacccagcatattaaaaagataagaacgaagctgttctatttgaagccaaggtagaaagtgtaaagcccagatcattaagtcttctctgcctctcttttcctttccctaccaggtaacgctaaagaaacttgagcctttacatagtatagttttaatatgcacaatatactgtagagtttttaaagtcatgcatgtttctgtaatgataattacctcattgaatatttttcttataaaccattttctttgtataagatcttgatgttagctccttgttcagcccacagtacagcaaacaacatctctcaaagtatagtgagcatttcgtttcatgcttcgaatcctccaaggcaggatgaaaaccatcttaaggagctggagagggagtttgagaagggcaaggagtcttgtgtagtgaactagataccccatttctaatatatctaccttgcaccttgtgcctctggtatacgaatttgataaaaggtgtatgcatggaaatagaagaatagtttctcaactcattctcaaagttactaaatgcttgcctggaataacatatcttaagcacatggccctgcttactcactgcttgggaatcacaccacagtacttacttctattccgcagccttatacatttgtttcttaagcttagagatgatcatgacattgctgtgcagttttctgctgcttacttttaagttgaaatctcatttttgtttcagattctccttcttctgtggttaacaaacagctcggatccatgtcacttgacgagcaacagggtgcgtgcaacaggagatgcgctatgcccatccatccatagctttattgcaatgcatatactaagctctctcacacctttcgtagcatttcattttgattatggtcttatagtcagtattttgtggaccaaattacaataggtggtattgtacataaaaggtctttttggcctatacagattattttctatgtaagctcatttctcactttggcccttgatgccaactttgaactctctccctataacaaaattataatggatacaaactatatccattttttaaattctaggtatctgtcataaaattgtgtagaactgtgggtgtgaggttaatactacctcgttgcttatgtaggataagttatttaaacacagtgatattctatattactagattgctttagtaatgatacttggttttatgtctcacttatctggtagccaaattcctggtagctttaactaaagactatagttacgaacccagaggtaagctcaaaagctgtcagtcagaagctcccacttccacttgtacttttcaatgtgggaaaggtatagaatcaatctccaagccttgaatagagcctgatgaaatgaacgcgttacttatttatcaggctttattactagcgatcaaatatagcacagagaaggattagtagaggaagacattctgacatgaagggacatctgaaaaggctggagataggaagactaaaaactaaaaaggctatttagtgttagcgcaaatgttttactatctcacctcagaatttaatgaagtattttaaatatattgtgacaaagtgtgataagtaatcttagttaagtctttaagaatgatttaacacgatattcactttctctatttaaaaaggcagatagctggacgtggtggcacacgcctgtaatcccagctacttgggaggctggggcgggaggatcacttgaacccagaaatttgagaccagcctggtcaatatagcgagaccccgtctcttaaaaaaaaaaaaattaattagctgggtgtggtggtgcatgcctgtagtcccagctaatagggaggctaaggcaggaggattgctagagcacaggagttcaaggatccagtgagctatgattgtaccactgcactccagcctgggtgacagagtgagacccccatctctttaaaaaaaaaaaaaaaaaagaacagaaaaaaggcaggtgattgcctttatatattttacaaatgttcctttcaaaaacattttttaaaaaattagcactaaagccataagatttggttgactgaaagtttacatattagatgactcatatgtcaatagtaatgcagaaattaaatattgctgtacttacttggtgtgaaatatatgtaatttaaactatattcttagagaaatattcagaaactaattttaaagtgaattagaaaacttcttttgtacttctgatcttaaattattccttatggggccaggcgtggtggcccacacctgtattcccagcacttttggaggccaaggcaggcagatcacctgaggtcagaagtttgagaccaacctggccaacatggtgaaaccctgtctctactaaaaacaaaaattagccggatgtggtggcccgtgcctgtaatcctagctactcaggaggctgagggaggagaatcgcttgaacctgggaggcggaggttacagtgagccgagattgcgccattgcactccagcctgggcagcagagtgagactctgtatccaaaaaaaaaaaaaaaaaagattattccttatggacctgaggtgaatttctgatcttaaattactccttatggaccttagatgacctgtattactataaggttttctgttcttgagaaagaaagaatgaatgaatgaattggtaaattaatttgcaaactaaggaattaagcatgtgttattttatatgtttattacagaggtattaacaatgaagaataattaaggcaaaatacaactatagcctactatattagactactgtatataactactctataattaaaggattttttttctaaggatatatggatttaataatatatcactatcagagattttatagccagatttatattctagttaatcacatacaataattttcatagcattacatttaatattatattcaatttaagttgataatttacatatgatatgggatataagaggaagagaaaaattatgattaactcccagattttttacatcagtgcctgggtagggtaaatgataaggccatttactagggttgagtagcttggaaatagaaatcaggtggttctttatctttttggctatgtaaagtatgatatacattttagtcatgtaagtagagttgctatgtaagaggttagtattgagtggctttggcagaagctgcaccgtagtagactatcagaaatgtagctttgtaataagacctctgagcagaaatgttctaatggtggaaaatatatctaattaattaaatcctgagtttttacatacctttttgttcatcagcattataacttttaaagtactaggaacttcacattgcaggctcacattacctaaagataacttctaaaagttaatagagactgcccaccaccatttgtctctcctagattaatggaataatccctttactagtcttctcacatccactcaggctatagtctattctctaccggcagccagagtgaaacttcaagatgtaaatataatcatgtgattcatctgcctaaaacattttaattacttcccatagcctttcaaaagaacccaaatccataccttggcttacaaaacctacatgacttgatttctgtatctctaatctcgtctcaggccactatcccatcattcactaagctcttgccaaatagacttactttcatttcttttacatcccttgtacaggctgtacatctcttgtacatgctgttccctctaccaaaactacttttttgttgagcaatttctactcattttttaaactcactgagatgttactctcaaaaataatataacttcacaatctctagtaagtctcctctttttcttcctttgtgacttgttatttttcctcattgcatttatcacatttgtaatcatacatttatttaggggattgtttaatatctacctttttgcatattctctaaatattttcatttaataatttcctctatgcctaaaatcatacatcatgtggtaaataatattcgttaaacgagtgagtaaatgaattctttaagcaattatttaagagctgtagggattacttcagcttgggagaaatgtgatcagatttacatattggaaagatcattttggcaacattataaatgattggaaggagtaagattgaaaacaccaagaacacgtaagaggccattgctatagtccacctaagagattatgagggatccaacctaaggcaatagtggtgagaagtgggaatggacagattttaaaaatagttgaaaggttgaattcatgggactttgagactgataagttagaaatgaatgagagtatgataaccaggtgtcttgatagggtgataatgaaccatcagccaagatagagactttaggaggaacagctagctgatttgaggggagaagaaagtatgtgagtttttttttaatgttaagtttgaagtgtctttggatatccacgtggagagatctcatagatggttggatggctatatgatgctggaagtcaccaaagtgatctgaggtagaaataaaggtaaggaatcattagtttatagatagcagttgaaaccatgggagtggatgagattgtctagaaaaagagggtagtgtgagaagagtagagtgcactacaggagcaagtagagaaaaggatctagctaatgagaccaaacaggaatgatgagagaagtacgcagggcagaaagaatgccatatccaaaaccaggagaaaagaagtgcaaggagggacaggttagtaatgccatgtaaatcaatgataccaactcccagaaagtctgataaatcattttttaaatttggcaacgtgattgctttgacattgtagtttgagatatgatgtagtggaagcagaagccagatagtagtggtttgaggagaaaggtttgggggaaaaaggtagagactttgttatgtctcttttcataagcccaattaagaattgaaagagcaaagataatgtcaggtataggtggtggtaggttcaaaactgagcatgtttatagagtaaacagattgtgtgttcaagatgtaagggatagttgatgtccccagatatgctattatttcaaaattttaacctttaccaagattcttgttctcagttttaccatggagaatggaaaaagtagtacatttaataagtttcctatttgaatatatctctgactaatgattatttcagcatattttaaatttgtttttcatacttttaacaaaacacgaatgctttttaaaaattgatagttcagttttatgtttatgtcacaaaatatttcttcaccattttccaggtgcccaaatcattttatatgttgtttaattttccatagcattttcatagatttctttacttggaaggattaccaaggacaaaaatgttactaataaatttttttaaaaattttagtggacttggttactgaagaaatttttttctttgaataactgtatacacagtattaaactggttgagtgcaactggtgtctttgcttatttatcctgaatttttaacaaaatcacaatttgatagaagtatgtttagcctgaatcttcattcattaatgcagctccctggttgtctcaatagttttactttttttaagaaacaaaattgtagggaaataaatgtataacatgcacattgttattaattgtatcctattataaaataattttcagtgttctccaaatttggagttgtgtgtaaacacattgatggcctttctgtgctaattatgcataaagtgaaattctgtttgaataagcacagtaatgtccatcatgcatcttgtttagtttcaacagtatgttttaatgggtagttttagttttcctttttatctctctactataagaggaaaaattctcttctgacatatatttattttaccttgtttatattattaaaacttaacaaatttttcctcttaaaaatatgtaggccagcaatttcccccttattttattttaaaaaataacaacagcaaaaagaatatgtaattgttgttttgagaacagttaacttttgagaggatataagaaagtaattttgtctgagttttaggttttggccatgattgaaacaagttgctttctattccttacagtgattccattaagtggaagttgacagtgccatcgagtttgaaacttacgtctgtaggcagttgtgcatctgcaggcactaattttctgttatagatttaaagaaatataaacactaatttgtaggtatgaaaaatatcaatgttaattttccactatgtatcattttatataagctgactgtctttgatgtttgtgaaacattcatctataggagactagtggataatcaaaaaccagtgaaacagatttttactaattctactaaggtagattgggaaatggaaaagttggacctgccatgcattaaatatgtattaccttaagattatatactatcaccaaattgaaatttcattttagtactattatctaatattattttaaacatattgacaattctaatttttattaaataaatatctagtgattgaagcttgctgtattaataagaatataagttcagtattccccacactggaatacatccataaatagtatattttaaattctagtgaaataataagttagtgaaataaaatttcattctaaattctttgtatttcttagaactagttatcacttagttacttggaatgaggtaactaatttcttcctatccccaactactaggtcttgattgttccaattaatgatatatttgatcttttggaagttaaaccctatttaatttttttgttgcatatgctcgtgtgttctactcttctgctgatcaaacctatacctccagtttgtttaacttagaattgtcttatcataaaaataactgacatttattgagttttttgtgactagcactgtgttaagaatttaacatgcatcatctaatttgtgctaacaatgaggtgaattatcttaattttactaatgaagaaactgagactccaagaaatatgtaaagatgagtgaaataagtggtggagccatatttgtatgtctgtacttcattaattcaactgatacgtaaatgcctacctaccttgtggcaagtactgggataggtactagggtgcatgaataaataacactactgtcttctgtactgggagcattgagttgatttataataataacagcaacaacaacataagacacttaataccacattttctttgtaccaaacattgcttggagcaattttttatatgttaatttacttaatccttaccacaaccatatgtagttggtgctattattacccccatttttcagatgaggaaactgaggcaaagggtggttaagaatcatgtctaaggccgggcgtggtggctcacgcctgtaatcccagtactttgggaggctgaggtgggcgaatcacgaggtcaggagatcgaggccatcctggctaacacagtgaaaccccgtctctatgaaaaacacaaaaaattagccagctgtggtggcgggcacctgtagttccagctacttgggaggctgaggtgggagaatggcgtgaacccaggaagcggagcttgcagtgagccgagattgcaccactgcgctccagcctgggtgacagagcaagactccgtctcaaaaaaaaaaaaaagaaaagaaacatgtctaaggttgcacacagctagtaagcgttagaaacgtgtctcaaacccaagaggtctggctctggcatccgtgatcataaccacttgctttgcctgatctaacagtaaagatggatgaaaaaataaatcaagtgtgatgagtgttatataagaaaggggaaatagcagggttcagtgtggaacataggagagtgggccttcattccctccagttgagggccaaataaggcatccctgaggaagagacattaagctgagatctgaaaggtgagcctgaataagttaggtgaaggagcatgagtaaagggaagcatgaatagcatattgcagagcctctgagatgccacatacaggatgactaggagaacctcagtatgcaggacaaagtgactttttggacatttttaggtttcgcatttttattttaagaacagagggaagctaatgaagtgtttaaattagggagtatggctatggcctgatactctgaatggagtatggagaattgattagagactgaatcacttacgaagttctcctggtaatagagattttgatctggtgataaaagtaaggtaggagagatgtgaagagattcaagaaatatttaagatgtagaataaacaggacttggtggtagattgaatgacacagggattgaggaggaatccagagtataagttgcagtaacaacttcagaattttcttatgtagatagtttagtaataaatagcagtctgcagaggccaggacttgtgtcttaaatcttttgtaaaacaaatacactgtttttacttaggttatacatttatttatagtgctttgtgggaggtactgttggagattaacaggtgactttttcagccactgcaagagtagctcatgttttgattgagcacaactaagtgaatggctattttcttaaataggtagccctggaaaagggatgaagcatgggcggggacgtgtaggggtaggtgatcatgaactcggttttgaatatattgagtttgagttatctgtatgagatacccaagttgaaaatcggttgggtagttgattgtgtggatatagagctcagaaaagatatcagagctcaagaaagaaatttgggagatttttgcatacagatgttaactgaagccatgaagttagatggaattttaactaggatgaaagtagaaagaagaggacagagtaagagagctaaaacatctcaagaaaaatcagaaaaattctaaaattaaaagattttgccagcgaagagctggtaaaggagattgagaagaagcaactagagaggtggatggcgacatagaacagcgtggtgtcttgtgatcaagagaaattttcaaatacgagagtgttgtctgctggaaggtcaagtaaattggctccaaaaaaattatcccctaagttaggcaatgtgggagtgattgagcccattagtagaacactttcactagagtgatagagacataggccagattttagagcaggagacgaaaaaatggaaatgagaagaaaagcaattcaaaacaataagctaggaggacagtaactggaaggagaagttgttaaagggagtgttctcctaaactgtctacctcatttgttttcacttggaagtcacattttaacttgttaatttatctacaaaatgagagtgttatttatgataggcagacttgattttttttttttccagtaaaggagaatatacctgaggaaacagtcatgaaaagaaatactggaaaaggattttggcaggactcatgtgccacatggcgtgggcgtatttacttattttcattctatactgtcctccctctagactgaaagtgagataggaataggagacgtttatgaatagaggtatataaaactactggttctgaagtaggagaaaaggaagcaaaggtcaaatggctaccacatttcaacccataaattctaaatactggtaggaatgtggaaccaagcacagtttcaatctaaatgtatcgaaatcacatatttaagttcaattcacacttctatgttatgtcatgaaaaaagttcttgggttaaaattattataattgacatagagttgagttgtgattgccagaagaaaatttgactgaatgttaaaaagattagagagaatggacttcctaataaatatctgtactaaaattgcactttgtttcgttttggcttgcatagtatcacttctgttttataaagccagatttgcactagtgtaagcactcaatttttagaatgaaatgtgttgcctcacagttatctgtagggtagatagatcttctctgttagcagtctactcctagaagcagcatctccactttgaatccagatatgcttccttatacaaatagttggaaggagaattggagatcctctaatctggaatctacaaaaaagttgtggattccctgacctatgaacatggaaaattttgcattggtttaaaaactgtggttgagaaatttgccttttctatacaagtctagtaagttggagtgcagaatgtggggagatagttaaactttattattttttcagaatatttcaccatatgttttatttcgaccttactttggtttttaaaaaatatttggtataatgaagtgggaattagaatatcattatataatcatacacacatcgttatacaatagaaaactcattaggtaaacagtgttttattttcacatgttccacagcttatctaactactatagttaattaatgtatgattataaagttataatagggacccaacagcagagaaaaatgttgggcatggtggttctaaagaaattattgttgctataccctagttaattatcttcattttgaatatttggtttagatttacatatgagatagattctccaggggtatcccagcttaaagtctgaacgtccttattagtatttggatatttagatctataccaacattttgaacagtatttaaatatataaaatactcagcatttttttttttactatggttatcacatgtgtttttgtatgtctttgagcatcttttagaacctcatgattataatttcgtagtggaaatgtacagattaaatcatttcacagcgtgtgcattacaaaaaatagttactttgtgattcttatgcaaaagacttgaaagatacctaattaaatacataacagttcaaggaaactgctttcaaattatatttcagcttattctgaattttttttctgagccaatgcactatcctgagaggtctctagtagcatttctgaaaaggatcttttttttttttttttttttttgagacggagtctcgctctgtcgcccaggccggactgcggactgcagtggcgcaatctcggctcactgcaagctccgcctcccgggttcacgccattctcctgcctcagcctcccgagtagctgggactacaggcgcccgccaccgcgcccggctaattttttgtatttttttagtagagacggggtttcaccttgttagccaggatggtctcgatcttctgacctcatgatccacccgcctcggcctcccaaagtgctgggattacaggtgtgagccaccgcgcccggcctgaaaaggatcttttaagttggtttcctgaatctcaagttacggacctttcacttctaatcccccaaaatgaagtcctttacagtcttttatcttgatgtttatgtggtcattgctgtgcttctgaagcatgtttcaaataaatggtaatttgcctccatagagaccactctaagctgctgatgtcatcagttgttcttaataaccataattactgagcaatatagaatcgctatctaaaaacttagcagtgttgaacaagttaaaagggattttttccccactatattgtgtgtgtgctgagcacactacaaataaatattctcctgtaatgtttttagaggaagaaatagttcagtctcttaagtgccctaaaagaagatacaacatagttttcctatactatgatgccaaagtgataattttggctaccagaactcttaaccagttattaatgttgttgatatgaattatttatttctgaggagtaacaacatcaacaattgatatttcttaattaaaatagttacttatctaagtaatcttatttttgtctttgtagtcagattatttctaagattgtatattaagtaggaacttcatataaaaagaaacctcagcgggcacagtggcccatacctgtaatcccaacactttggagtgctgaggaagcaggatcacttgaggccaggagttcaagaccagcctggacaacatagtgagactccatctctagaaaaaataaagaagttgggcatggtgacacacacctgcaatcctagctacttgggaggctgaggcaggagattcacttgagcccagaagtttgagaccacagtgagctatgaaggtgccaccacgctaccgtgggtgatagagcaagaccctgtctatggaaaggatggagtgggggaggaaaagtccgtaactagagaaaaaattaagcttattgttttcagttcatcatctgtaaaatggagatgacaatactgattacaaagatttttttaaaggaatgtatatatcttggcacacatttataattgatgtatattcatagtaatgctcaataaattatagttattaatatgatagctttctacataaagctatttgtgtgtttacttgaagttctaaaccttaagggttttaaataaaaatctaccttttaagtaacatatctgtgcattatgtaaataagactttgaaaaatacaatttttagaatgtgtttgctgatccaacctctgacagagaagttgggaacatttaaatagttacaattttttttcaaataaagtaaaaatatttaatttttaaaatcattaaagtaggtttttcttaagacatttgtagtttagaatatgcattttatcacaaagagtgaatgcattcattagtagtccaggaatcctaattcctgagaaaatgtaacctgataggttgtatatgaccaagcaaactagaattaaagaagacagtgaaatggaaaaaggctaggagatgaatttaaaccttggaatatatactgtcactaatactgcagttgggccaagtgcggtggctcacacctgtactcccagcactttgagaggccaaggcagacggattgcttgagcccaggagttaaagaccagcctgggcaacatggcaaaaccctgtttctacaaaagttactacaaattagccaggtgtgatggcatgtgcctatagtcccagctactcaggaggctgaggtgggagaatcaccttagcctgggaaattgaggatgcagcgagccatgatttcgccactgcactccaacctggacgacggagtgagactctgtctcaaaacaaaaacaaaaacaaaacaacctggagttgaagaaaccaggttcttcattgtgttgtctttctgccagagacactgtttacttaagtgtaggctacgaggaaataactacactcagggacctgaagtttttgtgactaacagaagagttcatgttatttttatagtaataggctagttttacacaaggctgatgaattcattaacaacttaaatgaacaaattctatcaactataatcaatcattttatgattaaatgaatattaccaatatttgacatgttttgtaatatgtagattatattcctgagagattaaataagaactctgtaggccgggcatggtggctcatgcctgtaatcccagcactttgggaggccgaagtgggtgaatcacttgaggtcaggagttcaagaccagcctggctaacatggtgaaaccccatctctcctaaaatacaaaaattagccaagtgtggtggtgggtgcctataaccccagctactctggaggctgaggcaggagaattgctggaacccgggaggcggagcttgcagtgggccgagatcgcgccattgcactccagtctggggaacaaaaagagcctccatctcaaaaaaaataaaaacaaaacaaaacaaaaaaactttgtagtagatactgtaggaagaaagttttaattatcattaaccatcttagaaagcttcttgcctttggtggggaacctgtataaatgttttctgctctgttctgatctcttaatagtttgtgtaatatattcctatagtcatagcatgtagatatctataactgtctcttaaattttcctgaaaaggaaagttttcatatatcatttaaattccacaaggcttctcataacttaagaagtcttaactataaccaaggtggatctgagaaattcagtcttacacttctctcacatctgcttttgttttctctactgtctttaccttaaaagaaaaataaacagcaaaacatttataaaatattaagagagaaaatgaaaaaactagcccgaactcagtctctcagtttccttaatcatccaatcatccaatctttagctgtctgtttcatctattgcagaagcctaaagacagcagtgatgaaacaaaaatctcagtaacataactaaagaataagaggaaactgtggacaaatgactagcaaacagcaagtttttgaaagagggtcaaggatagggcagatgtttccttaatacatttctgtaagctaaaggtctattaattcagttatttatcagaatgccatttggtaaaatacctcctctaaaacactgaatgtaatactaaatctttgacagttggaatgggttattagtttatttccaggagttgtttaaaagacataatcataacaaaaatagtacagaaacaaagtgactttaccatttgggatgtcaggtttataattcacattattttcaaatagcaattctgtaggacaggatttttcatgagttggaagttaagacagaggaattgatactaagttttgttatcagcttgactcttgtggaatacttttctactgcatttctgtatttgaagtcttgttaattgtcctctcacagaataaaggctagaagagaggttctatgagattctcccccccctttttttttttttttttgagatgaggtctcacccagactcgactcgaactcctgggcttaagggttcctcccaccactgagccccgctgagattctcttaatgtgtgctccaacatcttcaagaggaatgaaaaaagatataagtccttcattgcaatagaaagtagatccaataataaaaaaaaatcctaagtatatttgcttttatgaaattgtgattgtctttgttatttttcaagagaagtttatttttagtattaaatcagtccttgaactggtatcaaggaaaaagatatctcacagaagagttttctttctgcaagcaactggcagaaatgtgacatgtttgattatgtatccatttgtattccctatgtattttaatgtttcccaaactgttgttcatcataaaatgaaaaatatgtaaagctctgtttaattatgtctttgcatatccatgtactctttttttttggcaggtggggaaggtagctttaaatactctattaatttgtgtaggctttcttgattttgtcatttaaaaaagatttcatacattgagatagatgtgtattatagacatcatctataggctcttaaaatgaaattgctgtttccacaattaaacaaattccttgcaagattagtcaggaagagaaacggaaatataccaaaatataacaaagtatattttagaaaatatcaaagcactataaataccaccctcttctccatcaggtgcagactgtgattcctccctaaattatagatctgtgagtttgaaagaacagaaggaatttgataacatttcattgcagcaaagtttttgccaaaccgcttttcacagagcccttgtatcttacatctcagtgtttctgaaagagccaaaattagttcttattgatgctcaagcaactgaggaattatgagcattccattaaataagggtaccagtttgtaactatgtcattgcatgttaatactttttgattcccctaatgactaaatatggttctcaatgtgtgtgatttccatctgaatcaaagggagtcatgtacacaaagctagaacttgatgtagtgctactttgaaatataaaagagtatttccacaacacatgccttcaaactttaaatgaaacccataacagatgtgaaaaaagaattatgacaaggacaacctaatataagttttataaattttaggaaatgtcatctttttactggtttcagagactttttcaaatgttttaaacacaattttcagataacaataatgaaaagctgagccccaaaccagggacaggtgaaccagttttaagtttgcactacagcacagaaggaacaactacaagcacaataaaactgaactttacagatgaatggtaagttaatatttttgtaaagatgttcttagccattttgtaggattgtattagattttaatttttaacacttcgtcatctttatgttttgttttgctataaggtattggttttcaaacttgagtgtgcttcagaatcactgggagagcttgttaagatgcatattactggaccccactctcagaattaggtttggagtgggggtctgagaatttgcatttttaaaaactttccagatgatgccggtgctgctcatcctagaatatttcttctgatagaaaatgcaaaagataatactaataataataattaaaattagtgcaaaaatataaacattttgggactttttgcagtcgtggtcctaggtaggtgtatatgtatgatttttgttttgagttttagaatataattttagtgatactaaatatactgtattctcccctgcatttgtttgactttataataaatattcccatgttactacttagttttaataaatattattttactagctgtgtaatagtccatcaagtagatgttctatagtttacttagccattttcatttaattgggcagtaaatttgtttaccattttttaccaaataaggctttaatgaatatctttgcttataaagccttttcctgccttcaagattatttgagagatatttctgaaatgaactatatctagattaaaagatattgccaaattatttccaaaagaatctttacttactatagtcctactagacacatgtagaagtatacgatttactgtctccaggctagtgttcaatatatttatttatttttaacttctatatttgatttaaaaatacttttagtatttaattgattattagtaaggttgaactttttctttatttaatggtcatatagcttctctttaataatgtttctgatcatatttattgctcattaatctaatgaaactttacatttgagaaaagcaagttatgtaagctttttatactctttcccactatctcatgaccatttgaatgagagagcatacaaaatttttaaacttaggaatagtaatctattagttaatatattgatatagtatttcttaatatataatatagttgtataatatttgttaatatataattataccaattgtttaatgacaatatattaattattcataattaatatattaatatattaatatattaaatatttaattgtatattaatatatgatcatgttatctgttactataatatatgtaatataatatagttatgtattgtcttaatatgtaatgaattatatgttgatatgtgatattacttttatttaaattcactggtttccatttgtgtttatgtatgtgtgtattttatattaaaatatttgattaagtaggatcttaaaatactattggatatcttctatgttccggggactattctagacattggaaatacatcagtgaaataaagtacttaaaacccctgccttattggaacttacattctagatggaggaagtttattataaacataattaataagtgtaccatatagtatgttagaaggacaatggaggaaaatagagcaggtaaaagtgattgggaaacctaggcatcattgagaaggtgacatttgggcaaaatgtcacttgaagagtgagaaggagtgagccacgtatttatatctaggggaagagcatttggggcagagagaaaaccagtacaaagactctgaagcagaagcatcagacctagtatgttcaaggatcttaagaagaccagtgtagcgggagtggagtgaccagtggagagaagagtagtagataaggtcagccaggaaattgaggaggatatttaaaaggaaaaggttatttctggttattgtgttgagcatatgccatcagtagaaaccagaagaacagttaaaaagctatggcagtaagaaaggtgagaggtggtggtggcttagacaaggatgggagcagtggaggtggtttaaaaaaaaaaaaagtgatgggattctagatatatatttgaaggtgcagccagtaggactttataagtcttagtgcctgaccatttaaaaattgtgatgtttgtggccctttttcttaatacataatttaagatgacagtaggtcatcgtacttatcacgtcttttccattctcatgtttctgtacacaaggagctggcatcttctgaagaatcttatctaaactttttgggctttttttttttttagagaaaatcattagtcccattcttcttttgaatgctacttttccttctctaaaaactgaccatgaattatattctcattcatcaatttcttatttctttgtcagaaaagcagttagcattttttattattatgcaagtattcaacattcattgtaaaaaaaaaaaaaaaaccaaacaggcagaacttaaaaaaaaaaagtatacagactttttcatctatatcaggattgtctcttgcttttattttagtttctttggcaacagatgaggcaatagaacatgctaagagcttggactgaaattgacaagtttttgaatctctctaaatctcagttttctcccttgaaaacgggcatgtttaatagaacctacttcataggtttagtatgaagatttaatgagatcatgcagagaaagtacgtagcacttactagcacattgattggcacctgagaaggccctcattgattgttagctacagttctcatcttttgtaaattgtctttcagatactttgcccagttttctatggtgtttatctttttcttattgcgttattagagctatttatttattatagaattaaatgaggattataccatttgtctttcatttgttgcaaatatttttcccaatttggtgtttgtttttcagtttacttacagtggttttgccttatggtttctgcctgtgatagcatgcataggaaagccttgttattcctagaattaagggaaaaggttcttatattcctctcatattttctataatttagtatcaaaaactgtatattccttctagaatttattttcccataaagtataacgtgaagccatagctttggttttaccacatggctgttttcttgtctcattaccatttattgaataatctttttatttctgtgtgatttaaaatgccatattaacgtatgttaaatatatttactcggttgctgtgtcttttccactaatatgtctctattcctactcagtaccataatattttaattactataatgtatacactaagcgttttattcatgcctgaatcatagctttctcaatggaaaaaataaatatatatataccaccttagcttttttttgccaaaatagctatatattcctttctggtttaaaagaaatacatgtttgtcgcgcacacacacacacacacacacacacacacacacacacacaaattcagtataaaaaatttacctgcagtaattctactgacatgacactcaacactgatgcatagccttcctgacatttttctctgcatatatacacccatatgaatatacagttttagttaaataatattatatatgtactctcttttttttaaaaagtcaatttgacttctgcagtcagcctaaaagagtttttgtcatggcaaaaagtccatgatcgtttgtattgtttattgagttactggtatttgtctataattaatgtttttttaagttactgtaaatcttactttttttcttgttcacatttattttaaacttaaagaattgttgcatttctatgaacttaatttaaatctcagtcagattgttatacatgtcctctttctcattcagtcctcttgttacacatatgccatgatttgtcacagaatacttattgaaaattatttctttaaaaattggcctcgtattccgctatagctagaaatgctaatagaactatagtcatcatcaggtgagtattaaaactgaagcagaaaatattaccctgtccttctacagaactatgatgctcagtcacctgccatgtttgaacagcagatcagaactggaagtgatccacagggagcagttcaaaagaccaaagaactggccaggcttttgttcaaatactaattttaaagtagcctggaataacagagtctagaagggcatatgataaaaatctgtataaccattaaggttttggatatggtgaaccatctgtagtgaagacaagaaaggagacaatgtagttcacttaaaattcaatagagagacatgtagaaatacatactagataatgaaaggatccaaacagtgaagaagcagtccctttatatttttgaattttttttcaagagtaaagtgtgttatgatagtcatcttgatttgtttgaaatgatgtttacaaatgctattaaaattataaatcctacattttacttgtgaattttttggtctacctttctagttgtaaaatataaaaatcctaaaagatcatattgattaacttcttggtggaatcacttatcttgttttgatgataggagcagtatagcatcaagttctagaggaattgggagccattgcaaatctgagggtcaggaggaatctttcgtcccacagagctcagtgcaaccaccagaaggagacagtgaaacaagtaaggtgttattttgcttttgttgttataaaattgcagcattggatgtttatctactttcctgttcccttcgatgctgtattttgtttcttgtttttaataaattacttttgcttctatagtccagctgttaaactgatagatagcaaatccaaaagatggggaccttaagcagttaaaatgaggagacacagtgaagcacaatcctctttgtggacacagtggccaggatagttgttcatcatactataaatggatgagatataaatgttagtttgaattagtctttatcatttttatacctagcaatgaaatccactgtatttgttttggttgtatatgtggtttatagagggggaaaaaggaatagaatctaaacaagttacgagtgaatctatttaatacctgaagtgccacttaagggatttttcagaacccttttctaatagaatatttttatatgacaattacatgaaatttaatgtctagcacagagactagaacacagtagatgttcaataaatgcttgattaatgaaggaataaatgaattatatttcttataaatgtgtaggtaccttagtataacagagtttaaaattaagtatgtgtaagacagctatctggtaagcaaatgtccagtaaggaacattaaagactgatccttcatgcatctgacagttaaattccagaattaagtattttcagtggccaaaacagaatttatagtatggtcagcttaactacttgttcatgatagtttagattttaccaaatacatgatagaggggcagaaaaatgctcagttttaagtttagatttcgggaaggttagtaaaatgcaggatcaggtaatttcagctgtaagggatagtctaaagcagagattctgcacatagagttcatgaagctcaattcctgggcttcaggaagaagcagtgggcccatccgtccatgatagtgtttgtacaattttgtgtgcaaatacatatttgccttgtactgaggggaggttttagctgaatgtcaaaggttcctatgactcagaaagggttaagaaccatttatccataggaaagctggagtattaagttgatgtttacttttctaaaaaaatctggatttaatgatacatttggccctacatgcccatggattccatggaaatactccctcccaaaataacaatatgacaataaaaaggaacatagatttaaaaacaataacagcgtagcaaccgcttacatagcatttacattgcattaggtattataagtaatatagagataatttacagtataaggaagggtatgcataggttatatgcaaatattatgccattatatatgagggacttgaggagctgcagattttggtattttcagcgattttagaactaatccctcatggataccaagggatgactgtaatttggtttacttacagaagctcctgaagaatcatcagaggatgtgacaaaatatcaggaaggagtatctgcagaaaacccagttgagaaccatatcaatataagtgagttgctccctttagataattgctttgtatgggaaaataaaaagccttaatctatgttaatctctctatagttagaggccatgttcaagtgtattgtggaagtttcctccccttatagaggaattagacatcatattagaatgtgtttgtgagctcctaagttaggttaaataattagtattgcccacattaccacctgttacatacaactttattttctgacagcacaatcagataagttcacagccaagccattggattccaactcaggagaaagaaatgacctcaatcttgatcgctcttgtggggttccagaagaatctgcttcatctgaaaaagccaaggaaccagaaacttcagatcagactagcactgagagtgctaccaatgaaaataacaccaatcctgagcctcagttccaaacagaagccactgggccttcagctcatgaagaaacatccaccagggactctgctcttcaggacacagatgacagtgatgatgacccagtcctgatcccaggtgcaaggtatcgagcaggacctggtgataggttggtaaatttttaattaacatgaactgtaaaaaatgtatttcacaaggatttgtttgaagtcattgaagggaatctctccatttttgacagttgcttcctctaagagtgtctcattcatataaacttaaagaaactttacagtttactgtaaatgattttacgtattatattctttgagcactgtgcattaatagggaaataaaaagtcttcattctccatatctctagcactgaggcttgcttctgaatttacagatcaagagaaaagaatgttaagaatgacccacaggttatttatgaagtcaaggttatacttagctctcagattatcttgtagatatccaggcctttatcagtgttgttttggttttaatgttaattttttctgcttttctattgaccctggattaaggtagtgtgttagtagttctgtttttgggaacactgtttttctttgatttctactaaacttagtgactgaatttagaaaatgaaaaattataccaaataaataccatagcagcaataaaaaattgaattgccaacatgtttttatagtttttctatattttatgtgatcacaaggatatattttcttttgtgggagttaaaataaatttttaaagtatactgcatttcatactcatggaaaactatttctattattagtgctatcatatcttattgtaagttctgtcctctttcagagaacctagttttaatcttaaaatcctagtttacaaaggagtgagattctatttgaaatatttcacattttatatgctcaatatattgctgtttataagataccctaaagtatctgtcaactgaaaaatataatgaaagattaatttaccactcatagtcaagagcatgatgatgggtttgaatactggtttcaccacttaccagcagtgttttttcattcaaattacttaatgactcttaaagattcagtttcttatctataaaatagggttatgattatctaaaattattgtaagaattttaaaaaaatctatcagtcaatcatgatgtgacctggctcatgttaatagcactaattaaatgatagctgtattaaacaatcaagatagtctatgaggccactttaatttttaaaagaattacagtaagaatgactctagggataaagactgaaagaagacaggcaaaaatcctgaagaggatagcttgcagctcaggggaactgccttttcttaactatgaaagggtatgtttctttctttagtcatatttgggaaatgtttactttgccatggcactttttttgtagatatgaagcaagaatttcccatgtttatacttagagattaatcaaacatcttctctttacctgtacacagtaatcttgagcattcttagtatatattttaggcaagtaagacttagttctatttctttccatacccagagggagttccttagaatgtcattaccacttaatttatgcagatgaggttagcaagcttagcacaatttgaaaatcaaactgataatttccaaaatcaaactgataatttccaaaacccagggttgagagctagattctataattaagcttgtacatttatggccttccatttatataaatgagctaatgtcttatttttctacatttaagtagtagaacatgatacggaggtcataattgaaaattaaatttaagtgcccagtttctagtaatgtttttaatggatattagacactttgagaaagtcataactatttagcagcttctatgcaggctaattataacacttaataccaagcctgctttatagctgaggaaacttaggtgctaagcaaagggttttgtatattctagagctaaggagttttgttttttgaaacacagtactataacattaatgagaaaggaggatttgagggagggtgggtcctagagaatacagaaactgtaatctttctatagatctttatcatcttcataatacttagatgatttatatgttttagggattcttttagcatttagatctgtcacaaagttggttcccaatagcctcattgacccaaggaaacccagatgctgaactagactagcagaatcttttagaagagagataatcagtgacaacaaacagcctggaactgatcccacttcatgcatatactcttgaattcatactttcatggttaaatccagatttgaaaccactctgggatcacatttagttccctgctttttaaaaattaaatattatttaatattctgtacactcatttgagtatttagcctatgttggtcctacatggtattttgttttgtaagatatagtagtaaacttcctgaagagtaacagaagaacgataaaattcttatccttcaagaaacttaattatttatgaataagagagaataccgaagccatttataggaacatagaaaacatttaatatatgaaagtaaatacaattatatatatatgtgtgtgtgtgtatatatatataaaagatgtgtatactgaggtaattagaaagtgattagagtaacaattacattaattttcctttgagatttgcattattttctagctctttaccaaaaatttgtaaatggtgtaaatatttcctctgacttttatctaaatcggttattataattcttaacttttttggcaccatcctgatttaatcttgaacaactgtaaaaaagtatacttttaatatttctgcacctttctaagggctcttcatcattgacactcctgccagtttatcttacttctcaatttagctgacttttattctaaagagagaaagtttaagagattttgcttcttaagaacatgaaaagaatcacttaccagcttgtaattagtcctatgattttggagagtttctgtttcccaagagactaagggttgtgaagctctgttgtaacaatcataccatttggttcctagagtccaaggatacattgcacacatggatgaaatgcccacctaaaaggatgtatgtcttaaagttccctccatgctgccatttgcaaagcccagtcaatattagtttagctggggtagagaagtggtcctaaaattaaatattatacaagtgtatacttaatttgatctgtactttatatgaagaactatatagtggacctcatcagtttttgttccaaatttaatttttaaaaggaaactttaaaaggctttatagctaagtcatttctgacaaatttactgaaaatatcagaacagttccttgcaatacagagtaatgatttttaaaaaaatatttacattcttataatttggttaaataaatgacccaggttttcacttttgggctgagatcaagcatgagaaggaaatgtcttagaaaatgaagaccttaacaactaacatagatatttttaaatggaatgctcttctcattaactacagcaagtctatgtaaatgtaactgggagtctatagcagagcagcagacttactcctaaagagccatatagtaaatattttggctttgttggccaggagacaaaatggagaccattatggtaggtacttatatgaccatttaaaatattaacatttaaaaatgtaaaaactattcttagcctaaggttcatttcaaaaatcggcatttggcggagatctagcccaagagccatagcttgcaaatacctgctctatagtaatcagtgttatagagagaaatcaaactatagtctgtggtaaaatgcctctactggcaaaaatccagactttgaaacaatgaaataatatgaatctccacatatttgggttccctttaactttgcgtaaggcaagaacatggaacagtaaatgggaaataaattgaaaaaagacagaaagaaatgtttgttctctaatcatggtgtttaaaaaaataaaattagtcctaatgtcaaaaataagtctgacttaggaaaaaagcaaaacaaagcaaaaaaatagtatgtgtatcttttagtgattttatatactgtatttatttcattttgttttatttttttgagacagggtcttgccctgttgcccaggctggagtgcagtggtatgatcatagctcactgcaacctcatactcctgggctcaagcgatcttcctccctcagtctcccaagtagctgggattacaggtgcatgttgctgcactctgctaatttgttgttgttgttgttgttgtttttttttttttttttttttagaagagacagtctcactatgttgaccaggctggtcttgaactcctggcctcaagcctcagcctcccaaagtgctgggggactataggcgtgagccaccgcgcctggccatatactgggttaagaaacgtaaatatatgcccttggaatgaaaagagtgtggttgagatctctgtttagataatctgcatataattttttttttttttttttttttttttggagacggagtctcgctccctcacccaggctggagtgcagtggggcaatcttggctcactgcaagctctgcctcccaggttcacgccattctcctgcctcagcctcccaagtagctgggactacaggcgcctgccaccacgcccagctaattttttgtatttttagtagatacggggtttcaccgtgttagccaggatgatctcgatctcctgacctcgtgatccgcctgcctcagcctcccaaagtgctgggattaccggcatgagccaccgcacccaggctgtataatttttttttttttttacaatgccaaatctgttgtaagtgatttgacggcctgattggtagctcttactgtttctaaactcaagagaaaacctaaattactctctgaaaaaaaaaaacaagcatctaagaaagcttcctgaataagtcctcacatagtcttgaatagtttttaattatagcctcagttaggatgatctaacaattttttccctaaagagtgatttatcctatattgccctttaataacttttaaagtgttattttcatagaaatttggttccatatacctactctggaccatggagcatagccctcacttttaaagccaaaattccttgtactgtaaatttggcagcatttattcagtcatcattgtaaccatgatttccttatttctcattattgcagtttactctttattaaagaaaattgcagagagaaaagatgtactcaaagagaaagaactggactcctagggagttaaaagccctgttattctttgctcatttgttatatagtcttgtggttaggccaagtgaattagcttagggcttaattatttattttccaaagagctcctcagctttgaggagcatgtacgtgttccagaggatggtattcattataagccagtgcagtttcccatactgtgacaggattgggttctgatttatttaaaagataaaagggattaagtgcaatgtcttccttctattctagcttcaatgagtgtttctgtttccttaatttcttcatatacatttagttgactgacatattccttgcttaatgcccgaagtcacaaagggaaacaaaagtttttttttaaattgagatgattgatgataaaaagggtgtccttaatgctttaaatatttggttctttgaagtctttgtaagtgatttcagttattgtgttcccttcactagatttaatatcagaggaacaacaataggtgatagaataatgaggtaattcagtatgttccttcataattttttttttatgatggatttgccaggtcttcttttgccacagctaaccacctttcctattaacagttaatactccctttggacttactgaattctaagtgctaagcattgtaaagcaggtcgctttccacaaactatatttagctgcatgcactgcatggggatagaatgaaaagaaatttcctgtgtgcagactgatgttcacttcaaatatgtcatatggcaaagtaactataatctgaaatgatgtactttaagtatcagttactctttttggatattttgttgaagaatgcaatttatgttttttaaatttgattgggataacaattaccaactttttgttattcgtatatgctccttttccttgagctcaataactaaaaatgtacttgaatctaaatctgtgtataggtttctgatttttgcaagaaagttgtttccttataaatagtttagaaatagtgtcacatatcaagatgatatataagcctcaagcacttctctatttgggacatatttttgagtagatctttaaagtgaacctcaatgacatcagtcacctactgaaaacctgttttgctgacaaaatcaaccttgtacttaactctagaggcatatatctgttatttaccatcagtttctaaaacagttgaacatgaaacatatagcaacaatcagaaatgtaaagtttgtagagttcctaatgaaaaatacagaagtcatgaaataagccaaaaaatataatagatgtatggaaatttctggttatggttcattgtcaggaggattctcatctacaagtctcaaatttgtttttgcttctcaaacttgttttgttttgtgctgttgtttctagcctgttttaacattaaggtatatttgaaataactttttcaaattattactagttatcactttctttttttttttttttccccaagatgtagccttgctctgttgcccaggctgtagtgcagtggcgcagtcccagcccactacaacctctgcctccagagttaaagtgattttcccgcctcagcctcctgagtatctgggattacaggcgcccacccaccaggcccagttaatttttgtgtttttagtagagacagggttggtcaccatgttggccaggctggtctcaaactactgacatcaagtgatctgcccatgttggcctcccagagtgctgggattacaggcttgagccaccgcatctggcctagttatcactttctgattaattgtatgacaataaaatggaatttgcttcagagttttttgatatcctgatttatactttttatcacaagtacgcaaagctggtttctggttttataatgaaaattgcaactataaagtaccatgatgctttaattgagttttagaaaagctgaaacactaaagtagagattatcatgaactgataaacaatggtaaagcagaaaatgtaacagttacctccctgtagagtgaatgaggtgagactcattcttctctacttcattttatttcttatgtagagattatctggtggaaacttctaattataaggcagtattttcctgccagtgaacacacatttgttctgcttctccttttagctattagagatgttcaaagaatgtaaacttctgcttaagatagacaaaattagaaaaataaaattatcacagatgtttatatctactgcccgttatgactagtcttcattagggactgtcttacaatggggaatgtgttctactataatctgctaagattctgaatgataggtaccatatttctttgaatagtaaataaaatggtagtcatcccctattcttcattctacttttattacctcatcacctcttacctggtgtactgagggagttctccaactccttctactcctgctttcagtagttctccattgtttatgatataaagaagaaacaaacccagcttccttgcctggtatatagggcacttcatattatagctgctgccaaaaattggtcatgctgtctacattgccatacttggagtgtcactgaatacattcagaggactattggagttctctgaatacattatgctgccttaagtcagcgtatctttacatactctgagccctctaacagaaaagacctcctatcactatcaccatcatttgggtcacctcatctttcaacatcatcttaagctacatttcctggcccatatattccctaatcaaaaatatgggcccttatatatacctactgtactacctatcacagtgcattgtatatttgtatgttttcatatataagaatgtaagcacctttaaggacagtgtaatacatacatgcatacagaaataaaagttggcaaagacacctttttgtcaaaaactctagctaactaaatttttattcatatctccctgcatgatatgggtttttgctttctttctctgcttcctaaaacttgaatgagaaaccagtgaattactgtttcaggggtcccacggcctccccacacagttgattgcttgctacaaagactcaaaagaatcaaaggcacttcaatcatggctatgatttattatggcaaggaaaaaagatcagacacagtggaagaatccaggctcagtgttccaaagttctccctttcagaatgtgcacctcccttcccaataaaatacagtaatacttctgtagtttttctgccctggtgaagcctgcttataactcaaaatccagggtgtttactggggtctggtcatgtaggcacctctgcctgtgtgcctaaccacagtcacctgaattccagacccagaaggaaagtaggtgttcaccacaaatcatgttatttttgcagtttacgcaagctggccccgcagggttgtgtcccaggcaggcagagcaatgtaacatgccaaaagtcaagttctcagacaccagccaagggccagcctcataagcagacccttctaaagatagcagcatcagacctgctatcccttacctttatttactaatacattgtaaggcaaagaatccagtttcttgcccccacaaaggagcagaaacagcaagatactctctagcaacccatctccctcacttatttcagatacttgtaaagatatatgttgaaatgacagcaattctaacatatagaacttttttattgataaagctagataacgctaacatactaatagtatcttagttcatttcctgttgcttatgatagaaatcttctgggtaattaataaaagaaatgcattttttacagttacggaggctgggaaatccaaggttgaagggccacaatggtacaagccttcttgctggcaaggactctgcagagtcccgagctggcacaggaaatcacatgatgagaaggctaagctcaggcttctcttcctcttcttataaagccaccagtccccactgacctgataacctattaatctataagtgaattaattcattcttgagagtggagccctcatgatccaatcaccttttaaagaccccacctctcagtactgccacattggggattaagtttcaccatgagttttggaggggacatgcaaaccatagcacatagcttttactataaaccaagtgtgtgttttaaagcacttaaaatgtttattttttaataacttttttctagactcttacttataggattcaattggactgcaaacattttaaaatttataatttaaatgtaaatttcagcttcaccctgtctgaataatcacagattgcatataagaagattcaaattaatgaggttttcttttctaagaactactaagctaatataagaaaaatgtatacatagtataaattaaaagaacatacgggtttggtttttttttttttttgagacggagtctcactctgttgcccaggctgcagtgcagtggtgtgaactcggctcactgcaacctctgcctgctgggttcaagcaattctcctgcctcagcctcccaagtagctggggctacaggcatgtgccaccatgcccggctagttttttgtatttttagtagagacggggtttttaacttgatatactgaagaacagtggtattcagaattataatgagcatttccaatgaaccataaatacatggaatttaatttattcttttaatatcttttttcttatttatgcctggggaatgcgtctttaacacatacccacagtaactttgattcttatagaaaagttttatagctactatgaaagtagagatatagaaatgtaataattgttgcagaaactcttctattgaaggagatggtggtgaggatagctatcctatgtttgtaagaacctagatcttcaatctttgaattgaaaaaaatcaggcttaagtttttttttttttttttttttttttttttaacgaagaagtattttattattttgctgcaaagctgttgcttcactgtataaaaatagcaccagcaaatgcagtgtatcgcaaaattaagatagtggtgttcctcatctgacactgtacaagcaacaaaacctcttcacttccagttatttccaatggaaagatcattaagtatttcatcccaaatccaggtatggatacatgcaagttacaatattatataaggcttaagaataacaatgttatctttgaattatgtaatttttataactagtttttaccatggataatttcatgaattctgaacactagagcctagtctaaaaatcataggatattgtgaaaaagacgcatattatatttatctataatcattagaaagttaaagggcattttctttcattagcagtgttaacagtagtttttttttccccatcggtaatactaaaagtttctattctaagtcttctatccaccactaatttaagacaactctgctggcttgcgttatttcatactagtttatttaggagttccattttcactcctcaatagattttatgtatttctcatatgcttcttcactcataagttcatctagttctgaagggttactcagtgtcatcttgatcagccaaccatcttcataacaagatttgtttacaagtcctggattttctgcaagagcttcattaatttcagttacttctcctgataaaggagaatagagttcactagcagctttcacactttccaaagcaccaaactcatcttgtttgttcaattttgtcccaacttcagggagactacaataaacaacatctcccaacgcttcctgtgcaaaattgctgattcccactgttccaatgccattttctgttgttacccattcgtgtttctctgtgaatttacgcaccgagagcagagcgggtccagtgcgtagcgtacggacggcgcccacccccagctgccagggcctcggcgggcagggcgcggcgggtgacgggaccgcgcgcagggtgcagagcagggcccgcacgctccgcaccactcgcagcgccatgttcgcaggggtgcgggggtcgcagcgctacgcctcggccacccgcgccgggaggcggggcggggaggggcccaggcttaagtttttaataataaattcacactcaatttatttttgaatggaataatttaattacagaataagaagatgaaggtcactgttgtccaaagtgttctgatactctacaatgtggtcacaaaatttgggaaatactacattgtgtatacctctttgtgagattcacaagaacctgtagcgtaataaagcctctgagaagacttgcagcaagaaacctctttaagctttgtttggtatatcattttccacacttactttatcataagcctattttgtggaatacctacaaaaatcccaagttttagaaatgctctgcttctggattattctaactacattctagacaagtattgagttccttagaaacctggactaggagaagcttttatttccctttagtttttcactgtgtgttttgcacagtaaagaatttctttctacagatttattcaaaattcgccagctataattctagtcatgttcttgtattctatccatggtacagtatcctttatataataaccttgtttggtaactgaattacttaagtcatttcattcctggtcctctcctaatctttgattatgctgttttttccaccctaaaaagtctttgttctcttgtaaggtattttaataatacctataatatcagttaatttgtgccattctacctatgtgtaatggtgttttatgaaagggtttaccatcttgaaaatggtatgcaaattaattcatattttttagtgctatttaatgaatttctgcttatattttagcctagttttttactaaatgtgactagtacttttaaaacgggtttatagactgtttctgcttcatgtaacttcatactttaaccttggagttatctccaagattccagattttctggaatatgcaatagtaaaatacaaagtcaggagtctaggttttattttcttaggttagttgtacatccttcagatttactcttttcctccattaaatgtttcttccaaatagaataataattgatactttgagctgtttcattattgctttgaaattgctggataatcaattttttacctattattttgttacttcaataaacctgttatgtgctagatactctggtgggtgctggtgataatgataacacaacgcctaccctccttgagctctcagttcagtgggatacacagacacatatacatagttacaatacagtaattgcattgacagggctttgcagggctttgagagtattaaggacccctaatctaacctgaggaaggggagaattgtatttttataattcttggtttgtgacacattatcattgttagttcatacttggctccttttctttctttctttagatacccatgagcccaccaaccaatccaagaactaaaaaactcgctgtaacttaaatctacctgttcaccctattttgtccatctgcctaccacgccagtggtaaccagtgtcctgaatgttatggttatcatgccttgctttaaaaaacaaaacataaacatataaacataaagttttacccacttttgaactttatataaaaatgatgtcatactgtatacaagactgggactcttttttttcctcagatattatcttactgtgattcatccatgttacatgtagctcttgcccaatcatttttactgctatctaataatccatatttgactaaaccacagtttatccattttcctgttaatggacatttaggttatttctagtttttggtattaacagtgctgctttgagcattctgaaatatttctcctgataacagtttttcttgcgtatataccaaggaatggaccatttacaaaataatttaaaattgttttccaaagtgggagtgtaaattaaatataatatctaacaatattttttaaaaatcgtgtttattcacatcactgattcttgttgtcacatatcttgatttttctaattgatttggtaaacaataatatggtcttgatgttcattgcccaatttacaaataagattatgcatctcatgtttttcagcctgatctcctgatctggttttttgtttgtttgtttgtttgttttgagatggagtcttgctgtcaccaggctggagtgcagtggcacgatctcagttcactggaacctctgcctcccaggttcaagtgattctcctgccttagcctcccaggtagctgggattacaggtgcatgccaccacacccggctaatttttgtatttgtagtagagatggggtttcaccatgttagtcaggctggtcttgaactcctaaacctcaagtgatccacctgcctcggcctcccaaagtgctggaattacaggcatgagccactgcacccggtcctgatctggttttctactgggttgttttaattgagttgtttttcttttccttattgatttataagagttcttaatgcatttttgatactaatccactatcgtgtattagtgtacaaatattttttctattttatgatttttttcactgtttttaggctgttttttgatgaaccatttttaattttcacattaaattttatcaatcttttatgcttgtcactttcttttatttacaaaattcttatctggaattttaaaatttatctgaatttccttttgaagttttacttttgacatttaagttactaatttatttggaactgatttttgtttatgatgtatatgtgtaacttttccctgccccatttagatagccagtttttcccctgtacatttatgaaatggtgaattttcccagtgatctgctatcccacctatgtcatattacaaagatttatataaaacagatttgtttctaggctcttttgtttcatcagacaatttgcctgtctctctgtcagtatcatacttttgtaattattatagctttttagtaaatcttaatggcggctaaggcaagacccttccttctctttattcatttttagaaggatcttggctattctttgtcctttggttgattttataatcaactttttcagttctacaaataagtcatcagaatatgcttatagttgtaataaatctgtaaaataaatttgggtgaaaattgtttatctttacaatacaaagttatgtctacatttatttaggcctttttttcttttttccttgagacagggtcttgctgtgtcgcctaggctggattgcagtggcatgatcatggctcactgcagttttgacctcctaggctcaggcgatcctcccacctcagcttcctgagtagctgggaccacagatgtgtgccaccactcctggcttatttttgtgatttttttgtggagatggggtctcactatgttgcccagcctggtttcaaactcctgagctcaagggatcctcctgtcttagcctcccaaactgctgggattataggtgtgaactgctgcactcagcctaggccttttacaaaatatctttcagtaacattttatttttctgtgagcaggttttgcatatattttttataacttaaagacactttttgttgctgttataaatgcattccttttaaaatttaggctaattgtcccctgctgatatttagaaatgcagttaacttgtatatgattatgtatccagctacattccttttctattatttgtattaattggcccgtagatattttgagttttggtttttgttgttgttttaagagttgttttgttacccaggctggaatacatggcatgatcttagctcactgcatcctgtaactactgggctcaagccatcctcccacctcggcctcccaaatagcagggactacaggtgtgtgtgtaccaccatgcccagctaatttttttcatctttttttagagatgggatcttactgtgttgcccaggctggtcttgaactcctgggctcaagcagccctcctgcctcagactcccaagtagctgggattactggggtgagccaccgtgcctggcctagagcatactttttaaatgaacatttatgctttgatacagttctcgtttattcataattattaccacctcatttactaatgcagccttaattttgtccatacatcttgttttaaatgatttgaagctgggcatggtgactcatgcctgtaatcccagcactttgggaagctgaggtgggtggatcacttgaggtcaggagtccaagaccagcctggtcaatatggtgaaaccccatctctactaaaaatacaaaaattagccagatgtggtggaggcctgtagtcccaggtacttgggaggctgaggcaggagaattgcttgaacctgggaggcagaggttgcagtgagctgagaccccgccactgcactccagcctaggtgataaaataaatgatttgagctgccatgtaaattcttgttgcataatttttttctcatttatagctcttatgtcctttggcttagcaacacagttatttcctctgctacctataactctactttcttagcaaaagagttttttctttattggtttcttgctaatcacatgtttgtaactgattcattattcctttttcttccattcagaaaaatgagagatccaagcatatgtctcttaagtatgtctctttcgagaatatttgacctctctatccttcccattctcacctcccagtcagaaatagagtgaactaaacatgtcagcttttctgggagtttctaactgtatctaacttaaaaatgtatgtggagattcctttttctttgatagcatagaaaaaagttttgaaaacactttttaagtaagtctatatagcttaaagtataccatttagtttatgaaaaagtaaacatctttttattatgaaagtagaagtatataattgttacataattattttaaaaattgttagtcacaatttaatgtccatctttccaaaccctttctatgcatatataattttattctatgaattattctttagcctgtgttttagattaagcagtataatggtgatatctttcatgtggtttatggatcattcataccctttttaatggctgcataagtatttcattgtatggatttgccataatttatttaacctattctttctatatgaacatttagattatttccaatctgtctcaattacagttgtgcagtgaaaaaaagtttatgtatttacatattttaagtttttctgtaatatacattttttaaaagttaaattgctgagtcaaagcttatattacttaatttctcttcaaaaatatattttactggaactttacactatgggtgggagtgtaaatttatacagccactttggaaaaccacaaatagatcttcagtttgagagtatctattaaagcagaacattatgcacatactgaggtctagcagctcctcttctaggtatatatccaacataaatatgtacacagttcaccaaacaacatacacaaatgtggatagtagcctaatattagtaatcaaaaatgtcgacaacccaatgtccaccaatagtagaatggataaataaatattaatatatttataccaagtaatactctgcagcaaaaaggatgaatgaactacagccaagtacaacatgggtgaatcttacaaacataattctgagctaaagaagctagacataaaaaaaatgtattattccacttaattaaagttcacaagcaggcaaaattaattcatgatatcagaagtcagaataatggtttcctttaaagggacagtaatgatggaaatggggtacttaggagacttcaggaattctggttatactgtttctaaattctggtgctgattatatgggcctgttttgtttgcaaaaattcattgagctttttaccttaggattttcaactttcccgtatatgtgttatatttagtaaaaagtttacaatatcttttttatgtgtaaaaaccgctttcaaactcctctcagtaatgcctgttttcctgaactcttaccattctgatatacataaaagtcttttccatctaataaacataaaaagatcagttttttgtttttatcctattattagtgagactgagcatcttttatatatttgttaactgttatgagatctgtttttcttactgatttgtaacctttttaaagattatggacgtctggtctgttatatgtcaaaatataatattttaaataaattcaaactgacaaaattattaagtaatatgtgttaggagagaagttttattttaatagttaaatcagtttttaagagtcctttgttcttcaatcccagttctgtcaccaaatcatttcttaagagagtaaaatctgcttcattagttctaaattcgtaatatggagtccataaagaagatgctatttgaaggcccttgttttattgcttatatattaatattcttttttttttttttttgagacagagtctcgctctgtcacccaggctggagtgcagtggcgcgatctcggctcactgcaagctccgcctcccgggttcatgccattctcctgcctcagcctcccgagtagctgggactataggcgcccgctgccaaacctggctgattttttgtatttttagtagagatggggtttcattattctttttacctaaagtagtctgtttttggaacatctttaaaccacattttaaataaaatatcaaaatagaagtctatccactgctattatatattacctttagtttcttttcatttctctttatgtgttttcttaatatggagaagaggggaaagaacattggataaaatttgttatatttgtagtaaaattgcacatgaattttgtctgtattatgtttttataaaatagccctttaaaaaccagtttgccgcatgctattgcctttacttttcatccagtaccaaatttctaagtgatctcttaactaaaatactttgttgtagtaactcaactagtctgacttctcactgttgtgtctgcgtttttatgcttttggttgggggtgccttattgagatagtgtgtttatgtatttcctagacttactatattttcataagtttctcattattctttgtgaatatttttatttatttttgtttttttaatatgtaattcatatagacgctctgctgttgcccgtattcaggagttcttcagacggagaaaagaaaggaaagaaatggaagaattggatactttgaacattagaaggccgctagtaaaaatggtttataaaggccatcgcaactccaggacaatggtaccaaatgttcatggcattttttggtgaaattgcagtttcatgctctgagtgtttttccataatgatttatcttcatatattgccaatgggatttcagtattacattattaaatcttcagttatctctttatccaacatggttcttttagccctataatatattgtgaaagatcattattttttacaagaaaactctactaaaaaaatgcagattaaaaaaatttttagtttatacaagtaatcattgcttttgtttttttttttttttccccctctctttctcacatttgctgtctacctgaaaagtttctggtggattttttttttttttttttttagcttgtattagcattctttgttagttttggagagaaggatttggatctataaaatctaagttgattgcaaaaaattgtcaggccactttatacccatttttaagattgacaagtgaaaatttgttttagtgacttaccagatgaaataagaatagaccagaaagatctctaagatcttttgtagtttttacgatctacaagtttctacacccagtgtaatattaattacttaataagaaaagtttttgagatgactagtgtaactgttactctgatcccttcataactagaaagtgttgttctcctcatatacattgcatcatcagaaggtatctacagaatcagttttaatccatattactgccatattacccttgctgatgaatttgtagcttgctttctttaggatctaggttaaaaaataacatttgggttggggaagtaattagctctttctataaatgtcattgctagtaacaatttactcatttttaaaaggttactcattattaatagaagtaaccaatttatatttcttgcattttattgcctaaaagttagcatgaaaataattagaggaaggagtgagaaaagagaagataagtaaatttaacagtagctcagataacaataaaattgtctcccctcttttgtgagagcaccaaaaatggcaaagtagcagctgcagttaaaattttttaaaatccttgtttgaaatacaaagatttttgatgtttcattcatgtgcattcatttaaaaatgtcattataactattccagtatatcatatgcctttgattctgcttcataaaattaagtatgtttgtatctttctcaattgtgttagcttataatagctaatgatcttctttctattctttgggtctaaagcaaaatacaaaagacaatttcttttatctgtgaattatttcattgtcttataaagctaaattggtacaatttttggaaagttcagcaacatatatgtaaattgccattatactgcccaaaacccagaaatcctattctttcatttagcagttaataattaagcacctattgtatcccaagtaccatttcaggtgctgtaaatatagtattgaacaaagcaaagtccctcttcttaggggggattttctattacttactgccatcttacccttgctgatgaatgcctatcataatttaaagaagctagaagacagatttttgtcagtttttttttttatagataggggatctcactatattgcccaggctggtctcaaactcctcagctcaggcagtcctcctgccttggcctcccaaagtgctgggattacaggtgtgagccactgcgcccagcatcaatttttaattttactattttctaagccagttttttaaaaaatgtaagaattaaaacaaataaaaaaatgtaagagtagcataaatctttgttttaataactttgatttgaatttttaaataattttttttaacccttagataaaagaagccaatttctggggtgctaactttgtaatgagtggttctgactgtggccacattttcatctgggatcggcacactgctgagcatttgatgcttctggaagctgataatcatgtggtaaactgcctgcagccacatccgtttgacccaagtaagatatcttttctaggacgagggctagaaattatttgtatgactcatcagtcatacaaaattattcttttttaattgttaatattataagaataatccaaactatctgactaggcagcagtagagtcaattacagctgaacttgcacttcaaacacacctgtaatctgctttttgcacaaagtaaaagaaaataggttaaaaagtttattctcccaatatttcttctaagttttacaagctgtaagaggtttggtgtgactgaactttttattgtatatccaaatggaacatccagtcatttttagtcttcacatagctgaattaatttatcagaacaaaagagcattgctcgtcttctttttgaaattgcccacatatctcataaaagaacaatgaataagtgacttcaacaatgaatctgagtgacttcaacatggtattaaaattacgttctaggataacatttagcaaattgtcaaaataatattttcaattaacagttaaatatatagtgtacaattgctgttcaaggttagttttgctatatatacatatatgcataatataagcatatcctgaattgcatgtttctaggcttcatattaatatataaattttatttctagttttagcctcatctggcatagattatgacataaagatctggtcaccattagaagagtcaaggatttttaaccgaaaacttgctgatgaagtaagatttttattgtacttactatagaccatatttcaatttgttcctaaaatgcttccctaagaaaaattaaaagttattagttgctaacatgaaacaagttaatgcagttaaggaggtcaaattttaagaaaaagaaaaattaagataaaaggatgtctataatactagggaggtaaaatctaaatagtagcttactaattataatattcatcatcggtaacaccagattaggtgtatagtagtttaagaaaaacaggtttgagtattcatgttattacaataaagaatcacacacaaaaaaatctgtccttttaagaaaataattttattataactgtttctccaaaagcctagcaatttttccatttttagtacagctatttttccattttgagtttttcttaaaaaggaaatggaactttgtttttcaggattagtatatagcagaacaaatgagtgaagaatcttttcctttatcattatattttaagatttttttaagcctgttaaaacagtattttcagcctgagttctttggagctctggatttcttctgggatgggagagggaaggtggataataggaaggcattactctgggcctttcctccccaacttcaaccagggtttttatttgtgggttctcatatactatttcttatgaaaatgagaatccattgctaaaaatgttagtaagttggaaaaccactactctagactaacactgactgttcgtagcacaattcccatgtatactttcactcattgaataggcatttataaaacagttgatgtattgtatacataatgctgggtgtaaaaaagataaggccctaccctcagagtttagtgggaaagacaatgtaaacagctagaacatactgtagtggggtctgtgtcagtcagaggtatacacatagtgttttggaagcccacagagaggaacagctgtttgtaaatggggtagataggatggagaggtcttcacagaagaaataagaattggacagaagtctgagaatagttcaccaggcagacagggagcaaagcagcatttaagacagaaggatcagcatgtgccaaagcatgagagggtaaatgaaccatcagtgtgcctggaaccctagagtacatgcacaaaagtagcttaatcaaactaaacggttaggtgagggtaagattgtgaagggccctgtggggcaccctgatgagttgggaatttattatttcagtattggggaactgttgatcagagtagcatctttctcttcctctcatactctttctttcatcctttttttcctttgccatgttttttgcttttccacttttttcctttgctcatggttacatattgcatctctgggtgttcacgagtattcaagtaatcctattcttggtacttaaggctcagtttcttgttaacccttgcccaaaaatttattttccaagactactctgcctcagtcaaggtaacatcttttcaagggattcaagtggcccatggataataatttaactgtatttcgtcactaaagttatcagttctcctatagggaaaacaaggagccaacaaagtaaatggctctgagaagcaaattgcaagtaaaagctaaattaaattcttaaatgttttaagtagcctcaaaatttgacctttgtttttctgccatttgaaagagttgtgttctttgaccttcctcctttaaatacaagttacagtgattatttggcattgaatagacttaaggcagaaatatagacatcagacgcataaagaatgaagtaattcctcctggtactggctgattgtttacggtttgcctgatcttcaaggaaaaaatacagttactttatgatctttgatacgatttttaacttgccttgtaggttataactcgaaacgaactcatgctggaagaaactagaaacaccattacagttccagcctctttcatgttgaggatgttggcttcacttaatcatatccgagctggtaggaactttaagtatactactaaaaccatttttatatttgaaaatatattattatttaagatctgctttaaaggggtttatatatattttttaatatcacaaaatgagggtagcttaacttctaaactaggatttctgtgaatgcttgatcttggcacagtaacttagttcctcatgaactacatttgtcgtaaaatggtcaaaatgaaaagaccagagtcacgtaaaaactcttatcagctgctgttttcttagagtacataaccttaggatatattatcgtgcatattctttaatggtaggtttgttgaaaatcagtcatagcccaaacagaaataaatgtgacatgctaagaaatgaaacatacctcagtttgctttttgaatatttttttgttttagataaactgtgaggtgcagtgccacagatacataaaaatgcatatattacaactaatgttcaagaaggaattgaataatttataacaaaagaaaaggtctagtatctgttataagcagaatatatttatcaaacaaaagagttttaccactcttcactgatttcataaatgtccccatacgtttggtattagctatcatttaataataataggtaccatttataaagtaactataatgtatcaggcttatactaattatttcacagctttatcctcatttacctccaatcctttacaaagtaggttatttgtaataacttagcccaagtcacacaactgataaatattaaagccagaatttgaaattagcttccaagcccttactcccctttgacctataaatttcacttacaggaatatattcaaatcattcatatgacatgcaaacctctggatgatctaatctcaaactattctagctgatttacagcattcttttcttctgtgactactccatccacactggccctctttgatttttggggatacaccaaactctttcccacctcagggtttttataatcgtgctgtcccctcccatcttcactctgttgagataacttcttactgtaagaactgcataagcagtgaattaaatatcacttcctcagagagagtggggaatggagacaagtattccacagaaagtagacagcgtatagcgtttttctaagccctagaggagagaaagtatagcacatctgaaaaattgaaagaagacccatatgtttgtaattaaaagaattagaaaataatcctcaaatgtaaatattaacttttaccaggaaagagggaaaacttcaaatggtgaaaacaacaacaaaaaataaacctggaatgtaaacaaaaaatgttaatagaccaacaaaatgtttttgtgatcttctttgggttcctgtattattaaattataataacactgtaacttttttaaaatatattttgttcaataacagcaagtaacccttaaaattcatccatttgaatttcacatttgaggaagcagcattttaaaacaagaaaaacgtttactggtaatgacacctaaaatgtgcttactcttatctagtggatggctcttcctcagtagttttcctgcagaaaattaattctctttccagttgcacaaaaatctatttgtgctaatgtagcaatggttggttagttaatagccactaccatccttctttggttttagaattagataaggtgttttataatataaaaattctctttcatttctttttgccagcaatcaaaaagacaatttctagttggtttagtcagcttatcttcttgcttctcttatacaaaatactagatagaataaagtgcccaagagttaacatttctgctgcccttatctttaagatatctagttatttgatgggtcagttagtcaaccactctttttctctcctatccagtgtcctgcagtccaaatacaataatgtgtgcatattcaggagagttaaaaatggacttggatcaaataagcacatggtagccacaaagtacctctcggctcatccattactccagaaggcttcctaggaagtccagggaatagatacggacagtttctttctgttggagctgtgatttttaatgaaggagcctcttaaaatcatctgtaggggttttacaaactacaaatacttacctaggtctcacctgctaaagattctggttcattttagctggatagagattaagcgtctacatttttaaaaagcaaccaaagttaatctcatgaataatgcactaaagactgctagtctagtggccacttgagatggaaaggcatttctgacatccctagaagctttgagaggctttggaaagatggtaatggtttgcatggatcattctagactcctctagaatgtcttagaatcactttactgccctgcttaaaattctcctttgcccacacatgttcttagggtagagtccaaatgtgttaacatgtcttataaaaccctgcattatctcttgacattcttcccattatacctctggatcttagcacagatagttatcatttctctgtcatgggtttgcaaagcctgttatcctattgagatcacaatcacttattaaatcgttcacagattgactccctcagtaagtgatactaactttactccagaatagacctaatatttatatacccttgatctccctgcttctacttctcttgtcctcatagtctgattttcacacagcagccagagggatcctttcaaaacaggtcagttaatttttttgttaatggccagatatggtttttattgtaaccactcaactctgccattgtaatgcaaaaacagccatagaccatatgtaaatgaacaggtatggcacttataataaaacttaatatataaaaacagagccaggtacagtggctcacgcctgtaatctcagcactttgggaggctgaggcaggtgaatcacctgaggtcaggaattcaagaccagcctcgccaacatggcaaaaccccgtctctataaaaataaaaaataaaaaaaattataaatacaaaaatacaaaaattagctggacgtgatggtgcacacctgtaatcccagctacttgggaggctgaggcaggagagtcactttaacttgggaggtagaggttgcagtgagccaaaattgcgccactacactccagcctgggtgacagattgagactctgtctcaaacaaaaccaaaatcaggcagtgggctgtatttgcctatgggctatagtctgctaccacctttttaaaacacaaattagataccaccccctcttaaaattctcagggactccctattgctcttaaagtaaaacccagacttcttactctggccttcaaggtcctacatgacatacattctgccaacctctgacttccactcagtccacctttttttctagctcactacattttagccatactggcctctcttcctcaaactcatcaagcttagtagcacatttaggaccttttcacttgttcatctgcccaactttgcccccaggacttcacatacaattgaggtcttagctccaatatcacctccttagaaaagtcttccctggtagtgcggtggctcatgcctgtaatcccagcactttgggaggccgaggcgggtagatcacgaggtcaggagattgagaccagcctggccaacatggtgaaatcccatctgtactgaaaaatacaaaaattagctgggtgtggtggcgcgtgcctgtagtcccagctacttgggaggctgaggcaggagaatcgcctgaacccaggaggtggaggttgtagtgagccgagatcgcaccactgcactccagcctggtgacagagggagaatcagtctaaaaaaaaaaaaaaaaaaaaaaaaaaaaaaagaaaagaaaagtcttccctggtcactcaatctaaagttgttttctgtgtcttctcatatcttccctctcacttagtcattcttgttcattgccttattttcctcaagtacttatcactcttaagctttaatttctttatttattgtcttattacagattagaggagaaaaatacaggtggtaccttgtttgttgtctatcttcctccttagaaagtaagcttataaagagcagagacccagtttgtcttaatttgcagctgggtctttaggctcctaaaacagtgcctaccacatagtagttgcttaacaaatactgagtattctggtaaataagtacacatctagtatcaaatctctagctaacaatgaatttgtattatttcttttaaagaaagtaaataaattctttgtaaagggtagcctggaaaataaaacaacagtgttttttgtgaaacacaggcttccattgggaaatttttttcttatctaccttccctccctctgcagcaaactcagtgtctcttcatatcattatcttccccagtttcctgaagaaatattctaacagaataaaaggaacctttctacaaatgtaaaccttatttacaaaagcaatttgacattgctacttctgaaaaacagtatacatagacatcctggctaacatggtgaaaccccatctctactaaaaacaaaaaaatcagccgggtgtggtggcacgctcctgtagtcccagctactcgggagggcgagacaggagaatcgcttgaacccgggaggcggaggttgcagtgagccaagatcgcgccactgcactccagcctgggcgatagagcgagactcggtctcaaaaaaaaaagaagaaaaagaaaaacagtatacatagaagtgattcttatttccagtttttatttaagagaacacactgttcttcagacctccttgtctataattgccaaccagagatttgtataagtgttaactgctttgcagccttactacttcagtagcatttcatgaacagaagatttaattaattctgagaagttgggcttacattctggaagaggtgactatgcatcagttaaatgaattgaatttgaggagagaacaactattctgctttcctcatttcagaagccactgtcacttattctgtgacctatcgtaagactcttggccctcatttgtctctttattgtgtgcctctgagtgtaaaagtctaacctctactgcaaactccctgatttaaaggctgtgacatttttttcttaactctctattatcccatcttctttataatgtgacaaccaaaagaaatttgagtaagaagcctgccaactttgagataggccgttactgcttcatcatgctctaacatgacaggataggtttcttgaatatattcagtcatactcaggattcccattcctgagccctacttaagtagaatagcaacttcatgttttgttctctcttgaaagtatcacacaataaaaacaatgtaattttttttatactaatatcccttaggtagccttttattggtcagaaattcttctactgtgtttaaattccttactgatctataaaggtctattcaaatcttattttgttcatttattttataaatatgtattgaatacatatttataaaataaatgaacaaaataagatttgaatagacctttatagatcagtaaggaattgaatacttatttgtattcaatacctatttgtataattaaggttataaaggttacacatacattatgtcattggtttgacattggattagagttggcatagaggagatttaatctaattcacttggacaattaaacaattaaaagggacatatagtcccttcagtgtactgttcttggtgctgttgacctaggatccagtgggagcatttaatcctgtgtagataataaataaaatctcaggattcagtcttctcttgctgttgacagtgggactgaactgttttccttatgcttaaccttaatattttccatgttactatgtggaaatgtttctggggcagaaacatcctagttccatctcagtgatggtagtgattttatgctgttgccttcttcacaatacccttatgtaatgtatcttaccttcataaaacttatattcatttattcagtaaaccttcattgaacatcctatactaggctctgaggatataaagataaaaagaagtaactcctgccctccaggaactctcaatctggtctgcaggaagacatgcaaacgactattactgtaattaggatcatcattatgaagttcatataagatattctagaatgtggaggagggagttcataattctgcagatagcctgtttggaaatgtccaggaaaagtttcaccaagggtataatagttgtattgagatgagtaaacctttatagctaaagaattgggcaaaagtatcccaagcagaggaatagcaagtgtaattcctgaaaacttgaacgagcatactgtactcaccagtttgtaagtttatattcacttgagtatttaacctaaataagctccttgagaccagaaatttacatctgttttggtcaccattgtattctcaggttttatcacaatgcctggaacatagtatttaatttaaaaaaatctttttacaaacagaattacacaaatcctcaacaatcgtccacatattttctctcacacagctgcctcctcactcccctttgcagcacctgatgtacctccttagaaacctagactccaaagaacactgtttgacaaccactgcagtagaacataatatatcaagattttaggagtgggtttcttttttcatttttacatgttttagaataacatgcataatcaaagctaataatactgtgttttctttactcttttatttgcctctaaagacatccacacatagtggtgaactgatttttaatgcgttttaaataaaaggcattgaaaaatattaataattgtaattactaaaagtatttctctttgcgattctcttatctgtgtttccagaccggttggagggtgacagatcagaaggctctggtcaagagaatgaaaatgaggatgaggaataataaactctttttggcaagcacttaaatgttctgaaatttgtataagacatttattatatttttttctttacagagctttagtgcaattttaaggttatggtttttggagtttttccctttttttgggataacctaacattggtttggaatgattgtgtgcatgaatttgggagattgtataaaacaaaactagcagaatgtttttaaaactttttgccgtgtatgaggagtgctagaaaatgcaaagtgcaatattttccctaaccttcaaatgtgggagcttggatcaatgttgaagaataattttcatcatagtgaaaatgttggttcaaataaatttctacacttgccatttgcatgtttgttgctttctaattaaagaaactggttgttttaagat

SEQ ID NO: 38243 - DNA, 6180 bp, Homo sapiens
cgccacccgcttcctcgccgcagggggcccgcccgctggcccgtttccggtccggtgggtacaagatgacggagccgggcgcctctcccgaggacccttgggtcaaggcaagccccgtgggcgcgcacgccggcgaggggagggcgggtcgggctcgtgcacgtaggggggccggaagacgaggggcttccctcctgtccccaaagtcccccacgctctccgtgccccggggctgcagagaagacagctctcaccccgcgtgtgccaaggtggggagacaaacgaggcgtgtgcgcgcgagtcgggggaacggggcactggggtggagtaggggcggaagggatcatacacaggggaggcactcgcacgccctagcctgtgccagtctcgggggactcattaagctgcccgcgcaccccgggctgtgtgtgtgcaagcgcgcagggtgacagaggcgccttcccggaatggggggcgcgctgtgcgtgcctgcagtggaaggggcgcctccccctaggggcggaggtctgacgggcccttcccgtgctctgtgccgcaggtggagtatgcctacagcgacaacagcctggaccccggtgagtagctgccccatcttaagctctagagggacactcccgcccaggctctctagattcttgtggcgttgccaaccacgcctgagcacagtccactctccctgagcagagttcctggcttgagacagcaggagctgaaggacaagggcagaaaacaactgagggtgacacctagttccctctgctctggaacagggaagtggtggaactgatcactcaccactcagtggagcagctgatcactcacaccctcatcacgtccacatgcccgtttgtgagccaggggggtatcatgcaggcctatggagcagtgtagacactagggagcagagcactgcagcgtggtctggcaggaagtggggggcccagtatggttggctttgggttgaagggaagaggtcagcatttaagaaagccattgtgtggccgggcgcggtggctcacccctgtaatcccagcactttgggaggccgaggcaggcggatcacgaggtcaggagaccgagaccatcctggctaacacggtgaaaccccgtctccactaaaaaatacaaaaaaattagccgggcgtggtggcgggcgcctgtagtcccagctactcgggaggctgaggcaggagaatggcgtgaacctgggaggcggagcttgcagtgagccgagatcgcgccactgcactctagcctgggcgactgagcgagactctgtctaaaaaaaaaataaataaataaaagaaagccattgtgtcctacaggtgtctgagggtctggcaatgttccccaccccaccccttagtgattggggcctctcttttccagggctttttgtagaaagcacccgcaaggggagtgtagtgtccagagctaatagcatcggttccaccagtgcctcttctgtccccaacacaggtaggcagtaacatcccccccgacctcggggggctcagatatgtcataattgtagtacctttcctagacagggaagccccagccatccacacaggggtgctggagccaaagtatcagacacaaggtctcaccatctttcacctcatctggaacattaggtggttctgtccatctgccttctctggacaccaggttcttcccagctggggaaaggtgggctagctggaccccactgggccccaagatgacctttccctgcccccatctctgagcgtagatgatgaggacagtgattaccaccaggaggcctacaaggagtcctacaaagaccggcggcggcgcgcacacactcaggctgagcagaagaggagggacgccatcaaggtgaacagggaggcctgtgcctcagccagtgcgggagggccctgcatagtttagcttccctgtgccctgacccactcagacagtcccaggcaccctagggggtgggcaggtagtatagtcccaggcacaaacacctcccttgcagccttcccaccccattgagtttgtgagcatagaacttggtgtcatggaggaactttgtgccattttgctttaatctctcagggttaaagaacccatttcccctgctgtttccacagagaggctatgatgaccttcagaccatcgtccccacttgccagcagcaggacttctccattggctcccaaaagctcagcaaagccatcgttctacaaaagagtatggctagggaaagcactggaggggatggagccaagcggggctgtgaagaggccagtgcctcctacccacccatggctcggccttggtgtggtgattgccatgggatagttggggtctggggtaaggggaacaaagtcagccttatcttcttggttgagaatacttctgtacctgtcctttttttcttgcccccaccctagccattgactacattcagtttttgcacaaggagaagaaaaagcaggaggaggaggtgtccacgttacgcaaggatgtcaccgccctaaagatcatgaaagtgtaagaggggtgctgaatggggggaaccagaacttctgaggcaacttcattgcacaccctcccttgttcaaaggccacatcagttactgctgtacagataatactcttagttcctgagctagccagtaggactgtgtatccccaactgtccttacacatggcagacactcaggaaatgcctgttggattaatgtaaggaaggttggagagagagggccacctttcctgacctggaagcagtatctccctgatactgaaccccacccagaagctctctggggctgccattcctgggagtacacaggatagtcccgtcattcttcttgggtgggcggagctgctgcagcacctcagccctggcctgcatgcttttaggaactatgagcagattgtgaaggcacaccaggacaacccccatgaaggggaggaccaggtctctgaccaggtcaagttcaacgtgtttcaaggcatcatggattccctgttccagtccttcaatgcctccatctcagtggccagcttccaggagctgtcagcgtgtgtcttcagctggatcgaggagcactgtaagcctcaggtatggggcaacaataggcacagggtctgcggttttctctaccatcaagcaaagtggcccaagccatcagctgttgagaaaagcgtggcagctgcttttagatcttaagggcgtttctacagctttgagggccctggtattttcccttttctttgctgtctaacccacatcttcatgttacggtttcattcggcaagtgtgacgtgagctcaatgtgaagtccagctcttggcttttgtctagcccatgttatcgctgcccctgtatggaagccccaggcatctgcagcagaattggaaacgcaaattctgggaccctacctttaggccccctaaagtagttgccccaagagctttttaaaaatttatttataatggagatgtgctaatggtattgcactaagtcttctaattgaagtctggttgctttttctgaggttttaaacttgtgtctgagatttcttgtttgtttctcaacatttttttttttgagacgggagtctcgttctgtcgcccaggctggagtgcagtggcacaatctcggctcactgcaacctccgcctcccgggttcacgccattctcctgcctcagcctcccgagtagctgggactacaggcgtgtgccaccatacctggccaattttttgtattttttagtaagacggggtttcaccgtgttagccaggatggtctcgatctcctgaccttgtgatccacccgcctcggcctcccaaagtgctgggattacaggcatgagccactgtgcctggcctcgtttcccaacatttttattgtgaaacacattaaacatattgcgatgttgagaggagttcacagtgaacactcgtatacccgctccctaaattttaccgaaacattttactatatttccatctctccatcttgcttcaggagcacctcaaattaaactgcagacatcagtacttcctgggggctttttttttttttttttgagacggagtctcactctgtcaccaaggctggagtgcagtggtgtgatgtcagctcactgcaacttccacctcctgggttcaggcgattctcatacctcagcctcctgtgtagctgggattacaggcatgtgccaccacacctaatttttgtatttttagtagagacggggtttcactatgttggccaggctggtcttgaaattcaggtgatccacccgccttggcctcccgaagtgctgggattataggcgtgagccaccacacctggcccccggggggctatttttaaagcacttttctaaagtacatggctgatctaggcaggcatcttggaaactactctgcgttgacttgggcattgtctatttcttcctctgctgccctcgccagaccctgcgggagattgtgattggcgtcctgcaccaattgaaaaaccagctttactgaccggttcttggaaacctggagaacagccaacaagaggcccttgaatctctacgtggccactgaactgctgggcccgggagactggactacaacacctcacactggtcagctggtttctacttggtgtttggtttttcccagccccattttatcttcagcggagccgcggtgtttgttttgtgaaagcttctgattaatttattatattgacgataaaactcaaacctacccagccttccccccactccatggaagtccttgggatgggcgtctgctctggacaccccaaagagctcctgccctctcagccctttattcaagcctcagatttctgctcatgatctacatagatttggaaactgttttcctctgttttggtctcttgggcaacatttttggcccaagtttgggcaacatttggcccaagtttgggcattttggcagtagctgtatgggagaaaaagagtaagaggaaatattcccacagccatgaagggtgaaagggcaccttgtgcctagactagggctgcctggtcagtcccaggtgaggccaagggctttctggccatctcagggaggggccaccaggttcctcccctcaccccatattccatcaccttcctcctctgctctgggtggtaagggaagccctcccggttcccacaggctatgatgctgcatggcagaggcaggtataacacagcactacatattggaaattttttatttttctaaataccaatgcagttttgctacggttacaattttgaaatattaactgagcctcaaaatcaccctttctgtcaagcatatcttggcctctcccatgtctcagtgttgcctgcatttctcccaggacttgggggtggggtgaaaagcgtacaaaagatacttaaaagggctcctggggtacacaagcccagcaggtcctgagtgaagccgtgggccctccaaatgctcgttttatagcaacctctctctaccctagttctccaaattcacttctgccttcctcaggtttgatatctggcaggtttgactatccagaggaaattaaatatttttatataaaattaaattataataaatattgccaaatgctttcctttagcattgttccaagtctaaatgttaacctcaagctactgcaatttagacaatgaaatgggctgggtctacccccagccaccagccctcatcctctctacccagtgctctggtttatgcttgtctcctgactgctctgcttaaaggtgaaagtagcaggaacaacaacaaaagccaaccaaaaacaaggtagccagtgcaagacatctcactcttctgacatcctgcagtccccaccagtcctgaccgtgggcccctcaggggtctgggagtgtgacgttgtaatcttcatccgtctctatcccaacttcctcctgtgagacagggagacaagtgaatgagatgtcaccaggataagaccacagggaagcaaagaaggaagagagctccacttacaaagaactgcttcttgctcttggggtatccttcaagtattgcatcagacagctctgtagcctgacaagaaataaaaccacccgttttcagatgggcagcactgggcactgcctgtcagtttatgatattgtgt

SEQ ID NO: 38244 - DNA, 7933 bp, Homo sapiens
ggtggcggcgcggagccttgggcccggctgcggcccggcggcggccccggcgcggtgcgggcgttcgcggcgccccgggagctgcaggggccccgggcggcggcgaggccggagaggggcgggcccgggacaccggcacccggcgccctcggagccaaaggcgcgcggcggacacggcggggccctcgcgcggtgaggacgcggaggcgtgtgggctcctgtcacttcacacagcaaacgctgcccgccgcgtggctccggaggagtctcgcgaggggcgcccctgtggcgtttcgggccagccgggccgcctggccgggtgcggagaaggaagctctgcccttcccctggcccggcgcggagccgattctcccgggaaggggccgggggtcctaacttcaccgccgggcggcctgctcagggccaggcccgcggggacgctggcgtcaaggtttcttcccccttcacgccagtcccctaccaggccgacatcgagtcccgctccccagggagggtcaagtcccaggggtccagcggctcccccgaggtccgctaggaggtggcggcactggagtggccgttctccagcctgcaccgacccccgcctttagtgcccccgcgtgtgacccaacggtggtactggagcggccttagaagggtgaccgctgcctctgagttgagtcttaagcccctcgttgggcctggctgaaccccgggtctgcgcctttcccccagcctggagacgatgccaaagctgcagggcttcgagttctggagccgcaccctgcgaggggcccgccacgtcgtggcccccatggtggaccagagcgagctggcctggaggctgctgagccggcgccacggggcacagctctgctacacgcccatgctgcatgcccaggtctttgtccgcgacgccaactaccggaaggagaacctgtactgcgaggtgtgccccgaggaccggcccctcatcgtgcaggtgcgcaggaggggctgtggccgcggccgcggttgggttcccggtcctggaatgcctggggaaaaacccttctctctgtggcgggacatcactttcagcctttccagagacagctcaattccaggaggagagggagaaggtggcaccaggcatgtagagtccacgtagccacagcagtgattcctgtggtggagccagggctgccaggtgcacctgccagaatccaaccccattctctaggagtggctcaggcagcctgggtgctgtgaggtttgcagccctgctggggcctctggattgctgcctctcacactcacactccctcttcagaaccagtggagatggctctgctcttcagaagtcagtgattgtggcttctgccacagttcagaagaaaatctgtaaatccgggtggcttggggactcctcccggctttgtcatattgtaagcctccgcaggacagagcaccctcctgcagtgaacctgggcccacaccctcatggggtcacactggacctctcgtagggctgggcagcaagggactagggcctggctgggcccgtggctgactcctgcatcttctccagttctgtgccaatgacccggaggtgtttgttcaggcggctctcctggctcaggattactgtgacgccattgacctgaacttgggctgcccacagatgatagccaagagaggtgagctccatgtggagcatgggggcacctggggcaggggccagagccagctcagtgcagccccaggtgtggtgagcttggaggacggcaggccctgcctctgtcgtgacagtggctcaggctggagccagctgtcctctgtgctccgcctctggagggtggctgtcctcaggccttgggggctaggggccgagccctactggctctctcttccctcagggagctccctctgcataaacatgattgctgatacagggtccccattacccccttgcactgctgtgtgtggggctgagcctgctacctcaccgggcccctgaggaggtgttacttggttccagaccgtgcagggtgggggttccattcagcaccttctgagcttaggcagctgggcaaatagagcccctgagtctgatgccgacaaaccactgctctgactgtcccactgccccaactggagacactgctggttctggggacctgtgtcccgcctgacagggcagctcctggcctgcgtggatgcaggaaagggtgcagagggggtgcaaggcttcggccccaccagccttaacacaggtgccagccaggccatgcttgctccttgcaggtcactatggcgcctttctgcaggacgagtgggacctgctccaaagaatgagtgagttggctgggtggatggtgaaggacccccagagaccctcaagagggacacatgggcactgtccacttggttggggctcaggagaggacaggcgttggcaggagttctcagcatcaccctggggcttcctgcccacagcagcctctctgctggaaggaggtggctgtgaagttgcctgtcctgcaccacccaccccttaaaaccagacagtaggtgccagggcagagtccttgctcgggcccagccccagatgtcctgggagacagagccggccttggccctgcttgtttgaacttcggagggccgggggtatggcggagggagcctgcccagcaacctgagggagacacccagatggtggcccgggctgcctcccagcctcccggcaaagctgcctgggctccgctgtctgcagggccctgggctctggggcttggccgctaaagtgggaacaccatggccccctcagaagctgcctctcttctccccagttttgctggcccacgagaaactctctgttcctgtcacgtgcaaaatccgtgtcttcccggagattgacaagaccgtgaggtacgcccagatgctggagaaggccggctgccaggtgagccctgggctcgcgggggtgtcatgggcctcagctgggcctttgcgcagaggacatagctgaggctcttcctgtgtccagacaccgtgcaccgtcggcctcatgggggcagtggccctcctgactggcctgtccccactggctctgagtgccaccaccccaagcccaggcctctacaacagaaactgctttcctggctccagggttttgtccctgtggagagagtaatgtcggcatctctgacatattcctagtgtcacagaggccggcagggcctcctttggggatactcagcatccagtctccctagagggtgaggaaggggccaccaggctgtcagcagagctgctcccctgcccgtgttccccgcacactgagcctggcctggcgcgggcctggatgggctgctgtctccgggggtgcccctcaagacactcaccttctgaaggtggacagcaaccttggtgacccggggatgagcttgcacaggggctgccaggcccaggacccactttcccccccagtgccccactagcctggagtcagtccctcccacacctttggccttgggcagtggggatgctgccacttcccggcctggctcttgcatgggcctgggcagcacatgcagcctgaggttcccacagagtgcagaggccttggggtaggccccagatggccattcctcagccctgcttcaggagctgatatggtgagggaaaggtccctgcagtcgggcatggggcacagggctgggaggggcagagggggctcggaggggtggagtaggggcagagggggcgtggaggggcggagggggctctgaggggcggaaggggcttggaggggtcaagcgaccactgctctgtcctagttgctgacggtgcacggacgcaccaaggagcagaaggggcccctgtcgggtgcagcgtcctgggagcatatcaaggctgtgcggtgagtgggtgtgggtgacacagccctcagtccttggggctttgctgggggtcccagctccacacctcagggtgctcggcacgcctgacgcccgtgaccacccagggggccgtggctgggggcagcatcacctgggtgctgttccgggcgggtggaaacaggcatttctctgccaacaggaaggctgtggccatccctgtgtttgctaacgggaacatccagtgcctgcaggacgtggagcgctgcctccgggacacgggtgtgcagggcgtcatgagcgcaggtgggcagggcccaggacagcagccagggccccatgcacacggcctgataccaccgcccaggtcggtgcctcccactgcctactgccctccccatggtgctgttcacagatggtgttcatcaatcccagtctgctctgatgggcctgagctggccttgtcccttgtgaggtggcacagaagggtgtcctgagtgtcccaggctttcctgtgccgtccacctggagcaacccacgaggtgtccttccccgctcctcctcccacagagggcaacctgcacaaccccgccctgttcgagggccggagccctgccgtgtgggagctggccgaggagtatctggacatcgtgcgggagcacccctgccccctgtcctacgtccgggcccacctcttcaagctgtggcaccacacgtgagttgccccctaaggcagaagccacgttggagggccgcccaggcagattccgtcagaccccacctggggcattttgcaggttttgtcaaaacaacttgctgctaagtcaggtcttgaggggctggggtgacttaggagtggagttgggcaggaagagacacaggtccccgtgtgcccagtgctcagcctggggcctgacggtggagccgggagcccagcctgcgtgacagggcctctgtctcaggctgcaggtgcaccaggagctgcgagaggagctggccaaggtgaagaccctggagggcatcgctgctgtgagccaggagctgaagctgcggtgtcaggcaggtgctggggctggtgggagcccggccttgcagggggtgaggggctggggccatgaccagggccttgggcttttgcaggaggagatatccaggcaggagggagcgaagcccaccggcgacttgcccttccactggatctgccagccctacatccggccggggtgagagcccagccagccctgggcggggatgtgcaccaaggtgtgggctccaccctgtgcccacagtgctgcgcctgccctgcttgtcctcagccattatggtcagtcatctcctgcccaagggaaaggaggagggaggcctcggctccgagcagcacacaccttccacgtgcccctcggtgtccttggtggaggatgctggtggctcagctgtgtcctccctcagtggacgctcggattttaaatcttttcttccataacatacttctctgagctcctctgatcctggtggatttgcccgtgggtcaagaggttgaccccagcttctgctgggttctcagaggtgaggccatccgtggccacagccctccctggagctggtggttcagagcttggggctgcccgagctgcggactccatctcagaggccccggactccctagtgacgagtcctgaatgggctgcccgagggaaaggagggcactcctcacagcagcggcactcgccacggccgcctggcccctcacccagactcagacccgtgtggctgtggctgctgggcccctctcacagtgtccttgggctctgcccgctgccctcccctcaggcccagggaggggagcaaggagaaggcaggtgcgcgcagcaagcgggccctggaggaagaggagggtggcacggaggtcctgtccaagaacaagcaaaagaagcagctgaggaacccccacaagaccttcgacccctctctgaagcgtaagtgctgcttccgctgatgggcccgagagagcctcttcatcacccccatcctccctgttgccagtaacaggaacccagacttgtggtcagcaaggctcaaggcccagagctggaagcagacacctggagggcttggcggagtagtcagccagacttggggtcagaacggggaccctgtgcaggccacagcccgtgcatgtgggacatgggctcagtgaatcagatgaggctatgggacaagcttttcagccaggtgaagctcgtctacagctcagggcctcgggtccctgcggctgcccctgcccagcctcacacaggacacctgagcagctgctgagagggaggctggggtccccgggagtgtgtgcatgggtcttgttgctgggccaaaggcacgggacgaggctgctcgcccctctcttagccaccagtggcaaggcctcagcctagtgctgtctcccctgagacccctggtcgccgccgtatcctgggccagcccatctgggccctcaacaggtggcagcctcccagatctctgacaactttacaagctgcaggggagaccagcgataaccctgaaaccttcccatgtaacccccagggcgctggccagtccaagagcagctgccacatcaggctggtgccagcagtccctgcctgccacactgccccccaccaggccactgaatgaggcagctgggagaggcaggaagtggggcttcaggctgaattcttgatttgacccttcttggcccttttgcttgggagacctggaactgaagggcatggaaccccccttggaccctgtgggcaggaaaactgctccccttgtccctgcctgggggtaggacagataaggctgctcgtcctgcggcggccccccagcccacctgcttcctatccgtttcctgcaggatggtgccccctgcatcccctcacccattgctcacggaaggaaaagcagacgtggccagcctgcatcctctgccctccctgagcctcctggcctggctggccacagctggcatggacgccatcagcaggctccgtgcaggcggacggggcagcccccacagccagggcaccctggccctcactcaccagcacccttttgttcttttcctagcaaaatatgcaaagtgtgaccagtgtggaaacccaaaggtgagtgggttccggctgcaagccaccaaggcttcagctttgggggtgggcagggtggtctctgcactgcttggggtggcaggtctggtgcccgcccagctgggtttgcaacgtggctcaaggtggcatggatgcctcaggacggccccttgcttccagccaagcccctgcccaggcctggaggggaagagagtctgggtgggtgggggtgagggagaggcatctggcttgggagcagttcccagggctgcatccaggccgtgggcatctggcagaggcttccccagtggggctgctcccctgctggccagcctggccccgggagtggtgctggccacaggctcccgagatttcctgtgcccagggcaacagatgtgtgttcagcctgtgccgcggctgctgcaagaagcgagcctccaaagagactgcagactgcccaggtgagggcgcctaccacccgccccgcagcaggcaaacagaccccctccgcctcctgacccccgactcctctcactcgctctgccaggtcacggattgctttttaaaaccaaattggagaagtctctggcctggaaagaggcccagcctgagctgcaggagcctcagccagcagcacctggaacaccaggtggcttctccgaagtcatgggcagtgccctggcctgaaggcccacaacccccacccccaggactgctgctggagcctggacacgtcctacttaagaaaatgccttttactcagggaatctcctgctacttaatgtggaaagacacgcccatgtcccccttcggcccactctgggggcctggaaatgctgcagtggggagcaggccccaggctggacctgccctgtcctcagcacgcgtgtgcaaaagtgaacaataaatcatttcaaagatgcgagagcc

SEQ ID NO: 38245 - DNA, 35162 bp, Homo sapiens
cgctgtttcgtgggaccaggattgaaacaagatggcgggttcgtggtgagaagccgtcaaggtaaccgcttccctctactcctcctgtcgaggacttcctcgaaactgggcagtcccacagtgttggtcggcagttgtagaggtctcccgcctgtcgttcccggcagggcgaggttgcctgcatccccagcctttgtccttcctgcagaagagccggcatgtggctgcgcgtttcttatagcgccccctttgttccctggcggacgcccgtggggaggtgatgcagcttgtggctctagggactcctttaggtcgaagagttctggtgctcttggtagcctgttcctcaaacctctgaccctcagaggctctgtagcttttgttttggggttgaattccgggctgagggacttgatctctgaaatgatcttcctggggtgaataatctgactcccagcagggcgtgcttttctctgggcttcggacagaggggacctaatttcccccaagatgttttattcgtggtcagaagtcatgggtttacgtcccacgcatgtattaagcagcgatatactgagcaagtaatcgattgacctctctgagcctttgttcttaatctgaaatggagatgctgcttcacacacttgtgaaagtcagagcacatattgtatatgaaagtgggttgtaaactaaaaagcacacctatgagctcagggttaacggtgttaatgtactggcagtgcaaggtatcagtgtgagtggtttagactagcaaataagagggcctgtgtcctaattctcttttatcactattggggggaagggcacggatactcattgaagactattaaaaacaagatttaacaatggttatttgtcatttattcacaacaggccatgaagattgtggttttccccattttgtcattggagaaactgaggatcgtttagttaatgacttgtttaaagtttcccaatttggcagtgactgactctaaagtccttggaagcaagacgtttaaattttgtactttagtttcttcatgaatcagaataaagatacctcacatgattaatacgagagcaaaatgaaatggtggtgaaagtacgttggaaagttaaagactttgtacacatataagatggtgaaattttatctgggacttgagggcatttatgagttcctccaattgagtaataggctaaggataggccttgtttgatatttctttattattattattattattaatggctcagggcagacaactatttcatttaatcagaaacaggatagtactgtaaatgatgtagtatcttgtgtatggaaccttggagggtgtacacagccacactagcattaaaagaatgaatactctgtgtaccatttgtgagtgactgtttcaagagtaattacacatttactgagtattcattaagtggaaggagctgcactgggtcctgcagagaagtttgtatctaagataaatagtaatggacatagttccagtggttctgatcttatattctgtccatgtcgctcttcgtcctgttgttcaatcatgtggaattgccaagttgtttaaaagcattgcttcagttgacttctaggcagtgattcttaccttgttcttgtggtgtttaatataacttaaatttaccataggtagcactgatttttctttatctcttcagcaggagtagaaattggtatgcttagaagcagattctaaaagcagtttctcttcagaacatcttttttcataccacttgataagcatcttgaaacaccatggctgtagctgcagtaaaatgggtgatgtcaaagagaactatcttgaaacatttatttccagtccaaagtaagtgaaattttttttaatgtttaaaaacttttaaacttttaagaattaagaaaatttaaagcatttagttattgtatatgcctgtaatttgcaggagtgtttgcagcaatggaaagtgggagaaaacctaaatgtcagtcagaaggggaatggataggtcagatgtggtgtctcatgcctgtaatcccagcactttgggaggctgaggtgggaggattgcttgaggccaggggtttgagaccagcctgggcaacatagcaagacccccacctctaaaaaaaaatgtgggttggggaggggaatggataaattatggtacatctgaactgtgactgtcatgtagctgttactgacatggaaagatctccaaatagaaacaaaaaaagcatgtcagaaccacatctatatatatctatcatatgatcttatttgtatgtttaaaagatgatccatcatatgcatgtgtgcatatgcataaatgcagaggtaaaaggtctggaccaaacagtggttatctgtgtagcccactcttgggatttggctgagggcaggagtaagggactggtcaagggtaactttctcttgttcgattacatgtattacttttttagtatttctctcttttttttttttttaacggagtctggctctgtcgcccaggctggagtgcagtggcgtgattacttttttagtatttcttaaaatgtgcgaataaagggtaaattcacagtcccatcttccaaagataatcattgttaatattttggtggattgtcattgtgttttttctatgtacctagccatttttaaaaaaatgaaatgtaatttctgcctttcttttctaaagaactgtatatagttagtattttctcgaaagcttgttaatacatgtttgacagtcaaagcatggacccaaataagtaaatagagtattaaagtcttttttctcagccaactgtgctttctttttccttttcctgtctgtaaacagagtttatagctcttataaacagctcttataggaagctttccatttctaaagtagacatgtatagaaggcaacagtaggtttgcctttttatattaaactatgtgagccaactttttatttttattttttattttagattcgggcgtacatgtgcaggtttgttacgtggatgtattacatatactgaggtttgggcttcaactgaacccgtcacccaaatagtgaacatagtacccaataggtagtttttcaactcttccctccatccctccattctgttttgagtccccagtgtttattgttcccatctttgtgtccatatgtacccaatgtttacctcctacttgtaagttagaacatgtagtatttggctgtttttgcattaattcacttaggataatggcctccagctgcatctgtgttgctgtaaaggacatgattttatttgttttaatgtctgtgtaataatccatggtatgcatatacaccacatattcttccagtccaccattgatgggcttgtttccatgtcttcgctattgtgaatagtgctctgataaacatgcaagtgcagctgactttttaaatacaactctgcttgaccttgacctttgtctcttctttcttatttcctatttaccaccatttgtaattgaaagtttgcttattgaattagggagaaaagagctatttgaagaatggagtataagtaaagtaataaataggcaatttgttatgcttgagacgaggaaaatattttactcagtaaacacctttgttgaatagaatgctcaaaagtttgccagatcctactctattttattttattttattttttgagactggatcttgctcccaggctggagtgcagaggcatgatcttggcacactgcaacttctgcctcccaggttcaagtgattctcctgcctcagcctcccgagtagctgggattataggcacctaccaccaggcctggttaatatttgtatttttagtagaggtaaagtttcaccatgttggccaggctggtctcgaactcccaaccttaaatgatcctcctgccttggcctcccgaagtgctgagattacaggtgtgagccattgcgcctggcctaatttttgtatttttagcaggggaggggtttcaccatgttggccaaaactggtctcaaactcctgacctcaagtgatctgcccacctcagcctccgagagtgctgggattataggcatgagccaccgcacctggccaccaaatcctgctcttataggaagctttccatccctgcttccttgcttgccccactctcccattttttagggccctaaacatagaaacatttattacattatattcaaagtaaaatcaacttagaattcagtaaatagaacaggacattgcttaagagactttggatataaaccaaaataagtcacaacaaaactgcaatcagcttttgattatctaggagcatttttgttgttgagaattgggagaaagacccttactcttacttcttagattcctctttgccttgcaggaacccagctcctaggctaatgagaagtcacatccaatcagtttttacatagactatgttttgaaacaattagtcctcacacaggcccatcagaaaaccagttaatgtgtccctgaataattgaaaattatttatatatctttttccccactggatttcccactaagtttgtactggatctaattcattttggtgtccctggggcctctcattcatgataggagatctatcagtgtttgttcaagtaatctgaatggtttagagttaactctcaaaatatctagttaactaagaattaggttaccctagaaaatcattccattatcagttatcctaatactcagtgacctaacttcttatatccgaaaagtcccttatactgcaaagttcctgttgctactattattgaaagtaaagggctgggcagggtggctcacacctgtaataccagcactttggcaggctgaagcaggctctgaagtttgagaccaggctgggcaacataggaaacctcatttctacaaaagttacaaaaattagctgggcgaggtggtacacgcctgtggtcccaggagggagccagcttactcaggaggctgaggtaggaagattgcttgagcccaggagttcgaggctgtgattgtgccattgtactccagcctgggagacagagtgagaccctgtctcaaaaataaaaaattaaaattaaagaaagtttcattactgttattattgatgtttaataaaaaagggaaggacagtaagattggaggcaaagcgaaatcatgattaaggaagaaagttcagtgagcaaaaataaaaagccttccttatattctagaaggaatattttaaaatttcccaaatggtcagtcagcccgggagtgtagaacacttcacagttttcaaagcatgttaagccatttgatccttataacagctttgattttggtagcccatgtagtattatcctctttatgaaggtaaagaaacttgagttctgtggccctcataagttcacccagggtcacatatttggtaaacaaaaactgtgaccaaaatctggatctcccaccttactttgtcctgtatactttctactgtacttccttttctgtagcaaggtaaaatactgagcatttgaagatgggacaacttttagctttcatagctctttcaaaatgcaattaaatatatatatgtaacaagaataactcataaattacagaaattattgttaattgaaattcttttggcacattgagcttaattgctgttaactttggcattggtcctaattatatatttagagcttctgctacttctatatccagaattacttccattggtaaaatatcaggtaatgaatgtttccttatttttttttcaaggtgaagtctcactctgttgcccaggctggagtgcagtggtgcagtcttggcccactgcagcttcgacctccctgggctcaggtgatcctgctatctcagtctcccaagtaagcaagactacagatgtgtactaccatgtctggttatttatttatttatttatttttgagatggagtttcactcttgttgcccaggctggagtgcaatggcatgatcttggcccactgcaacctccgcctcccagattcaagtgattttcctgcctcagcctcccaagtagctgggattataggcatgtaccaccatgcccggctaattttgtatttttagtagagatggggttccaccatgttgatcaggctggtctcgatctcctgacctcaggtgatctacccacctcagcctcccaaagtgctgggattacagacgtgagccactacgcttggcctatgttttgtatttctttgtagagatggagttttgccatgttgcccaggctggtcttgaactcctgggttcaagtgatccacctgcctcagcctcccaaagttctggtattacaggcgtgagccaccatgcccagtccttatgaatttttcaaacatcagttatgcagaaacatttgagaggcagttcggcaatcactttttaatgtgtaggcactataggggacacagtaatgaacaaggtacagttcctggccttaaggaacttatttagacttgtaggtgaaacagacatctagcaacactaagaatgcccagaatatgaggcagaatgtgataagtgtgtcatgagggcacaaacaaatgtctgtgtaaacacagagtagaaattttactgagtttcttgttaactaaaatactgttgtcttgagttttcttgtctgcatatttcagaacacttaattctgtcacccagtcatgtttctttcagtgaaaatgtatatcatctagttggtttatattcagagatacaaaattgtttttttttaatttatattttttattattaatttttttttaatagagatggggtctcactatatgacccaactatgttgcccaggctggtcttgaactgctggatcaagcgatcctgctgccttggcctcgcaaagcgctgagattacaggagtgagccaccacaccccaccagttttaatttttttagaaacgattttgctctgttgcccaggctagaattcagtggcacaatcatagttcattgcagcctcaccctcctaggttcaagtgatccttcagcttcagccacctgagtagctgggattataggtgcatgccaccatgcccagttaatttttaaaaatagtttttaaagataatatctcactgtgttgcccaggctggtctcaaactcctggccttgagcagtgttggcctcccaaagtgttgagattacaggcgtgagctaccatgcctagctttataaacttcttttaatattaacccaatccatgcataattaggaaggtcccagtgatgtcaaacaagaaaataaaatatggccaggtgcagtggctcacactggtaatcccagcactttgggaggccaaggcgggctgggctgatcacccaaggtcaggagttcaggaccagcctggccaatatagtgaaaccctgtctctaccaaaaatacaaaaattagccggacatggtgggcgcctgtaatctcagctactcgagggactgaggtaggagaattgcttgaacatgggaggcggaggttgcaatgagctgagatagacaactctttcttctgtgaagaaccttgggggcagggagagtaaaaaggatttcatggaagaagagtgtttgacctttttttttttgagatgaagtctcactctcgcccaggctggagtgcaatggcacgatcttgtctcacggcaacttctgcctcccgggttcaagtgattctcctgtcttagcctcccgagtagctgggattacaggcatgcaccaccacacccggctaattttttgtatttttaatagagagggggtttcaccatgttggccaggctggtcttgaactcctgacctcaagtgatccacctgccctggcctcccaaagtgctgggattacaggcatgagccactgcgcctggcgaatatttgacttttaaggatgaggggtatttgaacaaaatggggctggaattccatactgaggacatggtaaaggcatggagatagggaaggcaggataggttacagttctatatcacaggaacaagaggctctgttgagactttgattcttggcattgaccaaggtgcattcaaaacttgcttttaactatattgagctacttttaaatttttttctttatattaaaagaatacccttttttgaacataggagaatctttcacaagcttttaaaaaagcagtttatagctgagcacggtggctcacacctgtaatcccagcactttgggaggccgaggcaggtggatcacgaggtcaggagatcgagaccatcctggctaacacggcgaaccccgtctctactaaaaatacaaaaaaattagccaggcgtggtgggggcctgtagtcccagctacttgggaggctgaggcaggagaatggcgtgaacctgggaggcggagcttgcagtgagcagagatcgcaccactgcactccagcctgggagacagagcaagactccgtctcaaaaacaaaacaaaacaacaacaacaaaaaaagaaaaacaattttggctcttgaatttgcaggtattctaaaaaaggaaaatatgctttaaaatgtaagcattttgattaagaaaagttaattttaaacaaatcatttcatatttcatcacttcaccaccaccaccccccctttataaactatgcaccttggaaaacccaaatactttatttttatttatttttttgagacagagtttcgctcttgcacaggctggagtgcaatagcatgatctcagctcactgcaaactccgcctcctgggttcgagcaattctcctgcctcagtctcccgagtagctgaccacgcctggctaattttgtatttttagtagagacaaagtttcaccatgttagtcaggctggtctcgaactccttgacctcaggtgatctgcccaccttggcctcccaaagtgttgggattacaggcgtgagccactgtgcctggccccagatacttcaagttctttcttggaaaggctggagtacccaaacacttttattttttttcttacctggagtccttgcgccttttactcactctgctagaaacattgttttcatctcttatcaatccttacttattttctcattcttcagagcaccttggacatcatctccactgaaaaggctttcttgaacctgcacaatttgtttggtagcctttctgtgtggcccatctttgccaatgtttaccattcctaacagtgcttatcctctatgttgtaattgtttgtctgtctctctcacaagcagactatacccttttgagggtagggactgagtcttgtttgttgttgaatccctagcccctagcacaggcctgtttcatactaaacagtaatgttggttgaatgagtaaaactagctttaaatttatggagaaaatatgctcaaattaaccaaatctgttttactgtttggggtttttgcagatggagctttatattgtgtttgtcataaatctacgtattctcctctaccagatgactataattggtatgtattaaaattcaattgaagaaataatagtcttagctatagctgaaatgatttaattttatttcttgttttgatgtctgatgctttcttttctcattattctttccttaattttgtttttaaaaattattttaatgattttatttacccagtatctgggcttataaacattttaaataaaaatcattgtcattgtgtttcattgaatatttaatttgttataagacagacatgctgtttagaactgctatcttttcttcctgaagcatgctttagctttttggaaaagttaattagtttttatagggttcatatctattagcttaagccattattatcttttcttttgtttgatattgaataatcctaaattatacatacttaatttagccaccatttatttggtacttattcaatttagtcactatgataagaactaggaataacatatgacattgtcttttttctctgcagcagagtctgatatgcagaaactgcaacctattttcttaatctatgttgtttttattacaaattataataaaaatattttttcttctctcttgacactagttttatttttattttgttttcgagatggggtcttgttctctcgctcaggctggagagcagtggtgtgatcttggctcactgcaacctgagatggggtcttgttctgtcacccaggctggagagcagtggtgtgatcttggctcactgcaacctccacctcctgtgttcaggagattctccagcctcagcctcctgagtagctgagactacaggcgcatgccaccatgcctggctaatttttgtatttttagtagagatggggtttcaccatgttagccaggctggtctcaaactcctgacctcaggtaatctgcccacctgggcctcccaaaatgctggaattacaggcatgaggcactgcacctgaccttttatttttgtgagacagagactcactttgtcacccaggctggaatgcagtggcacaatctcagctcactgcagcctcaacttctgaggttcaagtaatcctcttgcctcagccccccaagtagctgggactataggtgtgtgccaccacacccagctaattgtgtattttttgtagaaacggggtttcaccatgttgcccaggctggtcttaaactcctgagctcaagcaatctgcctccctcggcctcccagcgtacaaggattacaggtgtgagccatcatggttggccttttatttttgagacagggtctcgctttgtcacccagactggagtgcagtggcgctatgtcagctcattgcagcctcaacctcccaggttcaagctgtcctcctgcctcagtctgcccaagtaactggaactacaggtgtgtgccaccacacctggctaatttttttttattttttgtagagacaggatttttccatgttacccaggctggtctcaaactcctgagctcaagtgatccgccttggcctcccaaagtataaggattacagatgtgagctaccacgcctggccttgatactagttttaattgtacatctaatgagtactataatagcgatgaaattggaataggtaacagtttttgaacctggaaagactgagtcatataagtgttttgcattatataaaactatcttctcgtgaagaaatcgtttgacagattaaatgttcattgtagccatgttatggtattcaatcttgaaaccacggtgaaacaatctaatgcctattctttgttagctacaaatgtattttgttgtggtatttaagctgacatattctgtgggatggtcttcatttgtgtcctgtgttatgggtaccaggtttgccaatccagtgatgtagtatcttcagcaatttgtgattaattttagcttttatttatttatttatttatttatttatttatttttttgagatggagtctcattcttttgcccaggctggagtgcagtggcgtgatcttgacttccttcagcctctgcctcctgggttcaagtgattctcctgcctcagcctcctgagtagctgggactacaggtgtgtgccaccacacctggctaatatttgtatttttagtagagacggggttttgccaggctggtcttgaactcctgacctcaagcaatctgcccaccttggccttacaaagtgctgggattacaggcatgagccaccacgctgggcccagaatgattattaggccgggcactaattttagctttaggctggagtgcccactgcactccagcctgggtgacatagtgagagtccatctcaaaaaaaaaaaaaaaggtaatcattttgccttgaatacagtataactttatttctaaaacattcttttttttagcaacgtagagcttgctctgacttctgatggcaggacaatagtatgctaccacccttctgtggacattccatatgaacacacaaaagtatgtatgagaaaatttcttgcagtttttaatttgctgttagaaatgtttgcacttctttatagtatccaaaaagaagggagtcatctgattttctttgttttagattttcttttggctttttaattttactattttgatttttctcttatttatttttcatctgctttctttacagtcttttttcagaatacaaaatgaaccatttaaacacaattatggcatcagttttctggtctaaaaaatttggtagatttctggttaaggatcaaatacatctagtataaaattataaaatgcattatcccatgctaccccatattataatctagacaattatgagaaagttgtattttagagtgctgggattacagctacttttttactattggttctgacagtttttttttttttttaacatttggtgaatttctttatttttatgttttaatgggccaacataggtatatattttgaatggcccagttagatttttttccctattttttaaaaagccaagtactagatagaagaggattttgtattgtttttaatataatttatttttagtttgacccaagtctttttattgttttgtatttgaaatgctttttcctatttctttaagcctccttctactaggtaatgtttgatttgctttttttttgagacagggtctcactctgtcacccaggcaggagtgcagtggcgtgatccggctcactgcagcctccacctcctgggttcaagctattctcctgtctcagcctcccgagtacctgggactacaggcacctgccaccacgcccggctaatttttgtatttttagtagagacggtgtttcaccatgttgcccaggctgatctcgaactcctaagcttaggtgatccgcctgcctcggcctcccaaagcgctgggattacaggcatgagccaccgtgcccggccttgatttgctttttgaggagaaaattagatggtttaagtcatcacatgatgtatttagtggtacttattttgaaaaatcatcattagggtcagggtgccggttgatttgacaaataatttcttttctttttttttttttgagactgagtctcactctgttgcccaggctggagtgcaatggcgcgatctcggctcacagcagcctctgcctcctgggttcaagcgattctcctgtctcagcctcccaagtagctgggactacaggcgtgcactaccacacccggctaatttttgtatttttagtagagacagggtttcaccatgttgggcagtatggtctcgatctcttgacctcatgatccgcctgcctcagcctcccaaagcgctgggattacaggtatgagccaccgcgcccgacaaataatttctgtattcctttttaaactcaccattttgtctccctgctttgttaggaaacaaaagccaggtatcataggtactaattcagtgcctcttttttatcacttatttgggcaacgtttagaaaaataggcctacatcactgagttttggcctataaaccctccaggtcacactatgttgtgcctttgtccattgttattttgttaaatatcttcggtttatttgctgtgttttagcaattatactaagaatgccaggtcatttcatagcatccagactcttatccccaaatggctctttatatctctgaatctgaccctcctcaactgtcaaaactttcccactgtacttgtagaacttactacccttggcaaaatctcttacaatcttagcctattccagaatgttgccttcaccttttgactctaatagaaacctgcctgtaccctggagacgttacttccccagcagttcttttaagtagttgctgttttctctcgcatactcttttaccactgggtctaaagatggggaaggtatctctgtagctcttcactgtcaaatctagatcatttctcttccttcctaacaatttctagctttgtagcttgtatcattaaactgcatcatttactatctttttttgttgctgttatctaccaactgccaggttatttctcctcctccaccactctgcacttccttgaatattctaagcttgctgtcacactttctccaatactgttttaccctcattcttttacttcaatatccatgtaggtgatctaataccatggtgtctcacttcttgatctctctctacatcagctacccacttccatgggaggattccctatgattccctagagatattctaattaccagtaattgctactcctccttcccagtctaaattttaagaaatccaatagttaactaccagtccctcttggtctcccagctccaagaattattcattccctctttgtaacctacatcgattgatccaaccactttttcacagtccctcatgtatctcacacattctcactccctacttaacccagcacagactgatatcatggtttatcattatcatcattcctctgtacacatgaccacctcccctgcatcctctttctttgttgtgtttcctttgttttgacaattatcttctctgccacatcatcaatattcatctctctagtttaggtaagtaatcactcctacaagttttcaagtaatcaccccactgccaccatactgaccacaactccagctgttcttcagctgtattaggtgagctctccactcagagcttttgtatttcctgcttccgttgcctggaatgcttttacttcatagtttactctctttccttaaggtctttttccttatttgttatcttgtgtggccttccttggctactgcatttaaagttgtacctctgctcctgcactccttgttgtcctttgatttacttttctcaacagcatttatcatttctagcatactggatgttttctggctatctcccatcactaaaatgtaagcttgatgaggacagggccttgtgtgtttttttcccctgcttggtcttcagcacctggaataacgctttgaacttggtaggtgcacaataaatatttttctattaagtgaatgaagttgttccttcctcttcatgcttaagggttttttgttttagggctaagagacattcacatcagaaagcatggaaagtttttgtttgtcaagcaataaattgtagattgggctgcaaaataagaaacactcttgagaacatgttactattagtagaataatagtaacatgggctcaagcaatcctcccactttagcctcatgagtagcttggactataggcacacaccaccatgcccagctaattttttaaatttttgtagagacagggtctcactatgttgtccaaactgatcttgaattcctggactcaagcagtcctctcaccttggcttcccaaagtgccgggcttacaagcatgagccactgtaccttgcccaatctggttctttttttttttttgagacagagtctcactctgtcaaccaggctagaatgcagtggtgtgatcttgtctcattgcaacctccatgcctccccaggttcaagcgattcttatgcctcagccacccaaatagctgggattacaggcactcgtgaccacgcctggctaatttttgtattttcagtggagagggggtttcgccatgttggccaggctggtctctaactcctggcctcaagtgatctgcctgccttggcctcccaaagtgctgggattaccaggcatgagccaccacacctggccccattctggtttttgtgacaaggatctggcttgtctccctttctacttttcactgatatctttgttactttgcatttctgtagtacagtcatgcattgcttactgatggggatatgttctgagaaatgcattgttaggcaatttcattgttacgtgaacatcatagagtgtcacttacgcaaacctagatggtgtagcctactacacacccagactttatggtatagcctattgctcccaggctgcaaacgtatacagcatattactgtagtgaatactataggcaattgtaacacaatggtcaatatttatgtatctaaacgtatttaaacatagaaaaggcacaataaaaatgtgctataaaagataaaatgtaatatacctgtatagggtacttaaccaaaaatggagcttataggactggaagttgccctgggtgagtcagtgagtgtaaaggcctagtacattactgtacactgctgtatactttataaacaaacactgtatgcttaggctacaccaaatttttaaaaaaatatttttctttctttaataataaattaaccttaggttactgtcacttttaaacttaataaacttaaaaaaaatttaatacttttttactcttttgtaataacacttagcttaaaatatcgtgtacagctatacaaaaatattttctttatatccttattctataagcttttttgtattaaaatttttgtttgcactttttaaactttttttgtgagaactaagacacaaacacagtctaggcccacacagggtcaggatgatcaatattactgtcttctacctccacattttgtcccactggaaggtcttcaggtacagtaacatgcctggagctgtcatctcctatgataacagtgtcttcttctggaatacctcctgaggggcttgcctgaggctgttttacaattgacttttttttaacaagtaggagtacgctctaaaataatgataaaaagtatatagtatagtaaatgcataaaccagttgcctagtcatttattattatttttattatttaattattttggttgagacggggtctcactacatgttactctggctggttttgaactcctgagctcaagcctcacaaagtgctggaattacagccatgagccactgtagcctgccgttatttattattattatcaagtattatgtgctatacataattgtatgtgctatacttttatacagctggcagtgcagttggtttgtttacattggcaccaccacaaacatgtaagcaatgcattgcactatggcgttctgcaccatcactaggtgacaggaatttttttagcttcatgataatcttatggtaccactgtagtatacactgtccttcatcactgtacattgttgactaaaacattgttatttcaggcagaatcttgccctgtcacccagggtggaatgcggtggcatgatcttggctcactgaaacctctgcctactgggttcaaacgattcttctgcctcagcctcccgagtagctgaggttacaggcatgcaccacaacacctggctaattttttgtattttcagtagagacagagtttcaacatgttggccaggctggtcatgaactcttgacctcatgtgatccgctcaccatggcctcccaaagtgctgggattacaggcatgagtcactgcgcccggcctcaaaacattcttatgcagcccatgactttacttaattgtgccacctccattgctttttaaaaaacacacacacacacacacatatatatatatatatatatatatatatatatatatatatatatatataaacagagatggggggtcttaccatggtgcctaggctggtctcaacctcctaggctcaagcattcctttgccactttgaccttcctaagtgctgggattacaggtgtgagccactgcacgtggcccacattgcctttttttttttttttaattgacacagggtctgtctgtgtcaccaagactggaatgcagtggcgtgatcttggctcactgcagcctcagcttcccaggcttaagtgatcctcccatttcagcctcctgagtagccgggactgcaggtgtgagctaccatgcctggctaattttttgtattttttgtagagacagcgtctccaactcctgagctcaaagtgatctgcctgtctcagtctcccaaagtgctaggattaacacatgtgagccaccgcacctggccacattgccttttaaagaggtcttgtttcatgtgcataaactagatataaatatatgctataatatttaatacagtggtagaatgtagttgtcactaatagcgtatgaatgtaaagaaaatatgtttgaattgtttcttactggttgtaaattcagattttcattgtattataatacatacatattgttattttaaagcaaggcagtgttacaatcttgttacatatatattattattgaatatgttactttcattatgatagcgttatatagtattgaatgttacaatctttgttacataccttaatatcacttaatatttaaaatataggtaacttgaccctccaagatagtgattccttttgttttccgttttgttttgttttgagacagggtctcactcttgctcaggcaggagggtactgtgcagtcatggctcactgcagccttgaactcctgggctcaaaagatcatcctgcctcagaccccaagtagctgggactgcagccatgcaccaccacacctggctaatttattttttgtttttaaattttttgtagagatgaggtttttaaattttttgtagagatgttgcccaggctggtctcaaactcctgggctcaagtggttctgccaccttgacctctgaaagtgctgggattacagatgtgagccacatagctggccaagacactgattcttaaagtctttagtgagtcactattactggtggaatatgttgtatatcattcatgtgtgttgaggagataagatttttagtaatcattaactttgggggaaagctatttaaattacaataaagcactgtttggtggcattttagtcacctgaaatgaaaatgttgaaaatttttctgcttccattggatgtaagaaatgtcattttctttcttttttctttttgagacagtcttgctctttcgcccaggctggagtgcaatggtgcaatcttggctcactgcaacctctgcctcctgggctacagcgattctccttcctcagcctcctgagtagctgggattacaggtgtgcgctaccgcaccaagctaatttttaagtagagatggggtttcaccatgttggccaggctagtcttgaactcctgacctcaggtgatccacctgccttggcctcccaaagtgctgggattacaggcgtgagccaccgcacccggccaaaaaatgtcattttcaatgaaaagtttttaattatttctcatcttaatgatataaaaggtaaatggtaaacttttaagttaaaaaataataataggcataatttatacctttgagaaacagaaactaaagtaataagtactttattactgcagaaaataagaacattaaatgagggctttctttttttcttttttttttatttgtagtagagacacggtctcgctgtgttgcccaggctggtcttgaactcttgaactgaagtgatcctcccaccttggcctcccaaagtgctggaattacaggcatgagccaccacacccggcctttctatttttctttctcttttttgagacagggtttcactctgtcacccaggctggagcacagtagtgtgatcacaggtagcctcgacctcctggtctcaagtgatcctcccacttcagcctcttgagtagctgggactgcaggtgcatgccatcacacctagatagtttttaaattttttttgtctgaccatgttgtccaagctggtcccatgctttggaactcctgggctcaagtgattctcctgccttggtttcccaaagtgctgggattacaggcatgagccactcactgcacctggcctaaataagaactttattattggaaaagaaacctaaaatttgctgtgagaagaaaaatatttctgactaatgaataatgcactaagtgaaactttgttttgataacttatttgcccaccctaaagtactatagtgaattactgaatatggtaattgttttattgtgatctcaaacaaatgctggctaacattcccacatcttcatgatgtttgttactgattattttgtagcctatccctcggccagatcctgtgcataataatgaagaaacacatgatcaagtgctgaaaaccagattggaagaaaaagttgaacaccttgaggaaggacctatgatagaacaacttagcaaaatgttctttactactaagcaccgttggtatcctcatggacggtaagttttcttttcttttcttcaatccctactacatacagtaaaggaacacatggattttcttgcaataacaaacttctgaagtggtgttttgcatgaggaaattaaccctaagtagaatcacctactatgttgtactttttttttcttttctgagacaggatctcgctctgtcacccaggctggagtgcagtgccacaatctcagctcactgcagcctcaacctccagtgctcaagtgatcttcgcactttagccttccgagtagctagtactacaggcatgtgccaccacacctggctaattttgttctttttttttttttttgagacaaagagtcttgctctgtcacccaggctggagtgcagtggcgagatctcgtttcactgcaacctccacctcccaggttcaagcgattctcctgcctcagcctcctgagtagctgggactacaggcgcatgccactatgcccagctaattttttgtattttcattagaggcggggttttaccgtgttagccaggatggtctcgaactcctgaccttgtgatccacccaccttggcctcccaaagtgctgggattacaggcgtgagccaccgagcctggctcttttttcttcttttgtagaggcaaggtctcactcactgtgttgcgcaggctgattttaaactcctggactcaagtgatcctcctccctcagctgggattgtaagaatgagccactgccactgtacttttaaatttacatataatttagctaaaatgaaatagtacttctttttttctttattttaatgggggaatttaaccagagctttcagtgaattttgtaagagttcttgaaaatttttacattctatgatgtattcatttaatatgttgtttttgttcattttcctgttaagtaattgattgtgtcttcagccctttatcaatttctttatcatattttgagttatcgaaaaaaacattggggtacagaaaatgattgggcagcgtatgttgttctcagttcccttggaaactgtaattgccctgatgtttgcaaatactcacattttccatcgattcttacctgccatttgactctggcattaattagttttcctctttttgatttttttcttttgtatctatcttcttccataccaaactataagatgtttttgttgtttatatttgaacaaacttttttttcttttttttttttgtgagaaggaggtctcattatgttacccaggctgatcttgaactcgtgggctcaagcaatcctccttcctcagcctcctaagtagctgggattacaggcacactctgccacgcccagctagtttgaacaaaactttgttcttagttgtttaactcagtaactagcactggctggcatatttatggcagggtacatttatagaattaatgaatatacatttatcaagtggctctaagtgctggttagtgtaaaacataatccccagttacaaattgtttatagtcaaggagggaagatagtagagtaaataaacggttaaatcaagtgtgatagagccttgaaggagggttaggagttaacccatggagaatgaggggtaaacttcacagatagaggaaacagcatttcggataaagtgtgtgggggaaattactaataggttgggttatggcacccagaatattaatttattataacaaaacatagcccatcatttcctgtcttaagaagcccctttcttaataatctctataataaaagtgatttttttgtatcattttcccaaggaaaaatattgattttttgggggggcaggcaacatagtctttcaattcctgcttctcttttgtatctccttccttgatttttccttcttattttattttatttatttatttattgagacatagtcttgctctgtcacctaggctggagtgcagtggtgtgatctcagctcactgcaacttccgcctcccaggttcgagtgattctcctgcctcagcctcccaagtaactgggactacaagcatgttgccaccatacctggctaattttttgtatttttagtagagacaaggtttcgccatgttggccaggctggtctcgaactcctgacctcaggtgatctgccccacttggcctcccaaagtgctgggattacaggcgtgagccactgctcccggccttccttcttatttaatacccactttgtttatgcatgctatctggatttttctctatatttttaattgtaaggttaggatatgtgcaaacaaattaggaaaccatctcatagccctgtgccttaaatcattaaatctcattatattctgagatttctttttatgattcttaacatctcaggtttatttttgatttatatcacattatccaggtatttgagttcaaaccttgtttcaacttcttctgtaatggctttcagtacctgtttctttcctgcatgttccatattgctacaatctgttttaagcattcataaccaaatcactctaaaggtatgtaacttgacggagacaagactgaagacagggagactaggagtcttaaaaccgagcatgttgtctttagacatttgtgtctagtaccctatgtttaatcttatttacttaatcttactgctaatcagcttttgactgctagttaatttaatctcctgatattttttcccatcaaaattactaggcgttttttaattgtaaagtgactttaattagattatcccaatatatatcctaataaagagcttggcagagaaaccccagagactagtttatgtgtataaagagaaattttatctgtaggccttgtccttgtagatgtatcatcttgctgaattttaaatatgcctatgtgtcatcacttatcattcaacacatatttatttgatatctacatatgtattttggattaatgtgagtcattttcaagtgttggtttctggatgtcagtggccatttctttctttttgtctgtctatctgtccatctgtccattcatccattgattcattcattcattctcagcttgttttccctagtcagaccatttcattttaaacctcatttaatatatagaaggatgatttactaaatatttcacagttcttaagttacagcagtcaaaagaatgggactcattatgaatttaataactgggggtatataacttcttcttaaataagtttttattaaaaggtataaaacacattttatttttatttttattttttatttttctgagacagagtcttgctgtgtcgcccaggctggagtgcagtggtgccatctcggctcactgcaacctccgcctcccggattcaagcgattctagtgcctcagcctcccaagtaactgggactacaggtgcacatcaccatgcctggctgttttttgtatttttagtagagacggggtttcaccatgttggccaggctggtctcaaactccagacttcaagtgatcccactgccttgggctcccaaagtgctgggattacaggtgtgagccaccatgcctggccaaaacacacatttttaaaaagtatttttaaactatgcagaagtatttaaaatataaaatagaagtgttctctatttctgtgttctccatagggaattgggtataatatgaggtaggactattcatagaggtagaggttaacctacctagatgttgaacatcttttcatgtgcttattggccattcatatgtttgggttttggtttttgtttgttttcagttaagtatctgtagaaatattttgcctattttttaaaaagcaaattggttgtcttattaaggtataaaacttagagaccaaagtgctatatgagctatatgctttgtaaatttttttatctaagcttgcctttcactatgtatatatgtatgtatgtattttaatagatgctgtcttagatgtggtttcctaggagaccctaagataaggattttttttttgttgttttatttcaatttttagcttcagagggtacacaagggtatattgtgtgatgctgaggtttggagtatgattgaacccatcacccaggcagtgaggtagtgcccaataggtagttcttcagctttctctcacctctttccctcctgtctgttgtccccagtgttttttgtttccatctttgtgtccgtgtgtacccagtgtttggctcccacttacacgtgagaacgtgtggtatttggttttctgtttctgtgttaattcgcttaggataatggcttccagctgcatctgtgctgctgcaaaggacatgattttgttctttttttatgtctgtatagtattccatggtgtatgtgtaccacattttctttatccagttcaccattgacaggcacctggattgattccatgtctttgctgttgtgagtagtgctacagtgaacatacaattacatgtgtctttttggtggaacagtttctattcctttgggtatttacctagtaatgggattggtgggtcgaatgggagttctgtttttagttctttgagaaatctccaaattgctttccacagtggctgaactaatttacattcccaccaatagtatgtaagcatttgcttttctttgcagccttgccaacatttattatttttatctatttttaataatagccattctaactagtatcagctggtatcacactgtgatttttttaaatttgcatttctctgatgattagtgatgttgagcattttttcatatgtttgttggctgcttgtatgtcttcttttgagaagtgtctgttcatgttccctagcccactttttaatggaattacttatttttgcttgttgatttaagttccttacagattctggttctagaaggggtttgggaagtcattaacctcttgaaattatttgtaaaaattttgaataggtgtttttctgggcagtggattcaaaacttttatcagactctcaatgaagtatgagaccttcagaatgctaagaactgtccattaaaagtgtcattcagcatacactgttcaattatatttactactcaagactgaaaatgtttgagactctgatagccctaaactgaacaaagtcaagttctaaaatatgctcaataaatgtcaaatagcatttacacatatcttatcatgcatgaattttaatgtgcactacaatcactagccaaaagcaagcaccttaattttacgatgaccttattctatcatccagattgggaaccttgcagacactattaattaatacaagagttaaattgagattgctcctggcaaaccaagttatattgttacacttcttagattacacaatgactcagtgacatctggaacactggtctacagctcttaacccagaaaactttacctcctggttcatactaagctaggtaatcaaatctgtttcctactgatggaagtagctaatttttgttgtctccatgggaaaatattaaagtagtttcttaaataaagtggtactattattcatgcatttgtaagattgccctatatttcagaaatttagaattattttctcctgcctgcctgcctgcctgcctccctcccccgaccccctctctttttctctcctcctttctttcttagagtcacggtcttgctctaacacccaggatggagtgtaatgacacaatcatagctcactgcaccctcaagctcctgggctcaagtgatcctcccatctcagtcttctgagtaggtaggactacaggcatgcaccaccatgcccagctaatttttaaaaatcgtgggggctgggcacagtggctcatccctgtaattccagcactctggtaggccaaggtgggcagatcagttgagcccaggagttcgagaccagcctgggcaacatggtgaaaccacatctctacaaaaaatttaaaaagtagccaggcatggtggtatgcatctgtagtcccagctactcaggaggctgaggcaggagaatctcttgaacctgggaggcgaaggttgtagtgagccgagatcaggtcactgcattccagtttgggtgacagggcaagaccctgtctcaaaaaaaaaaaaaaaaaaaaaaaaagttattatgagaatcagaatcatttatccattttaaaatgtgtgagcacctactatgtgtagatcctaatgattctgtagtacacaaaacaagataaaaatcccgactttcatggatcttacattccaatacaggagataggaaaataagatgaataagctggtcagggaagccttcattgagtaaaaacctgaaggaagtaagagagctagctttactgatactgtgagaaagagtgttctatgcagacaaacagcaagtataaaagccctgagatggaaggaaggacatgttcaaaagcaaaaaagaggccatgtagccagaatacatgaacaaggaaaagacagtagggcatgagagcagagaggtaatgcaggaccaaatcatgtaggtagttgtaggcctagagtgtttctgagtgagataggaagctgtttgaggattttcaacagaaaaattacaagaaccaagggaagtgttaacagtaggttactctggctgctacgctacaaacagactgcagcaaagcaaaggaagcagctgggagaccagttaggaagttatttcaacaaaacaggcaagaatgatgatttggactaggatagcggcagagggaatggtgacaaatggtcaaatctagatacattttggagatagagctaacaagattcgctaatagaccagatgttgggtatgagacagagagaggagtcaagagtggtaccaaggtttttggcccaagcacctagaagaatagaactggcattaactgagagagcaggctgcaggagaagctggtttgtggaggaccatcagaagcacagttagacacataccaagttaaggatacctactacacatgtcaagtaggcagttggatatgtaagtctagaggtcaagggacaggtcttgaccacagatggatttggaagtcatcatcacacagatggtatttaatgccatgggactggacgagattcctgtcctagagaatggaacagaaaagtggagcagtccaaggactgattcttggggcactccaaaatctagagacaagggagatgaaagggaagcaccaagataaatcaagatagtatattaactttagatatgtaaaaagaatttcaaccgttactaaggtcgaattaatgagaaaagtaacagacacaccatcaggaactctagagatatagtgatacaggggtccccagagaaactccgaccagcttgtgcactgggaaaatggggtggagcttcgtgaagttcacgctgtttgcagggaaaaggagcctggcctctgtgatctggtgtggtaacctggggattcaatctgtgagatgtgggcctgttaacaggaacctctcttgctttgctgagttttttccttttcacccaataaaccctgtccttcctcacccttcaaattgtctgtgagcctaattttttgtggttgtgtgtctttagctgacctaagaaaaaagtcctacaataataatattgctcaaatgatgtgttctaggaagattatattagaaggaatactttatgacttgattttttttcatgtcaactaaggaagactaaagactcagcctcctaagtagctgggactacagaagcatactaccatacctggctgatttttttgttgttgtttgtattttttggagagatagggtttgccatgttgcccatgctggtctccaactgctgggctcaagcaatctgtccaccttggcctcccaaagtgctgggattacaagcttgtaatcctggcccacacatttaatagtaaacacttcagattttcagacatgagataatctaatcaacgatacttattagccactggcctattcagcattgattctttagagtcatacaacttacactcccagttcacccaccttgggtgaggccaataattagactcaggtagcttcaagactgaatgaagtggggcaacacttctggatcattaaggatctgctgaccttgattaagaatctgataatgaggaacatcttaacccacctgtgacccacctagataaaatggataaacccatgtaacctggtagctgaactctggaaataaaacttccaagaatcactgggaaatttaccagtgcatcctcaaaacttccataaagtatggtttcaaagaggaactgaacaccttaaagaagctgtgaagacaattaggtgagatagtattccatcagacaatcatttaatacccatacattgtattaaggatactgtgttagaattattgtggaaaattacacaacagatgtttgggttttttgtttttgtttttgtttgacacggagtcttgctttgtcacctaggctggagcgcagttgcacaatctcagctaactgcagccaccacctcctgagttcaagcaattctcctgcctcagcctcccgagtacctgggattacaggcagttaccacaacacccggctaatttttgtatttttagtaaaggcagggtttcgccatgttggccaggctggtcttgaactcctgacctcaagcgatccacccacctcgggctcccaaagtgctaagattacaagcatgagccaccacgcccagacaacatccttaacaaagagaaaatactccagagaagatttaaccaaaaaaagtcacctaaaaatgtaaatataacattaatagatacctaataaactataattatatgcagttgtgctaagagggacagtagatattcaaagtgaatataaaaaagtaaaatgtcatgaagaaagtaagataagagcaaatagcagaggaagagtaaaagtgctgaaaactgagggataaagcatttgaaatagcttgatgttgaaatgagatggggcactgaggtcagattaggtaaaaaaaaaaaaaaaaaaaaaaggcaagctccaactatatgctgcctataagaaatccactttaaaaataaagacagccaggttaaaagtaatacagaaatgacaaaggtgacatcacaaccaatcccagagaaatacaacagattctcagagactattttttttgggggggtttgggggcgggtggggacggagttctgctcttgtcccccagcctggagtgcaatggcacaatctaggctcactgtaacctccgtctcccaggtacaagtgattcctcagagactattattaggaacacttcaagcacacaactagaaaatctagaggcaatggacaaattcctgaaaacatacaacctcgcatgtttgaatcaggaagaaactgaaaccctgaacagatgaataatgaattctgaaactgaatcagtaataaaaaaacaacaaccaaaaagctctggaccagacagatccacagctgaattctaccagatgtgcaaagagccagtaccaatcctactgatactattcccccaacaacaacaacaaaaaatcgaggaggaaggactcctccccaactcattctacaaaaacggcatcatcctgatacccaaatctgacagagacataacagaaaaacaaaactatgggccagtatccctgataaacatggatgctaaaatcctcaacaaaatacgagcaaaccaaatctagcagcacatcaaaaaattaattcaccatgatcaagcaggctttctgcctgagatgcaaggctgattcaagatacgcaaataaataaatgtgatacatcatataaacagaattaaaaacaaaaaacatatgatcatttcagtaaacacagaaaaaaactttcaataaaatccaacatcctttcatgatgaaaatcctcaacaaactaggcattgagggaacatactccaaaataataagagccatttatgacaaacccacagccaacatactgaacaagcaaaagctgagatcatttcctttaagaacagaaacaagacaaggatgcccactcacactactcctattcaacatagtactggggaagtcctagccagagcaatcaggcaagaaaaaaaaaaaaggcgtccactcaggaaaagaaaaagtcaaataatctctcttcactggttcttgtaatttttctgttgaaaatcctcaaacagcttcctatctcactcagaaacactctaggcctacaactacctacatgatttggtcctgcattacctctctgctctcatgccctactgtcttttccttgttcatgtattctggctacatggcctcttttttgcttttgaacatgtccttccttccatctcagggcttttatacttgctgtttgtctgcatagaacactctttctcacagtatcagtaaagctagctctcttacttccttcaggtttttactcaatgaaggcttccctgaccagcttattcatcttattttcctatctcctgtattggaatgtaagatccatgaaagtcgggatttttatcttgttttgtgtactacagaatcattaggatctacacatagtaggtgctcacacattttaaaatggataaatgattctgattctcataataactttttttttttttttttttttttttgagacagggtcttgccctgtcacccaaactggaatgcagtgacctgatctcggctcactacaaccttcgcctcccaggttcaagagattctcctgcctcagcctcctgagtagctgggactacagatgcataccaccatgcctggctactttttaaattttttgtagagatgtggtttcaccatgttgcccaggctggtctcgaactcctgggctcaactgatctgcccaccttggcctaccagagtgctggaattacagggatgagccactgtgcccagcccccacgatttttaaaaattagctgggcatggtggtgcatgcctgtagtcctacctactcagaagactgagatgggaggatcacttgagcccaggagcttgagggtgcagtgagctatgattgtgtcattacactccatcctgggtgttagagcaagaccgtgactctaagaaagaaaggaggagagaaaaagagagggggtcgggggagggaggcaggcaggcaggcaggcaggagaaaataattctaaatttctgaaatatagggcaatcttacaaatgcatgaataatagtaccactttatttaagaaactactttaatattttcccatggagacaacaaaaattagctacttccatcagtaggaaacagatttgattacctagcttagtatgaaccaggaggtaaagttttctgggttaagagctgtagaccagtgttccagatgtcactgagtcattgtgtaatctaagaagtgtaacaatataacttggtttgccaggagcaatctcaatttaactcttgtattaattaatagtgtctgcaaggttcccaatctggatgatagaataaggtcatcgtaaaattaaggtgcttgcttttggctagtgattgtagtgcacattaaaattcatgcatgataagatatgtgtaaatgctatttgacatttattgagcatattttagaacttgactttgttcaatttagggctatcagagtctcaaacattttcagtcttgagtagtaaatataattgaacagtgtatgctgaatgacacttttaatggatagttcttagcattctgaaggtctcatacttcattgagagtctgataaaagttttgaatccactgcccagagaaacacctattcaaaatttttacaaataatttcaagaggttaatgacttcccaaactccttctagaaccactattctgatgaccgttctccctgctttgagagaatgcctttcagagacactattgtactagtacaaccttgattatctggtatgtcaatggaaccttttagaaaaaaacagaattttctgtatgccaacataagtacatgtagaaatgtttatgcagatggtattttactgtgtgtattttttgacagcttactgttccatgttagtatagacagctgtacttcgttcatttcaacttaattcctgtattttgcaaattttcaaaaataaaatcagtgtatcaggaagttgcccatatgaaacctgaagcaaaaaaatgctttagatatcttaatcacaacaactaaagatcacagggtacatgtcttaccatttatagtataaaactgaatttccacattagcaaaagattgaaaacaaaaattaacttgtgaccaacttgccaaaatctgacctgaaggaaatttttgaacgtaactcatcacaaaaacacatgtactctgtgcagaaatgtttcttaaatcagtaaagaaaataaggaaatgcagaggagcaaaaagaattctccatggtgaaatcactcaaaaactatcactgctgacaatgcatttcatttctctatatctatacataagttttgttagtttgcctatttttacatggttatcatcatactgtatatgtaaattttctcctgtgttcttccttaatattttaactactttttctatattcctttgggacagagtgctagaagaggaattactaggtcaaaaattatgaatatttcttgatacatcttatcatactgcttttcaaaagtattttgaagtaaaagtttatacttttaaccagtcgggtctcatactgctaatttcaccacacctgtgcttggattgggcattatgatttttaacatgtttgtgatctcaaaaacaaaaggttcctcactgttctgatttgcagtccctccattttgcatgacattacacatttttccacagacatattactagttttattttatattaaaacatgattttgcatttatagagacctccatttagaggacaatagccccttgtaaataaaacttttaacagaacacgttcatgttcacgatgtggtgtttctttatgttttggaagcctaaatctcaccagatgtgatatttcttcactactaagacaaaaaaccattagtttttatcagaatcagtcatctgggttaccatgttgaaattatcctcaagatatgaaagaaaactatttcaaatgcttaatttaattaatagtcaacaacttagccacgtgtggtggtgtgcctgtagtcccagctactaggcagggtaaggtaggaggagcccttgtgccaggagtttgaggctgtagtacactattattgagcttatgaataacctctgcacttcagcctgggcaataaagcaagacccagtctctagaaaaaaaaaatgattaggtaaagaaaagaaaacaaattttcacaatgggagaatgtggcttattactaagaaatggctgatacgtagtttcattgattttttaaaaaaatagttccaatagcaaaataatcatagaagttagatttttatcaggaataatttttattaaaatcatcttattccaagtattttcttcttttcaaggtatcacagatgtcgtaagaatctgaatcctccaaaagacagatgatgcggaggttcctgggggaatcaaagagaaatgtgcctcatttgccatttgagaaaatgcagtctggtgtattcagtaatatatagtaaagtaataatgataaaatatcttttcatatattagaatgtgtacttttatataaagtaattctggatttgacattctcatttagagaaacctattttcttttttctttttctattttagtgtttcatttatgtgcggtctccaatttaggacttttccatagtgccaaagccatacatattcagtagaacatcaataaattacatcagaaattcaacactttattataaaacgggcttcgtgttagataattttgctaaacagtaggctactgtaagtgttctgagcatatttaagacaggctagcattttcaatttacaatattttcaactgatagtaggtttattgggatgtaaccctatgataagttgagaaacatctctttttgtgtgtctactgtgatttaagtatttttaatcatcagccaagcattgttagtagtataaatatgattaataaaaatgtgcatggctttcctgaaggagattttttaattgcctttgagaataaactcataaggtctaccaagaaaataaatgttatgatgtttcagttggcttctaggaaataattaaattagtgatattttaatcaggttttactatctgctaggccccttccatcaattcttattaaattctcaaaataatcctttgaaaagggagtataattacattttacagtgactcgaaccttacccaaacaagtgggagagccaggagccaaactatcaggctccaaagcttttttttagtgcatcacaatgacaaaggggtggttttctttcacccaagaatgtgctttcctggaaatttttctagatagaatattatgtaatttgttttgaaggttttttttcctgactgtcttaaagattatgctagctttagaacacatgcaaacagctgcagctctgtgattaaaatgttaaggtcactagaatagtgttaggaaaatgttaatagataattctgctgcctctattagcttatgtatgatccttaatagcattgcttccccttcagtttctatttaggaggtgaagaatcttttaataaggtagaaagttgctttatttaaatttgtactgtagaatgtttgtgatacagtatttgtaaaattgatatgaaaaataatttctcaaagtctattgtttgatctagttattttaataaaggaactctagaagtttcaagtggccagtgaagtgtgaggaatagagagtaaaggaaataattaataatggtgaccctctgttaagtggtttactttttccattaatataaatttcatttggaaagattaaaaaaacaagtttgattgaacttgataaatcagaaatattt

SEQ ID NO: 38246 - DNA, 159091 bp, Homo sapiens
agacccgtgcggtagcaacagcggcggcggccgcggcggctggccggactcaggtgtttcggacgctattgcccttcgcgccagccgtcgagtgggcagcagcgggactcagccgggcgccaggttcctgccaggcagcgccgggaagcgcgggcggccgagaactccttcctgctacttcgcccagcgccgctgcttcggcttcccagcgaagtgggagaccttcctccctgtttgcagacgtccgtgggagacccttattttttccaccgctaaggttaagagattctggaatagaagcgtcgaaggagatcaagtgaaccttctacaactcctcggatgtcgccagtctccctttcggggcggaagactacgtttgagcatctcactgaggtgcaggaatggaagaacccaccttgcagcttttctgcagtgtggcttgcctgatctacccctaggaatgaagaggaggcttgtaataatccgatgaagtacagatgttgaagaggatatcgcaggacctaaacttgtgatcgtttgggggaggtcacacacgtttctgagtgggaatggatgggcgtgaatgacgtgccctcttaaaaagcacaacagtcctttaagaggagcaaaattgagttttcccattttggccaagattttgaagacagttcaatgtattctacatttgacataagatgagaactttctaaagtattctctccaagagcgtaaacgatgactaccccagccctgctgcccctctctggacgtaggataccacctctgaacctggggccgccttccttcccacatcacagggctaccttgagactttctgagaagtttattcttctccttattcttagtgccttcatcactctgtgttttggggcattctttttccttccagactcttcaaaacacaaacgctttgatttgggtttagaagatgtgttaattccacatgtagatgccggtaaaggggctaaaaaccccggagtcttcctgatccatggacccgatgaacatagacacaggtttgtttatttcagaagttctggtactaacatttggcagagcaaggtacggtgattggatcgaatctgtcttttttttttcttgcagtaaaatgtaatttttcgagtcataaatattgtattgttacttcaagactggctgaataaaaccatagactggagggactctacctccagtctatggtagagtccatagactggtaggactggagtcctacctaagtcgttcttctcttcggttttatataagaaaaacatttgcgttcagagttgtgtctaatgtggacatctgggaagggaggtatgaaaacttaacctaaagaaatggtgacataagctgtgcctgcatttattaataacgtgttggagtcagtcattgtgccaccatgtgaaatcaaagcatcgaaccttgacagctcttttgggtgtgctctcccagagggctctcgttttctggcttgtagttgaagcttagtagtgagtcagctttttaggatgacaaacgtgggcagaatatacctgtcatttcttaacgtgaaaatatcctgatttttgttctttttttggggatgtgtgttggtgctgtatatgaaatcagttaagttaaaaggtattgaatcctaagttattgcactttgtgaggcttgtagacaagatttatttttgtgaaacttaattttgctctctcttttaatgtaatagatggactgtgtcaagcaactattggaatttggttgattaaggggttcacattctttcagatcactaaatctaaagtgagctctggggagagcatagccaaactaggataaaatgggagctctagttacaatttttataatttttatatttgtactcaagagtttgggaaagtagttgacttttcttaaacctgccatcttttccttgtttcttaaaataattcttgagtatgtgggaaaaaaaatcatgtgcttgaattcatttcccatctgatgatagttttaactttttgtcaagcaccgaaaaagcttaggttcacgtgtaagcctacattaaatatttgggaaaatgcactgttttatgagaactggtttttctttttttctcaacctagttaattcattacttgtgtgatggttctttgacttttggatgaattttatggagtagttacttctaatattgtttcatgccattcttttgtaactaagttaatttggaatttttgccattttcgactactgtactcctgtatttgtttctttaattttgcactttgcttgttgtgactttaagaaaacactaatatgatctgtgaaatatgttactgaaaaattaacggtgaaagtagttttccttgaaaatcttatttcgcatggtatttgtataacatatgaaatatattgaaaaaatgtgttaaggctgtttttagagctgtttcacaacagccacacattaacattacttagctctattattaatagtatctgtcatgtactaagcagtttaaaaaatacattttgaatggtctaaaagtttaaaataatatgaccacattttagtttaaaaacatttacacaaaaattctcagtaaatggagttaaaatatgaaatttgaatgaaaatacagatatgtgccttttattcacatttttaacagtctgtataaatagtttaaacaagaattcttaaatttatgaagcccttggatatatatgcatatgtatttagctatctaaaactattgggttcctgagtttggaatgagagattggttattgttctgatagcaggggtggtttgtgagccatgccctgagttttggctagtaagagtctggatagcaagtgatacatgtgagtctggatagattccaatgcagtttttggaatctattcggttcctgagttttggaaaacgagaattcaaatagagttcaggtggcaaaggatccttgtgttatctctttgtatttctgtggttatatcagttgacatttgctttagcgtattatttgctgttgtttactatatcagaaaagagtctgtagtaataaactttcttttactttgagcaaggaaatactttttaaattaagtgtatgtttaaaatgtggaaacagaaaacatcaaatgtataaacattaacttatttaaaaataattcagaaaaatagcacttttacagttggtactaagatcatatgtattttgggtatgggtcagaacttacctaatttagaagaaacaaattgacagtttatcttcatttagtgtgtgtgtgtgtgtgtgtgtgtgtgtgtaagggtacaggatagagggctgaggaatgttactttaactaataagtaatggaaaataagtcatggtcaccatttcttatttgcagtacttaagagatacttgtttagttagtatttctttattaatagattagtataataatttggtgtttaagttctggagtcagactgtatagattcataccctagcttgccactgattagatttatgatactgagaaattttaaaactctatattgtttcctttgtatcacagtggcatgtatctactttacagattgttttattgaaagagatagtacatgcaaagcactcaacatagttcctggcatttagtaaatgatcaataaatgttaactattattatcatcagtgattataattgtaatggaatatttttattcggaatctactttcctttaaatactgtatattttctgaaaagtagggtacagtttgattaatatttagaagtatactaggatcttattgtctaaaggaacattttataaccaaactggttggcaacaaatgtatgcctactgtggcaggccccgctttcatgaaactttcaatctagggagagatgatgggcattaaataaataattttgtttttgaggtgtgatgaatgttacgaagttgtactcagtgctttcagagcaaggaatgtgtgacctagtctatagagttgggggtggaggggcagtgggaataaggaagacttcattgagaaagtgtgcctcagaaacgtagaatgagtaggagattgcttaatgaagtggaattggaggttgaggggaggttgagggtcaaagcagaagacacaacatgtgtgagagccctaaggaaaaaaagcttggcatcactaagaatctgagaaatgttaagtatggctgttgcagagggtgtgggtctgggtgatgagactagatgagaggtcaggtttggcctgcttacaagttttttggcctccttattgttgttacaaaagtttgaattagttgtcagcattcacagatcaggagatttcatgttaaagtctggatttctgatctttcttgaaaaattagaggttatggcaacatccagtgtattttcagatggtaatattcaagccacaacccagtagcagctgctcccttgggagggggacgggggcgggcatgtgccactcagagtgcgaaataagtaaatacaaatcaatcaatatttaacctggttgttgttgagtttgcaaattctagtcaggattctagagagtttgtagttaaatattttggtttttatcataaatactaagagaagttattgaaggattgtaataaaagcaagggaatgacatgatcattttaaattaaaaaaattaaataatcactttggttgcaatgattacttactggatggtaagaagcaggaggataacaagttaagaggggctgggtcacagaggatatattggcttagatcgcagtggtgatagtggagaatgagataaattagtggagaaaagtggttgagtcaagaggtgttaaactattaagtttcacagaaaatggtggttggttaaatatggggccaaaatagaaagaaaagtgagtccaagataatgtctaggtttctgggtgacatggccatggattagtaagaaatacatactatatttaattaatgccctaatttatagataatagtggtattacatgaatttagtatattttcatgaggaaaccaatatgttcccttctattaagtagttcataaataatccagaattttcaaacactgtagatacactttatagatgataaggatatatcaaatgtgtagtttggtgttgattatggttatttatagtatctatgattttgcagtacccaaaaccagaagttgttataatatacatgttgttatacgctaatatacataaagtaatatacgtaagtatactttgtgtacataatagatctcaataattaaaaacttttttttttaaaactgacatttgttttatataatggcatttatagatgggctttgtgagttaaaaaaaaaaaaacccagcttatgagctgtttatctgaatagctaataagtttcaccctccagtcagaactttgttagtctgaattgaatacttgagggtcaggtatatgtttacctttgatactttcctcaaaggcattggagttataaataaggctgcatcttagttctactaactagctgtgtggcattgtgctagacgtaatcactcaaacctgtgcgctgtccagtaccatagccactagttatatatgactattgcacttaaaatgtggctagtccaggctgcagtgtgctttagtgagtttctcaagttcttcatgttatgattcgtgttttttttttgcttgattcagttttgttacaagagtagagatttcaaatctcactattgcaattttaattttcttgtcatctttctttgtctcatccctcttctggaccttttttttctatcctgttttttatttggggctttctgctcctgtttgggcgacgtcacattgttttatgcactaatattaaagtctgctggatgttccatttcccttataaattgctcatggttatttttcccacttccctttactcagacatgaattattgtgaggtttgtttgtatttgacgtttgtcaacaacagactggtgtagatgcctttgctgcatttgttttttttttttttttttgggtacattctgtggtccaggctggagtgcagtggcacaattacagttcactatagtctcaaactcctatgctgaagtgatcctcctgtcttagccttctgagtagctgaaactatgggcatgagttgggactacaggtgtgaacaaccatgctaggttaagttttaatttttgtagagatagggtcttacttgttgcccaggctggtctcaaactcctgtgttcaagtaatccttttaccttggcctcccaaagtgttcggattacaggtgttagccactgcacccaaccgaatcttatttttatcgatatggatactttcaaattggagctcatgcctaagattggaaagttggtaatgcagaagctaagtatcttctagaaatcagtagtacatggtaaacattaattgatttttttttttaagtgaaagcaagtttattagaggaggaaagaaacaaaggattataggcagagcagccaatttatttttaactgggcaaatgttttgtttactattgtttgaaaattatagaatatttaacttatgtgggaggtggaggtgggaggattgattgattgaggccaggagtttgagactagcctgggcaacatagtgagaccctgtcactgcacatactcgcacatgcacacagctgggcatggtggttggtgcctgcctgtagtcggaggctgaggtgggaggatcacttgagcccaggagttcgagggtgtagttagctatgattgtgtccgtgcattccagcctgagagacagaggctctgcctctttaaaaaaaattaacttctggtttgggctgactccacatatttcttggataggaaaatcatattgctacttttattttccctagttgtgcaaattctgtcagaaaagtttattttcactgctattgaatttttgctagaactttattcctgttaaaacatggttgtaatgaagtctgcactggagttttattttcagattgggtattaggatttgtcattaaaaaaaaaatctccttcaaagggcattctttccaatgatctgtttttgaatttaatgtagtccagaaggaaggcatcattatatattagaaagaacattggactcagtgttaagagacaggggctttagtttcaccattgtccttggttgttgaagtatatttagatatgctattcaacttctctgtgcctcgatgttcttatttatgaaatgagggaattgattgaatctttaaagatttttttctagctcatgcatatgaaatacaagtaattttatgaagtagggaactgaagagtgtgcagtaatttagttcatacatctcaaatattacaaagataaaatgtattctaaaggaattagtgtcttttttgtatataaaaattagtttaaaatcactttggaaatgactaaaatttatttacataatattattatttacataatgaaatctataccgatttaaaatgtgaaaatgaacgaaatgacttttatacattcttgtttcttgttagttttaaagtatagtttattgagcatttgatatgccagcctgaatgtagtgggtatatttacaaaattgttttcaggtgtcatttcttgagcccagttatcaattacacgtcttcacctgttacctgagactttaggatagattctgtggaatacagtccttgactgaggcctcagaccctttgaaggctcttactactcctgtggcacaattttctttgatttaaggctataatttccttttttaaaaaaatttattttaattttttaacaaaacacacctctcatgggaaggactataatttcctaaccttaatattgagagattccactgaaagtgttctctcctgttctccatatcttaagaacaacttttgggacaagttatacaaatagtttttttaaaaaaagaggaaattaagtaatctggagattacaaagaacacaggtgttgtttttccttttgactttttaaaaaaatatttatataatcaacctgttatgtagctctcttggcctccccttagtgatgttgatattaccattaaaaaatattagtcacaatcatttgttcagcaagtgttttgagtgtttattatgtaccaggcattttgctaaatattggagattattaatgaatgttacagaagattaattttgactattgaaaaattcagatcttagactcacgtcttgatatttttcttaaagcatattattatgtttggagccagattccaggggtcttagagataactttccacctatgggaggttctggtacaggcatttaggtcattggcattttttaagagttcagataagttattctatctctccccatttttgttttctttttctaagatgtatttaagataattaatttatgttttttttttttttgagacggagtcttgctctgtcgcccaggctggagtgcagtggcgcgatctcggctcactgcaagctccgcctcctgggttcacgccattctcctgcctcagccgcccgagtagctggtactacaggcgcccgccaccacgcccggctattttttgtattttttgtagagacggggtttcaccgcgttagccaggatggtctcgatctcctgacctcgtgatccgcccgcctcggcctcccaaagtgctgggattacaggcgtgagcccactgcgcccggccctaatttatgtatttctaatatacggtctgggttatctggtataaggaagatggatgctgcggtcaagaataggtcgaggcagacatccggtccagcatgactcaagtgagtttggagtgcaggcatacagctccgcttattatgtaaccatgtcatgtgaggcgcattaggtgatcacccatgtgagtgtgtgcttggcttggagccactatggtctgtgaaaggtctaattaccctgctaacgtggtacaaaaggctcgcgccaaggctcgctcacgcccagagagtaaagccatgttgaaactatgattcctctagtgtttttccaactacctgccactcacccaccaactctcctcagacctcagttacagcctgacatctggaaaaaagagacaaatattttgaagcgttttggtaaggaatcaggctctggcatctgaaaagaattcctaacattgtgtgaagttgagatctggtacctttgtatgtacagttggccctctgtatccataggttccacatgtgtggattcaaccaactgcaggttgaaaatattcagaaaaagttaaagatgattgtgtctgtactgaacatgtacagactattttttcttgtcattatttcctgaacaatacagtataatcactatttacattgcatttacattatattaggtattataagtaagctagagttaattttaagtacaggagaggttgtacatgggttatatgcaaatactacagtattttatataagagacttaagcatttgtggattttggtttccaagggaggtcctggaaccaattcctcatggatatcaaggaacaactgtgtttatatttagccatatatacatgaacatatttacatatggctatatatggttatatctgtatgtttataatgttatacatgcatacatgacttttttccaattagttggcagtcaggtggcatctgatacaaagtttgtatgtgtttggtgtgtatctgttaaatataataaatgaggattattttctattaatttgtgttgtcattaataaatatgttttcatgacctagatttttttctctctacataaaaagattggtaacacgctgagtaaggtgaacattgagcctctggctcttcttcagtgccgttggtgtaaatgtaaattaatagaattttcataaagagcaatttatttatatcaactaacttatagtgcatattctttgattcagcaatccttctagggatttatccttgggaaattttcacaaagaagtgttcaaatcacttctttcacaaatccgtgtgaaactgaagtttcacaaatcagtgcacaaagaagtgttcaagaatgtcccctgaagctataacatgacatattgtaagtgacctagatgtctgtcagcagggtattagttaaataaatgatatatcccatcccaatatatacaaagggtttctttgtttttttgtgttcgttttgtttctggtgctgtgaatctttctggttactcccaaaagcaccacactattttaatttcatagttttataatagtatgctttcatatctggtaggttaagtttaatgtatcattcttattttaaaagttattggctcatgcctgtaatcccagcactttgggaggccgaggcgggtggatcacgaggtcaggtgattgagaccatcctggctaacacgctgaaaccccatctctactaaaaatacaaaaaaaattagccaggcgtggtggtgggcacctgtagtcccagctactcgggaggctgaggtaggagaatagtgtgaacctgggaggcagagcttgcagtgagccgagatcgcgccaccgtactccagcctgggcgacggagtgagactccatctcaaataacaaaataaataaataaataaataaaaaagttataagtgtacatgaaaagtcttagtggataatattactgaatgtcagtgtaactactagttagctttgtcaaatcctaacattttcttattttggctggattacccttcttgaggtaaattcctatactgagttggacattgtcattgtcagtgcatggttttatatttccataacgtgtatttgttgatataaattatatacagtttttcatgtttttaaacattatttatcattctgcaagttgttttccccttcatgttatctttacaatttcacttttgggctctggttcaattatataattatattatctgcctattcagtgattaaacctcaagttatttgtgtatttccctgttgatagatttttagtttttagttttttttgttgttgttgcaaaaacattctgtacatatgttcttgggcacatgtgtttttctccaaggtaaaaacttagaactatagttactgggttgtagggtatgtgtatcattgactctaaatttttttgtttacagcccctgaagtggttattataccagtttatacttccacctgcatcttaacaaaccatgatattgttagagtttaaaactcttttccaacctgctgtcaatttgtttgtacttccctgattactagaggtgaaacacgtattttcaacatatttattgactatttgagtttcttaatctttgagttacttgttcagttttttgccagttttcttttgggttgttgcctttttcttatttatttgtagaagttatttgtacattctggatgaattctgtgttaatatgcattacacatttcctcctgtgaataccttattttttaattttgattatgatgtttttagttttacacaagtttgaaattttaatatatttaaaattgttaatgttttcatttatggtctctactctgaagtaacagtttcctgtattttcagttctgatagttgtaaagttttgtttttcacacctagggatttaatctacttgttgatttttgtgtatgatgaggtggggactgaatttatatttttccgtatgggtatctagttgtccctgtgtgacttattgaagagtctgtttttttctcatggatttgtaatgtcatttctgcaatataaattttcatatattcatagatttgtttatgatttcacttggttcttttgtatatttctgttggaataacgtgccgttttgttaagtatagcctttagatatatcttgacatcagatagtgtgggctcttctaccttgctcttcaaaattttttgctcttaattctaagctctttcataagcatttatttttttattcaggttaagttcatttaacatagaattaatcattttaaagtgagcacttagtagtatttacaacattcacatggttgtgtaactaccacctctagttcaaaagcattttcattactccaaaaggaaactctatacccattaaatggttactttccattccctcctccctgcttccccctagcctctgacaaccatcagtctgctgtttctatagatttacatgctctccatatttcacataaatagtatcatgcaatctaagaccttttttgtctgggttctttcacttagcataatgtttttgaggttgatccacactgtaacaggtaacaggtattagcacttcatttcttttttatggctgaataatatgccattgtttgtatatatgtgatttgtttatacattaatctgctgttgggcatttgggttgtttctaccttttggctattgtgaatagtgttgctgtgaacatttgtgcgcctatattcgttttgagtacctgttttcagttctcttggttatatacctagaaatggaattacagggtcgtatgataattctatgcttagctttttgaggaaccaccagacatttctgtagcagctgaaatgttttgtgtttccaccagcaatatagaggttctaatttctttatattctctctaatatttattcattaaaaaaattacatccatcctagtgtctatgaagtggtatctaatgatgaattgaatgaatgagtaatgatgaataggaatgaataatcatgttgaacacattttcaggtgcttgcagaccatttgcatttttgaaggaacgtctatccaggctttgtccatcttttaaattggtggttatgtcctttgcacaaaagtttttaattttggtgaagtccgatttatctgttttcttttgttgcttgtgctttgggtgtcatatccaagaatcaattgccaaatccagagtcatgaagatttaccccagttttttccataagattttttaaaaaagagtttatggttttaactcttatttaggttgttgattcatgttgagttaatttttgtgtatggagtgagatagaggtccaaattaattattttgttagtggatatctgtttgtcccagcaccatttgttgaagagacaaattttcccctattgaataatattggcactcttactgaaaatcagttggctatagatgtatgggtgggtttctggacattcagttctattccattcatctatatgtgtgcccttatgccagtatacactgtgttgcttaatgtagctttgtagtaagttttgaaattgagaagtgttccaggtttgttattctttttcaaaattgctttggctatttggagaccactgaccattccttatgaatctgaatattggcttttcaatttctgcaaaaatgactgttggaattttgatagagattacattgaatctgtagattgttttggtattattatcatcttaataatagtaagtcctccaaccatgaccacaggatatcttcccatttttgaggtcttctttaatttttcagcaatgtttatggttttcagcatacaaatgttttaccttcttcattaaatttattcctaggtattttgctcttttgtatggtatcgcaaatgcaattgttctcttaattttcttttttggtttttaaatttctggtgtgtagaagcgcaactaatttttttttattatactttaagttttagggtacatgtgcacaatgtgcaggttagttacatatgtatacatgtgccatgctggtgtgctgcacccattaactcgtcatttagcattaggtatatctcctaatgctatccttccccctcccccaaccccacaacagtccccagagtgtggtgttccccttcctgtgtccatgtgttctcattgttcaattgccatctatgagtgagaacatgcggtgtttggttttttgtctttgcgatagtttactgagaatgatgatttccaatttcatccatgtccctacaaaggacatgaactcatcattttttatggctgcatagtattccatggtgtatatgtgccacattttcttaatccagtctatcgttgttggacatttgggttggttccaagtctttgctattgtgaatagtgccgcagtaaacatatgtgtgcatgtgtctttatagcagcatgatttatagtcctttgggtatatacccagtaatgggatggctgggtcaaatggtatttctagttctagatccctgaggaatcgccacactgatttccacaatggttgaactagtttacagtcccaccaacagtgtaaaagtattcctatttctccacatcctttccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttttttcttgtaaatttgtttgagttcattgtagattctggatattagccctttgtcagatgagtaggttgcgaaaattttctcccattttgtaggttgctcgttcactctgacggtagtttcttttgctgtgcagaagctctttagtttaatgagatcccatttgtcaattttggcttttgttgccattgctttttgtgttttagacatgaagtccttgcccatgcctatgtcctgaatgtaatgcctaggttttcttctagggtttttatggttttaggtctaacatttaagtctttaatccatcttgaattaatttttgtataaggtgtaaggaagggatccagtttcagctttctacatatggctagccagtttacccagcaccatttattaaatagggaatcctttccccatgtcttgtttttctcaggtttgtcgaagatcagatagttgtagatatgcggcattatttctgagggctctgttctgttccattgatctatatctctgttttggtaccagtaccatgctgctttggttactgtagccttgtagtatagtttgaagtcaggtagcatgatgccgccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacaatattgattcttcctacccatgagcatggaatgttcttccatttgtttgtatcctcttttattagcacaactaatttttagtgttgatgttatgcactacaatttgctaaattgacttattagctctattaatcattttatgagttcattgggatttactatctgtaggatcatggtcatctgtgaattgaattgattttacttcttcctttccaatttggatgtcttttatttctttttcctgcctaactgctcttgctagaacttccagtacagtttcaaatagtagtggtgaaagtgggcatctttgtcttactccttatcttaggggcaaagctttcagtctttcaccattgagtgtgatgttagctgtgactttttcataaatgccctttatcatgttgaggaaattctcttctatttttagtatgagcataagtcctttcactctattaatgtgatatgttacattaattgattgattttcttatgctgaaccatccttgcatttctgggataaagtctacctgcctatgcctgtagttcttttaatatgctgttggattcagtttgctagtattttgaggatttttgcatcactatttataagggacattagtctgtagttttcttggaatgtctttggctagctttggtatcaagataattactggtctcataaaatgaattaggaaatcattcctcctctgttgtttttagaagagcttgagaatgattgctgttaatccttctttaaagatttggcagaattcaccagtaaagctatctggttctgggcttttctattttgggtggtttttgcttcttgattcagtctctttacctgattcagattctcttcttgagtcagtttttatagtttgttttcaagaatttgtccacttcatgtagattatctaattttttggtgaataattgtttatcatattctttaaaaattttttttttttttaagcgttgggggtctgtgttgcccaggctggagtgcagtggttattcacaggtgtgatcatggtgcactgcaaccttgtactcctggccttaagttatcttcctgcctcagtctcttcagtagctgggactacagatgcacacatcaaacaaaccaggccataagattctcttttaatcttatttatttctgtaaggtcagctgcagtgtctccacttttatttgtgattttagttatttgcatcttctctgtttttcttctttgtcatctaaccagaggtttgtcaattttgttgatcttgtcaaagaaccaacttttggtttcattagattctctctattgtttttctattctctgttttatcaccactgtaatttttcatgtttttgtctgttgtgcaggttatgggcttggtttgcacctctttttctagttctttaagttgtaaagattattgattttagatcttttaaatgtaggtatttactactattaattttcctctgaggattgcttttgctgcatcccataagttttggtatgtgtttttgtcttcatttatctgtattttctaatttcccatgtgatttctttgacatgttggttaagagtgtgttgtttaatatccacatatttatgatttttcattttccttctattattaatatctaacttcatttcattggggtcagagaagatactttgtatgatttaatatctttaaatttattgagacttattttgtggctcaaaatgtggtctgtcctggagaatatttcatatgcacttgagaagaatgtctgttctgctgttactgggtaggtgctctgcatatgttggttagtcttctctttccttattgatctttctagatgttctagccattattgaaaatgggggtattgaagtttctattattgttactttgtctgtttctcccttcatttctggccatgatttcttcctatattttgggggttctgttgtttaatgtatatatttatagtttttatatcttctaaattgacttccataagtattttagaatcaggttatgaagataccatccttatgctttcaagttttgctttagtgcttcctgttggtggtacctagtagggaaccagctgacaaaagaaagatgtaatttgcagagtctaagccccagcatcatgaagcatagacgacggaatttggaattatatagaagagtggatttggaattgaaaattttggtttacttactgatgctgtctggctgtctgaattttagcgtatgaactttgattaggtcttgataagcagtcagtggaacagcctatgagggacctcttccttgtagaattagaattgaatagccagcagctcacctcagacaaaatggatgcctgttgaaatgggccttttctcagtagatccctgcagaattttatgacttgtgcagtctgaggttttgccccaggtagatgagcaggagggcatctttccagtagtaacagagacaagctctcttcacctgtgctggaggatataccagttctcaaatcagacatgtgatagacttgccaagagaagaacctatataggtgagttccttgctaagttccaggtctcttcctagattcctgacagtgccttctatctgaatgtgtagtagtaattatggtctggttgactgccttcctgcattccaccctattctcatctacaccatattcagagtaacttggagtgttaatcatataggtaggatccttctctatttttcacggatgttgtgatggatcaaagttttatgttctgtattgtttgacttgccttagcaagaattgagggggtggggtgatgagttaaaggcatgtgcttaaattttattcccagaatacttttccatttgtattacaaataattacaggagaggaatcctggatacagacagtagacagcaactgtaacacatgcagaaaaggtatttattggaaggatgttagactgtaacacatgcagaaaaggtatttattggaaggttattaggttgcttcagaattgacataaaagtctgaagaactaggtttagtaaataggcattaagtgaagccagatacacagaaccactgtcagtgctgctgattaatgagcattggttatggcgttgctacctctggatactggatgtgtctgcttccagagtgatttcttaaattgagtccttgtttctttacaggtatatagtaccagccatagcatctcattgcttacacataggtgataggcaatacccttgctgctagatgttaggaagattaagtatcttgaatttttctgacttctgtaggaagaggagggattctgttaccattatactaattaattcctgaatgttttggcagcttaagcaacataaaggaaaccgaaaggaatcctacattttattacagtgacttaaaataaaataaggggatgaagtttttatttgtgctgtgctatttagaaatgtagatataaatagactttctagactctatcctttcagcactttctgttcaggggtttaaagtaggggttggtactgttcacctgagaggcagcttggaaacatggggacattttttggttgttagaatgatggggatgagggcactattgcatttaattatatgtgggctgggtatgctaaacatcccatggtgccttggtggttgtgcacaataaataattgaattatcctcctcataatgccagtagtgcatttaagaaaaaccaggttatatggctatcttggtgaaggactaaaagttattactagcttcctttgcttcactgtctgcaccctctggctgaggattatttctcatttcgttgctttgctgttttctttccttagttcaagggacttgattcctttcaagctccaaaaatgttatttttaaactctggctttggctcggctcagtggctcatccctgtctctagagtccctgtttctagagaccctgtctctagaaaaaaataaaaaaattagccagatgtggtggcacacacctatatttccacgtaatcgggaggatcattgaagcaggaggctgtagggagctatgattgtgccactgtactcccacctgagtgatagagtgagaccctatctctaaaaagaaaacaaacaaacaaaaactgtgaaaaggtgcccggtagcatgggagaaaatatttgcaaatcatgtatctgataaggcattaatatccagaatatataaagaactcctacaactcaacaacaacaacaaaaaacctggtttaaaaatgggcaaaggacttgaaaagatatttttccaaagaagatgtataaatagccaataaacacatgaaaagatgctcaacaccactaatcattagggaaatataaagcaaaaccacaataagataacccttcacatctattaggatggctgttgtaaaaaaaaaaaaaaaaaaacaaagtaacaggtgttggagtggatatggaaaaattggaaaccttgtgcattgctgaggggaatgtaaaatggtgtagctgctgtagaaaacagtatggtgtgttcctttcagcagtctttgtgtagccagtagttgtgattctaataaaagtagcagttggtttgggactgatagtgattgttatgatttcaattgggtggtgctgacagtatgtggttcttggtatctgtgaggataaaccgcataagctatctcatttctatcttacatgagtggtgtggatcattccgtatcagtaggttcactaatgcaaataaagtacatttaaaacaatgtaaaaggtagtagtaaatgcaaaagtatggaggtaaaggtgtaccattagtttttgggcttcaaggcttggaactcagggttggcagctgtcttacttagtttgcttgagctgccttaacaaagtaccatggactggctggtttaagcaacaaacattatttcccacagttctggaggctgagaagtgatgaagatgctggctgattcagttcctggagaaagccctcttccaggcctgtagactgccactttctctgtgtgtcctctcatggtcttttctccatgtgtgcttgtgaagaaagagacagcagctctctttctcttcctttccttatagggccccaccctcactacttaatctaatcctgagtacctcccaaggccccccaccccccgccgtcatctccaaataccccctccccctatcatctccaaatactatcactttgggaattaggggttcaacatatgaattttggggggacacaaacatttactctataattgaatcagtctgagagataatatcttagtaacaaaccaggtaaatctaggctgaccacagaaacaagttgtcagtttggagaggccggacagaaaggaaagatgtgagccaataagacaaattagagacacttgaagagagggaaggttcaaagcctgaaaatgggatggcagagatttgagaaattatctataataacaaggagtgatggctataacaattttgttttggggttcttactaccttagatatatgtaggcaggggagacatggtaaagatgctgtattaggctgttcttgcattgctataaagaaatacccgagactgggtaatttataggaaaagaggtttaattggctcacagttctgcaggctatacaggaagtatgatgccaacatctgcttctgaagaggccccaggaagctcataattgtggcagaaagtgaagggcggggggagtgtaggcatctcacacagtaggagcaagagcgagagagtgagtgggagatgtcacaaaccaggtctcatgagagctcactattgtgaggacagcaccaagccatgagggatccatctcatgacccaaacacctgccaacaagccccacctccccaacactggggattacaattcaacatgagatttagtggggtcatatattaaactgtatcagatgcctgtagtactaataacagcttggggccaaggtctgcacaaagactgaatgggtgatgttttactccacaagaaaagaatgaatagtgtaccaaaacctttttaaaaataatatttacaataaattattttcatgtcttcacagataacccataatgactttttgctttgtactgatggtgatttctgatatcaacatcctggtgtatcagtgctgtttctgacctctttctgatggtagcttttgatgaaaatatacaaatttttggtaaaggatctttatggtgatcagaaatccacttcaacttttatcctttatacttcaaaatgtcaatgagaatgactacttaaaataccaaatcccatctaaaacaaccccccaaaatctcataaaatattgaagctaaaagaaagaacgagttactatgtgcatgatagtttcttctttttcctttgggttttataccttcttcagtttctgatttgttacagcagcagtccccaatctttttgggaccagggactggtttcatagaagataatttttccatggacagtgggtggggtgggggatgatggcttcagggtgaaactgttccacttcagatcaccataaggagtgtgcaacctagatccctcacatgagcagttcaaggtagggtttgcgctgctatgggattctaatgccatcgctgatctgacagttatgtggaatgcaagtggtaatgcttgcttgcacagctcacctcctgcttgccagccgagttcctaacaggccctggactggtactgatctgtggcctgggggttggggatcactgcattacaggaaggccaggccttattttatttagaacctgtatactggggtagtgatttttagtatttttttcattatgtgttttaaaactacaacaaagcaatttaaaggtcttataaggtttataccttttttttcttttttttttgtgtgtgtctgattgcactgctagaacctgtaatagatttttgagtagctttttgttcttgatcttaatggggaagctttcagtctttcacccttgagtatgatggctgctttaggtttttaataggtgccctgtatcagattaggaaatacccttgcattcctagttcgctgagaattttcatcaggaatggatattggatttggtcaaatactttttctgcatctcttgatgatcatgaggtcattctttttaagtcttttaatgtagcaagttgttacattagttgagttttgaatgttagacaccctttggtaattattctgtaatcttaaaagtagttttctgtgtttatgagggatattagtttgtttgtttatttatttattatatttgtctgattctggtatcagagtaatgttggccccatgaaatgagttggttttccattttcagtgtcctgaaagagtttccatagaactggtattgatttttacctaaatgcttgatagaattcgtcagtgaaataatctgaactggagttttctttgtggagaggttttaactatacattcagtttctttaatagatacaggctgttaaggtaatctagttcctgagttcacttgagtagttttttttttttaaacaaggaatgtaaattattgaattgttgacataaagttgctaataatagtttcttactgtcatttgagtatttgtaggattgtaattatatcagttctctcattgctgatattggtagtttgtggtttctcttttttcccttctcgtcattattagaaatttatcaattttattgatctcaaataactagcttttggatgtattggtttttctctgttcttttgttttatattttatttcttgttttgcttttatctttattattttctttcttcttctaactttgggtttaattttctcttttttccattttcttaagttagaagctgaggttcttgatataagatcttttttccccctaatatagattggttaatgctataattctctctttaacttttctttttttttcttcatattggcatttagtgctatgaatttcagtctaagaagtactttagctttatctacagtttgatgtttccattttctttcggttcagggcactttcaaatttcactttttaaaaaacgcctttattgaggtattattcacataccataccatccacccatttaaagtatacaattcagtggtttattcagagtttggtatgtttagtatattcacaattatctgcaatgatcaccagtcatctagttttacttttgatttcttcttggacctgtgattattgagaagtgttttattgagtttataaatatttggagactatccagatacctttatgttacctggtttctactctaatcccattgtagcaaaaaacatactttatatggtctgaatacttttaatttcattgaaacttgttttatgacctagaaaatggtctgtattggtacatgttccgtttgcatttaaacagaatgtatattttgttatagtgttctgtaaatgtcaattaggtcaagttggttgatggtgttgttcaagtcttttatgtccttattgattttccttctattttgatcagttattgagtgaaggatgttgaaattacctataacattgtgaatttgtttacttctttcatttctatcagtttttgcttcaggtattttgaaattttgttattaggtgtgtgacgtttatcattgttacattctcttgacatattgacctcattaatacaaagtgaccctttttatacctgctctaaaagttactgttagatttaatatagctgttctcacttaaactttattgagttactttacacactgtaaaatttacccatgttaactgtacagttaggtgggagctatgcctcctgtacataggatgatgatttccaaatctgtgttttcagactttgacatctgaacctacgagctttgttgacttcttaaacttaacaggtctaaaatcatacacattcatctctttctcactccttccctttatcccaaatcaccctttctttctttgttcttggttcagttaatggcacccgtttctatccagtcagtattgtgaaaaatctattattgttaattaattccttttccttctcatgtttaatcacttgcctaaatttctagctttctaaggtctcttatattggtccttcttctctgtatctactttaaatacattttattaggcccttgtcattttttgcctgggaggactgctgtgacttcctgactccttttcctacttccagccttatatcccctccctttctactcccaccttgcctcaagtcaatcctgaggaggcattctttccaagatttaagtacaatcatgccattttcaagttgaagttctttagtgccttgcatttttccccaggctgcattgttagctcaattaatgattgagcttttgtcttctctagcttccttgctatagtatattgtgttacttcttctgtgtctttgtacactctgctatcttcgtctagaatgcccttattacttgatctgcatggcaaactcttattcttttaatttttatttgaagatcatgtatgtctttctctgtttccctatgtaaatctgctttcaagtcatatacttgtatggttaacaagtaactattcttttctatgtatatcttaccttttctatagctgtccgtggtatttattttctctttcacacattttgtgcttactttgtttatgtattcattagattgtgaactcctgtgggcaaatcatgtgccttatttttctctgtataccttgcctttcacatttcgtaaattttactgagttaagctgaaattacttgaatgacagataaccattgatttaatctgaaattaccataaacgcaaactgaaatcctttgaaaaccctagttagaataatctataactgctttctacagaaacaaaatcttttaatagccagataggtgacctatacctaactagagacagtaagtttgtgttgatggtccatggctgcattattaaagtgggagtgctaaagcacttagtattttgtaggtgccacatgaccaaagtaattggatttggtataaaagcttgaggttctgtggatttctcagtgcttagccttaaatcttttttagcctctttcatgtggccaaccaattcatattgagaaacagttgggcttcttcattaacgtgttattttaggaaagggattactgttaaggagtggtgatcccaaatgtgatacaatttgtcttgtttggcctttaactacagtcagtacactggaaactatgtgattcttaagatgataatgttcagaaacttttggtcatttgtaagacagtattattctgtgctggtagagtatgttcatttgctgttgaaaatcatcttagaccagatttgtaaacatctcccttataataacaccattttaattaacctcttggttatttccaggtttaaggagatctttttattaccttgaaggtgtggcatttcttttaggaaggtcttaaattccttcaggcacttgccactaaaggagtgtagaatgctgttgtttcattattttctgtatcagttgctgactatcctatagtcatttcccaaaatcattcttggcctatattgtgcacaagtaactatttatataactgcttcaactatttttttttttgtgtgtgtgtgtgttttcctggattctctgaaatttcttttgaatattattaaaatataggatgtttgagaaggctatttaatatctaactttgtcataaaaaaacttttagtattggccattgttacttatcttttaaaaggtagcattacattgttgattcatttagcatttttttttagtcattaaatggagcaatggggagttattcttggaatttggcgatgagagtcaatgtaaaattcatttatgattgttaacaatagttatctgccaaagtctttaaagggctctcatattcttagaccttattcggaagaagatggtctagaaatcttagcaaggtagtaatggatgtgaatgaaagctgatataaatagtggtattatcatagaagaaataatgtatcaatggaagtttgaatgtgtggagtctagtgatgggacccaatagatagggagggaaggaaattatgtttactgagtacctgctgtctgctcgtagtttccttcccttgctgagctcttatttatttgttgattcttttgagttttctatgtagaactcctattgcctgtgacaaaagacagtgggtttcctttttttttttttgagatggagtcttgccctgtcgcccaggctggagtgcagtggcgcagtcttggctcactgcaagctctgcctcccgggttcacgccattctcctgcctcagcctcctgagtagctgggactacaggcacccgccaccatgcctggctaatttttttgtattttcagtagagacggggtttcaccgtattagccaggatggtctcaatctcctgacctcgtgatccgcccgcctcggcctcccaaagtgctgggattacaggggtgagccactgcgcctggccttcattttctctttttatgttgctggctaggacttctagtacaatcaaattgaagccgtgatagtgagcatccttacttgtttccctcactttgagagagaattacttttgtagtttatcaagaatgtgatttgctgtagtttttggagatatcttttattaggttgaagaagttctctttttctccattcactttcttcttctgtttctactgaatgagtgtaagagcagaagtgaccaaaaggctggaacactgtacttttgagggtacattgaagatgataaagccaatgatcagaggcctgttggtaaagcaggtttgaggaagagggagcttcaaaggaaggatcaatttttaacagtggtggatagaagagtgatgtaaagtgtaggaagtggaaacagcaagtgtagtactgtttgaaaaagtaaagtgaaggaaggagaacaccaatgaaggttgaagtggaggcagttttgaggggagtttttatttattttttaaggacgggtgaaacttcatatttgtaagtaaaggttaaagctccagtagagaaggaaagagtgaatataaaggaaaatttctgccaaccaaaattccagcgtaattttatgtatccctatgtaaattagaatcatccagaatgcttccaaacatgattcaagagccacagcggcttaagcaagatagaagttaatttctgttcacacgtatgaattctgcaggacagtttcaataagagaggctgagaaatagagtttttatttagcaggatcatgggtctagccaaaacttgagggctctaggactaaggaggaagaaagaaaagattttgggagacagttttcagtatctgcacagtaagtgtgagaaaactcttaaataaaatttatctctctcagtatttgcatagtgtttaagaagtcaaaatgcatttgtttatatctagactctacttactagctccttgaccctgaacaaactatttttctctttgtgccttaattttttcataacaaggtagagaataatggtgtttgatagagagtacctcataagttggtatgataattaaataagataatatatgtaattgatgaagccattgccttgtacatctaagccacaattactagttttgttgtcatttgcccttgctcttcaaggatcagggatgtgttgaaggacaaaacacaaaaaaacaaaataatataacaaaaacaacaaacaaaaccttatattacttatgggatatccaaaagttaattaaatattacacattaagatacaattgaaaagagtaacttcaaatctcatgagaacttgtagatataaaactagatttttttggaaaccttggaaggtactcagccaaactgcaaagtttgaggacacagttcttcacatgaccactctcacatctggcaccacttgcaaattcagagggctccccagaccaccctctggcttgataatttgcaaggactcacaaagggattacagattacagggatccagattaaaatcagccaagggaagaaacacatagggtgaagtcaggaaagttccaaatgttgatctgccagtgtccttttcccatggagtcaggacatgttcttccagcaccaatgtgtgacagtatgcatgattgccaacctggtaacctcatccaagcttcagtgtatagagttttatggggcttcattatgtaggcatcattgattgattactcaattacctgtatggttgaactcagtctcccaatggactgatactgtgtaacccagagccttgtcctaagccatattgttggtgtttatgacatggccagcttttgctttaaaactattagttgtggccaaccctacctgaagatctggtatggccagcacccataataaacaagcacacttctatcaactatgacacattacctcccagaagctgaagtcaatggtgagacttctctttggacaaggccaaattctttactacacaggaagatacaagacactgatgaaaaggaatgatctttacaaatgaaagtctaacataattatctgttgaaaataccaaagttaaaaacaatcttaaaaatatgtatataagagaaagatcatccaagtgaaaataaaacccccagctggagtaatttaaaaatctagaaatttggctgccaaagcaaaatttgaggaaccatttgcatggagatcaaaatgaaaataaaattttgagtcatatagagaagaaaactagcaagaaagttcatagtgctactaaataattattgtgaaaactcaaggaaaagaaataaagcacattatttgctttggcagttgtaaagattgctgcattaacttgtaatttggaacagagaggttagaaggattgaaattattgacttacatgtgtatagaacattactttttacttgattccaaggtaagtacaaggaagtacttagcaaaaaagggttatagtgcttttaaagtggtatagtcagggtagtgtatgttttcctatctctgttaatgaaggtactaatcatagaggttttttttttttttagtgattgttccaggttgtagtgtgaggcatgggcagagatggaactaaaatctttgtctcctgacttttgggttaagtatactttttttctaactgcaaaatgattcctcttggaacccagttaataggaggtctgactgaatttcctggaactctggagtttctcttaggaccagtctggttagtcttttcttgccctctagttgatattggttcttctgaaatagtttactcactaaactcttaagcaaatagtgcttgttgaggaacaaataaaaataaatctatagattatttagattttcaaaatgtgtttgaataaggctcttcacaatattgcaacaacataggttctgatgagcaaagtttgactgctgtaacaataacaagtgggataagatgattggagctttcctttagagcaaacatttagagggctcaattttttatttttaaaaataattataaaaattattatacatgttgctatcaaatgtactttgcacctgtggaggaacaactgatgctaacacgaagttaatagcaatagtaagtgaaaatggaaaactgttacatggcagtgttattaaggggtctcaccataacaccttgtcattaattttaatatggattttaatatttaatatgcatttgtattgcctaccctgtagtcagagccgctgtttataaccccctttttttttttttttttttttggagacgtagtttcgcttttgttggcccaggctggagtgcaatgtcacgatctcagcttagtgaaacctccgcctcccaggttcaagcaattctcctgcctcagcctcctgagtagctgggattacaggcacctaccaccatgcccagctaatttttgtatgtttagtagagacggggtttcaccatgttggccaggctggtctcgaactcctgacctcacgtgatccacccgccttagcctcccaaagtgctgggattacaggtgtgagccaccacacccggccttacaactcttttgactgtttgtagcctcatgatggtatatagactttgtatatcatatttacttcagatggggtcttagaatctgtatttgcattttagtatttttaaacacctattatatgccaggtagtgtcctaggcattgagggatatgttggaacaaaaatcagatagggtctctgaacttaatggagttaatagtcatcaggagagacaggcattactcaaagaatcacatgtggttaagtactatgaaggaaagatacatggtgccatcagactgtatattagggagatttgtctaatctaggagaagttatgattgatcagtgacttgaaggtaaagaagaaattgtaagagtgttttaagcgaggaaacctcatgcatatggggctattgatgggaaagaaaatggtgtgtaaaagaactgaaagaaggtggctgggcacggtggctcatgcctgtaatcccagcactttgggagcctgaggtgggtggattgcctgagctcaggagttcatgaccagcctgggcaacatggtgaaaccccgtttctactaaaatacaaaaaattagccaggcgtggtggcgtgtgcctgtagtcccagcttgttgggaggctgaagcaggagactctgttgaatctgggaggcagaggttgcagtgagccgagatcgtgccactgcactacagcctgggtgacagagggagactctatttcaaaaaaaaaaaaaagaactgaaagaaggtgtgtggctgtagaacagagagctagaggagtatgtatgagatgaagcttgagagatagatagaagctacattatacagaatttcttaataggccataatataatagaattccttaggataagggaagccatgaagtgttttaagtgagagtgaggcatagtctgaataatttcagaaagcacattgggtctatagtatggatggagaatagcttgtgggtgggttggagagtggttggagagtgaatgtgtgaagactattggaagcgtattacagtagtttaggtgaggcatgatggtagcctccttattgtggttccatcgcatgctaaaaagagtatgcagaaaaggaggactatgactaagtaagttcaagaagtgttgtgttaggcaactctattgcagaacttctcagggcttttaaaatgcccatgtgcgtggtgaagctctgtgaggggatatgggatgttttgtggcatatatgtcttgccccccacagggtggactctagaaaatggtgtgtaatacctgttcgtggaagctcactggtaggtgaagatgctttctgagtgataacatatgagctattgcaaacatggtcggggattccacatgccatttagcaataacttggggataatgtggtacgtggagatagaaatggaaagcttgttttcctggggcaatctccccatttgtcatcaggacagaaaattacccttgaaagagccagtcttccccatttgatgttgctcttctttggggcccatttccaggtcctctgtttttctgaatctgtgtgcctgcttgcacagtgagtgggtgagttggggaaattctcagctggaaatgtcagaatacccattgatagttactccatagaatctgaaatctggggacaattgagggccgtggtggtaactcatgatagcaagcactttccctctttctcttctgtcctgaaccatgttggccacttgacctcaggcttatagtctcttgattgcaagatggctctcttagctttaggcttcacaaatacatttgaagacaggaataggtggttgggtgggtttagacttagcaggtaaatgtccttttctcaactggctctgtccatttgttaatccgtaaaggaaaattcctggtagttcccttttttctctctggttgaaatagggttttatggctacccttagctgcaaggacagctgggaaagacttgattaacatagatggattatgatctgttctctggggttagtagtaccgtgtttttctgttggtaaaatgtggggctgggattggaagactcttgggtgtttctgccttggatatcttatataagacttcagtcagcacctatgtgctgatgatgcccttgtctgcctgagtcgcctgaacagatcagccctcatgtcagtttctcatggtttcattcagggaccaaccttagttccctgccctgttcctcccacatcaatccagtctgtctgtagggcccgtggattcttcctccctgctgaatgaccttttgtgttactgaccgtctagcctacttcacctccctctccctttctctctcttgtttctcttatcagcaccttttcagtgctaataactctttttttttctccagtgtttaacattttattgttaatactagataatattagattgtgaatttttcttttggcatacaggtttatgatttaacacgtgctattcatgtaactaccatcataattatatatgtaacaattctatcattaaaaaaaaaactcccttgtgttattcctttatagttagcccatccctcatccataactcctggctaccactaatctattcaccatccctcttttttgtcttttttgagaatgtcatataaatggaatcatatagtatataaccttttgaaattggcttctttcactcggataagaatgcctttgagatccattcaagaagtgtgtataaacaattcactcctttttattgctaagtagtagtctgtagtgtggatataccacagttttgtttaactgtttatttttggaggatatcttgattgttttcagtttttgcctattatgggctataaacatttgtgtatagtcctttgtcctccattttttttcattatggcaaaatacaattaacataaaatttaccatcttaaccattttaatgtgtacaattcagtagcattaaatacattcatattgttgtacaaccatcaccatcatccatttccagaactcttttcatcttgcaaacctgaaactctgtctgtacccattaaacaataacttctcattatcccatctctagttcctggctaccaccattctactttttgtctctagggttttgccttctttaagtaccttctacaagtggaatcatacagtatttgtctttttgtgaccagcttgtataaaggtttttttttttttttcagtgatcataagtctttatttctctgagataaatgccgagaagtgcatttgcaggattctatgatagttacatctttagtgttttaaaaaaacacaaacttttccaaagtggaaaaatttacaccattttacattctcactagcaatgttataagttcagccatctgcagagcttgaattaaatttctggagagatgacctattgactcttgggttaggtgtttacccttagagtagtcatcgttggttgactgatttggaaaagagtgttttacagtaagtaccactcttgtattcattcctgtggattggggtggatatagagggaatattgaactctctttcacaaaagtagggctgggtggaaaacggtgtaggtgtccattgcagtagtggtttccaaatctgtgtgtacaccagaatcatctgaggagctcttcatgatacagattcatgggtttcatatagacctactaaattggaatctgtttttaacaagagttcaagagagttttaagtagtcatgcccacatctgttgggaatgttacattatagtatctatgcacttttgaaaacttaaaggttttagaagcatatgctgtactatataaatgaaaaacttcctgttctcttatcttttcctcttatttttttctttggccttatgtttatatttttgtctcttctctgttacttattctatttttgttttctctcctccatttagttttcactggtgtctgttttttgcaagtgtctatggataagttactgttatctttgctcttagtctggaaattgtataaagagattataaacagagtttgatcttaggcatccagggttccttttctttctcattccagatctgaatgtgtctcactgataattctttccttttaatggcaaaagtagaaaacaagttcctgggtttaatggagaaacctttatgttttatatttaaaggttgacattcttaagtaggctcactgttacgttttatttccttcttttctcacagggaagaggaagaacgtctgagaaataaaattcgagctgatcatgagaaggccttggaagaagcaaaagaaaaattaagaaagtcaagagaggaaattcgagcagaaattcagacagagaaaaataaggtagtccaagaaatgaagataaaagagaacaagccactgccaccagtccctattcccaaccttgtaggaatacgtggtggagacccagaagataatgacataagagagaaaagggaaaaaattaaagaggtaataagctgagttttgtgatatggagtgtttatggatttgtatttggatacaaacaaatatatataatctatggtatcctgttttgatctgtttattcttgggtcatagttgtagtatagtttccaggttggtaataaggactagaactctttcttgtttttttttttaatgttaattataatgtaattattggacacttaaaatatttttgatacaacttttggatggttagtgccactcattctttgttcagagatcttttgaaattcagcgttttattaataatatatctgtatataacttattgtctaagcagtttcttaaatgttcagttacaaagggactctgctagatactatgcagatcacctcataaacatgcttctaaagagctagcattatatctccaattttttaaggaacatgtcatggtatccctcaactatactgtagattaagaacacattccttccaaaaagtctccatggattgaaaaatgggaaagaattgatttcaaaattctttaaatttatttagcctcagaagtctttcaatttgttattctgtagttacttaaaagtaaagagaataccagatgggaaaaatctagtgaatatttgggttaaactttgttaattagaactcctaaaaattctgggtggagtttgtgattatactgcctgtgaagaaaaatattttatcagagtgtaattgtaccaacaatatttcagaaggtttaattattataaagtaagataaatttagttcaagtaatcaaatatctatttggatatattctagtaatggatatggaaggtatagcagatactttaagcttagccttatgaattattataaaaccttgaccttgatggagtagaaatagagctgtgctctgattttacctcacctctagagtctgttttatatgtagactacttaaggcacttccttcggacagtgttgggagagacagtgatagattttttttcagatgcctgacttgctttttttcagatgtcattacaatgtactgaaatacttttttcaaatacgtaataattcagatagataaccatgtgtgttcaggggacccccagatgatcctcaggttcagtgactcaccagaagtacccacggaactcagcatatagaaacatgttttagtttgctgaacttttatcctgttattttactgaagttatttattcttatagcttttttgtagattgcttgtgatttttcttatacgtagtcatgtcttctgtgaagagatacttttactttttccttcttgatttttataccttttatattttttttcttgtcgtactgcagtggctaggagttctaatacattgttcaaagtaagtggcgagaatggacatactaggtttgttcccaactttaggggttaagcatccagtcttttgccattaactatgttgtgtcaactgtaggttttttaaagatgctgtttattaggttgaggatgtctccttgtaattgtagtttactgagagttttatcatgaatgagtgttgaattttgtcagatgcattgtcttcatttttctctagatgactgtatgattttttttcctttattctgttaacatggtaaattacattgttttttggatgttaaattagtcttatattcctgggttaaactccactttgtcgtggtatggtatctgtcttagatgttgctaatttttcttaaggaattttgcatctgtgttcttgagatacattggtcttgagttttcttgtaatatctttgcttgattttggtgtctgattaatgctggctgcataaagcaagttgggaaatgtttaatgaatagtatgctgttaaatgaatagatttttggtctactattatataattcgtctgatatataattaaatactctgctattgtataactcagaactccttgggttgtaagacactcagctcaaactaagtgatacaaatagtatttattggtttaatggctctaaacaagggcttcaagtttggctgaatccaagcctgtagatattattgtgagtgttaagcatctgtctctctttccttttgctagtttctccatgctggcagagagccattatcagctccaggattatatattacatagaccatcagattgcagaataaaaaagccctctatctcatggtgtcaataacaatatgtgtaaaaagaacttgattgttcctacctgaatcacatgtatccactcactttgtttagggcaggggttgacagctgcaacctgtgggccaaattctgcttgctgtctgttttttaaaaataaattttaggctgggcatggtggctcacacctgtaatcccagcactttgggaggccaaagtgggcggatcatgaggtcaggagatcaagaccattctggctgacacggtgaaaccctgtctctactaaaaataacaaaaaattagccaggtgtggtggtgggcacctctagtcccaggaggctgaggcaggagaatggtgtgaacccgggaggtggagcttgcagtgagctgagctggtgtcactgcattccagcctgggtgacagagcgagactccatctcaaacaaaaaaaataaataaaataaattttaatttgaacacaaccatgtccatttacttagatattatctgggactgcttttatgctgtaacagcagagttagtttgttgatctctggtctaaggataggggattttctagctagggtgagttaattggtggtagaagcagagcctcttgattgacagctctgttatatgtgaggaaaggagagctgtccccaaaaagacttaacatttctcaaaaggaaagaatgccaaacaaatatgtacctcctgaagaaagaagacttttctattatgcccatttttttcctgtcatatagatgagattaaacatagttatgtatgttttcatactgatacaaatgctaattgaataatgtactaatatagatctggaagaatgggcaaggatatagtaatagaacccaaaattgtatgaaataaaaaaacagtttgtgaaaaatttaaattgatggattataatttttctcttttcagatgatgaaacatgcttgggataactataggacatatgggtggggacataatgaactcagacctattgcaaggaaaggacactcccctaacatatttggtaagtttactttttctaattactatttccattttctacctccatcttttaaaacaagatgtaacttttcaaagtactttctaaaatctgagtatttctgtggaactataatttgaagaaacaggtatgattttttgcaagtgtcagtcacgattaagttccagttgctttggagtacacatatatgtggtagattttctatttacatatggatgctttagtcatttatctgagtatttaaaagcttttttttggcatttttttctttagtgtcaggaaaagtaggcacctacttgtcatttttttcttcaacacaatacctattctgatattcacattacagaggaagaggggagggataggaaattcttgtagttctgtgtacattttttaaaaaagtgacatacctgggatgattgggttactgaattcagtgggttatgttgtacattcacagttcctaaggaaaaattaacaatgtgttctgtgaatggaggtttggggaagagctgtgttcatcttgagtttgttcatcctactttccctgagctcagttcacttgtaaaacttcccagtttaacttaaccaatttaacaacttttactaaacccaaaggtaagtcttcagaattgttaagctactctttgtagtcttcactcctttcccccattttaaatgcttcttgatgtgacttgatcattatcttttaagtaatgatagatgaaggcaagaaaattttaatgggctaaaaagtcacaaactagttatatgcaatctgattttattacctgtagtaaaccatcacagtaattcaaataacagcaattttctttttgacactagggaaggatttttctaatgctgtgagttttcttataatttgttcattgttgcttgcttttgatcaaaaaagaaaatgtcttaaaaaataatttctgttgggtttgggagatgttgtggtagaggagtaaaggaaaaaagtttcctctaggtaatcagtgactactagagacttcataatatgatatttaatttatcagccattatgtaatgaaataaagtatattttcttaacagagttttggactggaaagttcttactgctttgtggatgtcacaatatgaggcgttagtgcaataaagacattaaatttaatagtcaattaaatttagaacctcccttcaagtaactatttttatgttaaactcaacggtaaattgtgagccttttaaaaagattggagtataaaaatgtattgaaaataaaaattggatgtcaattttttacttttttcaaacgatatttctcagaacatctaatgtattaatatttatcaaatagatactggtcctatctgtttatcagataaatattgatgctttagtaaactttaaaggtagaagaaaattaattttgacacttaggaaacatctattctgcgaagaaaattatagtgaaatggtagaaaaagaaaatctacagaattttcagtagtcaaaattaggtgctgcttattttttattgaatttttgagtggttacagtttcttttccagccagataagctaagtaggaatagatccattattatgttttgtcttatgtttgtagctatgcagtcagtttgttaaaggattattttttatagtttaatactttgtttcctacttactctgtttcttttgtgtatctcaaattcttgccagtaagtacaatttgagtttttttaatctattttttgatctttttcttttttaaaaaaacagtaaaagtctaagagaagcgtggtaagtagttctcagtgtctcatttgacatctcaaatttagtatgcctttacagaataggaatatgtaggtggatactgaacctttgcttgcaatattctagattttagggaaaacattaacttaaaacactctttttgttagccttgattattaaacaattcttttatatggtaactgagataggggctcctctgacttctgtctagttagttcttggcatcagagtcctctttacatgcagataacagaaaatccattgcaaaatggcttaaactaaaaagaaaacttaatcagctgaatgaattcctggtgtatatctgattttacctgagcttttttactttatcttttctgttttcctgtgttttgatataatcaagctggtttcttagcaggatggctgcagcaacttgaagcttcatatcttcatactaccacagctgtgggaaagagaacattgtagagaagagagcactcggatgtcttagaaatataattgaaatactcactgtttcttattgtctctgattaggtcttgtgcccattgttgaaccaaatgctgtgcttaggaggatgggacatgttctttttgttttgcttagttagggcctggctctggagccaggagaggggaggaggaaatgttgctggatgtaagttagcactgatactaattattctaacaatgattaatagttagaatggctgggtgcagtggcacatagtcccagctccgcaggaggttgagatgggaggatcgcctggggccaggagtccaaggctatggggcaccatgatcatgatgcctgtgaatagccactgtgccctaacctgggcaacatagcaacatagcaaaaccctttctcttaaaaaaaaaaaaaaaaaaaagcagaatgagttctttctatttagatattctggaaagtagaaagttttgttagggataggtctttttgcatgtagaagaaattattttaatttgtaaaaagtattctttgattttgcaatgctctttgaagggtgcattttattttccaggtgtgtgtgtgtgtgtatttatatgtaaatatgttccttttgttatttctgacttaactgtgatttgatttgtacatgttttgttgaagattgttgcttctatattaataagagatactgctctgtacttttcttgtattatctttgtcttgttttgatatcagagtaatgctggactcagaaaatgatttgggaagtgttttctgcttttcagttttctggatgagattgtttaggattggttttatttttttctttaatgtttggtatatgttgctgaagaaaccacttgcatctggaattttttttttcttgaaggtttttaaactacaaacttaatttctctaatagtaaggaccattcagtttatctgtttcattttggttgagttttggtaatttgtggtttttgagtaattggtctggttttatctaagttattgattttatatgcatagaattgtttggagtattgccttgtcatttgaatgtctgtggcagctgtagtaataatcccctttcatttctaatattattgatttatgttttgtctcctctcttgtcctgctagaagtttattaattttattgatcttttcaaagaaacaacttttgggttcattgatctttgtaatattttctttgtgttttcatttctttgatttctactctttattgttttcttcttttgcatgatttgggttgattttgctcttgtttttccagtgtcttgaagtagaagcctagattattgaccagagatcctcttttctaatgtgtttattactgtaaactttctaactactgcttttgctgcatccctgaggttttgatatattttcattttcattcaattcagtgttttaaaattttccttgcgtaagtttaagtatttagagtttaaaaaaatccttctgttacagatttctcgttttaattttgttaggatcagagaatgtacttcacataattttcattcttttaaattatttttggtttgcttttagacacaggtttgtcttggtgaattttccatttgttcttagaaagaatggtatgtgtatattctgctgttattgtgtggaatgttctattgatgtcagttagatcccattggttaatggggttgttcaggctgtctctatcttagttgggtttctgtctcattctgtcagttactgagagagggatgttgaagtcctcaactcttattttggacttctttcagttctgccaacttttgcttaatgtaatttgaggtactcttgtcaggtgtttgtccattaaggatgatgtattcttaggagcaccactaaagtcctagtatcaaaaccagacaaagatatttataaaaaaaggaaactatagagcaatatcccttatgaacatagacataagaatatttaattaaattttagtaaatcttattgagtaatacagttgtcctttggtatccatggaggattggtttcaggactccagagaataccaaaatccatggatgcccaagtctcttttataaaatagtatataatatttgcatataacctaagcatattctcatatatttaaaattatctctagattacttagaatacctaatacaatagaaatagttgttatactgtgtcttaaaatttttgttttttaaattgctgtgttatttttaaaattattttccccaaatattttccgtctaccgttggttgaacctgtggatatgtaactggtgaatactgaaggctgagtgtatattacattatgactaagtggaatttatcatagagatacgtggtaggttttacatttggaaattagctagtgtagtttaagatatcagtataataaaagagaaaaatcataggattatcccagtagttggagaaaaagcatttaataacatttaacatccatcgatgataaaaactgtcagcacactaaactaaaaaggggatttctttaacctgataaagagaatttcaaaacaacaacaataagcaaaaaatgcaaaataccccccacatacttaatattgaaagactatatgctttcccctaagattgcaagctaggcaaaggtgtctaccctctcacttttatgtaacattgtactggagatcctagccagtgcactaaggcagaaaaaagaaaaagaaaaaaaaaaaagaataaagattggaaatgaagaagtaaaactatctttacatttttagtcaacataattgcccacagagagaatcctagggaatgtacccaaaaaaggtgctagaataaacaaatttagtaatgttataggatacaagtttaatatgcaaaaccaattatgtgtcttggtatacttgcaacaaacagttataaacacagtttaaaaaataaagtcatttgcagtagtatcaaaaaataagaactatatgtgtataaatttgacaaaatatgtacagaacctgcacatggaaaactttatgttgtttttgagagaaatttaaaaggacttaatggagagaaatgccatgttgatgaatttgaatattcaatattgttgggatgttaattctttctaaatttatgtttaaatttagaggagtccaatgaaaatgactaggcttttctgtagaaattggcaagttgattctaaaatctatgaaaatacaaagcacttagaatagtcaagtaatttttttaaaaaaaaccaagttgaaggatttgcactacctgattttataaattacagtaaagctacaattcaggacagtatggttttagcataaggatgggcatagagatctgtggaaaagaatagaaatagaagtgtacatacatggttaattgattttcaacaaagatgctgaggttcagtgattaaaaggatagcctttccaacaagtggtgctgggtcaactgtatatttgtatgggaaaagaatgagctttgcctcttccttcaacattgtatagaaaaatggatcacagagctaaatataaaagctaaaagtaaaaaaatttcagtagaaaacacttgagaacatctttgtgactttgaggttagcaaggattttttagaacacaaaaagcattaagtataaaataaaaatgttggtaaattggacttaatgaaaattgaagatttctgctccccaaagacatcaggaaattggaaagacaaaccaaagacttggagaagatatttgaaatatttacataaggatgtatccagaatatataaatacttccccacccaaggaggtatatgaatagccagtaagcacatcaataagcagggaaagtaaaattcacaccacaatggaatatttctacacacccattaacatgtctaaaatttgaggatcaacaataccaaatattgacaaggatgctagagcaactctgttatacattgtattgggaatgtaaaatggtacactgtggaaagcagtttgttggtttcttataaacttactgtatagcctagcaattccactcctaaatatttccttgttgctcacaaatgagatcaggtgtagttgtatgtttcttagtaaattcgatttttttccgccaatgatataaagaatttacaaattgaattttaagatctttttccctatgttatataaaagtttgtatagaataggagttatcatccttaaaattaaagtagtagtcattctatgaaacttctagaatatggtattttgatagcgggtagctctttgaaaacttttttatttcctgtgtttttcggtctgtttagattttctgtttcttctttcataagtcaaaaatagtatttctcgagaaagatcaaatttattgtgaatatatgaataaaatgggccttttataattttaaaaaattttctctgtgcttgtctgttgttacatttttatttattttgtgtttttgtcttgtctaccttttaaaaacgaggttaatggtagattcattgtatggttcttcatggaaccatttcttgaatttattatttcaataattttcttcatttctaattcatccatttctgcctttagtttttctcattcttctattattttgctcaaatttgttttttctttcttagaatattcagttattttcatttgttcttattaactagtataaatattttaagtgtttttgtgagaactgctttagttgattcacttgctctcatactaaatttttatgatgttttatatattttgcaatgtcatgttttgctgcttctttgacccaagaatagtgttaggctttttcattttttcctgttcaaatcttgacttcctctaggtaaacaatcatgatgatagccagtaatttcaattttacacttttcttccttgaagcctttagctcatggcacctagtgcaactaaccaagactggtacagaataggtgggtcaggcctttttccactccagaatagtcaataccttagagaaatatgtacttagaggactaaataaataactaggtaactggaggagcagaactatctacaaaaattaaaataaggacacaaacagtagtctcaaggatttaaaataagtttggtaaatgttttggatgaaatgctaaaattaaaagagaatacatattcaagaatttatgcaagagatagagatatatgagtgattaaatggcttgataccatttttatcgtaataaaaagctgaggaacgtaacaacacataactttctagataatatcaacatgaagggaactgagtaggtagaagaccaaggaatttatcagagtgtgttggagtatttgtcttgttagctaagagaagatagatgtattgataagttgaagaaattattaggaacacatgaacaagaaaatggcatgtaaattaagaacaaccatcataagaacaaatttgtgtagctttaaatcattggaagaaaacaatttctactcagtagaaagaggaatggaaaaagaaagaaaagaggagaatagtaaatggaaaatgtgaactaagtaatgttgaatgctggctctgaaaatgtcaccaagaaaacccgttgataagacaaagctgttaattattactttggtaaggagatcactacctcgctggagtcgtaacctttcagagttttggggtataaatcatcatttgatactttctgttgtagagttgatgggtctttaaagaagttcctggaatgaacaataaattttttttgcaacttttatctttctgagcaagagctcctggaacagtaaattcatgttgttgaagacaatgtaatatagtaaagccatgttaatgcaggcagtaagctgtgtggatcatttgcattttcataggacacaaataataattgcattaatgggattggggtgaacccatctgctccctgatatttatttttttgctgtactactagattttttactctactagtagcaaaacaaacctagtttatttaggatttgtagagttatattcattagtaagattggcctgttttcttctcttaagttttcattatctagttttggtatcagttaggctggttttgaattaattcttccctctcttcctccctttctctcttgctttcttcccctcagaacatttttttaatgataaggattatctctttcttaaaagtggatacattttattattttgattttctctactcatattttgtttgatggtttccttttttcaatttgatctacctgcttgttgattgttaaggattgttttttttccactgtggttatccagccctgttgtacatttattattatttttaaatatattttttgtcctttatatgaatttggaccagaccagaaggacatggttgtcttattacttagctttgtcattgtgaagtactctcctcttttcttgaattaatcctctttttttttcctttctcagttaagtagatagatatctcatattctgacgaggcagaaaattaaggaaaagtatgcttttagttttcttttatcttcctatttttagtaaagtactatttttagtaaaatatattaaactatgtatattatctaatatatacatataatttctaatgtaaaagggaacaatattgggtattctaaatttttagtccttatactcttactttagtttacctttatacataaataattaaaatacactgaatgtgaagggaatcttttttttccccccaaagagaacaggaacctaaagggatctttttaatgataatttttttcttcccaaatataggaagttcacaaatgggtgctaccatagtagatgctttggataccctttatatcatgggacttcatgatgaattcctagatgggcaaagatggattgaagacaaccttgatttcagtgtggtgagtgtatgattgataactaatctcttagattaaccatgaaaagacacaatgtctaactgctatggtctgaacatttgtgccttcctaaaattcatatgttgaaacctaatcactaatgtgacggtactagaagatggggactttgggaggtgattaggtcatgagggttgacctctcatgaatggaaaaaatatatatatatattttaaagttgagtaattagcacagcttcgatgaattttcatagttaggcctacactcattcttctggcactttagcatggtcaagtggcactgcttaggtttggcatagttgttaagtcacacgcccagcacagttgcattcttggtgtgcgacttgagaaagttccttatcttcctaaacctgtcataaaattgatattccattatagtattgtgaggattatttgagataatgtggtacatattaaatgctcagtaaatggtagcaattattttcattatcaccagtcttcacctaaaagatgtgtggactgttttgtcatattcacatcttttgtgatatttgtgcttgcttttccttttgactgtattatccttcactacttctctatgtacttctctctggcagactcttcgttatttaaattgtgatataagtccataattatttcttctctgatgccattcttggagctaactagacaaaaatggtttactttcctttatattactgtagaatttggacgtatctcaaagagaacaatttttattatcaattaagtttaggtttgatggtgagtgatagaaaacctaatataaaagagcttaaacaagatagatatttatttttttttcatgtaaatcaagtacagagttaagcagttcagggctggtttgggtggctccttgatcatcaaggatctaggatcatttgtcttgttgttctgttggcttcagtgtatatcttagacctcatgatatgaaatggttcctaaagatccagacattttatccagttgacagaaagaatgtgactgttctctaagaagacttctcaggaggtagtctccccatttttgcttttagagtttactaacacagcctcaactaactccaaaggaaagctgagaaatgtagtctttttttctgtgtagctatgtagcctttatacaacagattgtgctttttgtatcttgtttaagaaagccctactcctagatcatgaatatattttcttatattttattctgaaggttttaaagttttgcttttgtatttagtctttaatccaaatggaattgaattttttttaatgtaggatgaagtaggccactattagttgatcctagtaccatttcttttcctgctacttttatatgccacattagtcatatattagtcatattacagtttattctttaacattggcttttttctttatccatatgtcaatactaaactatcttaactacaattttttttataagaagcttgatgtctgtatctgaatctgttctctgttggtatctgatcttgttctctgcggaaattgtcttagttctcagctttttgttctttcaagttctggaaaactgtgtggaaattttgaggaggattgcatttaatttgcagattaatttggggagaattagcatctgtgcaatactcccattcattgacaggacagctttataatggctaataattcccttgtatatcattattatcagtcagggttcaatcaggaaccagactatgccatttattttaactagaggatttaatgtttagaattgttatccaactaatggggaaccaaaaaggcaaaaagagagcattgtgatatcaccagaagtattaactctaggaaacaggaaacagctgccacctgtggggactataagaacaatgggaagaggttgggatcattaaaatgcagtagcttgggctctatggaactggtacctgtgctgcccaggtgttactggtacctcaggaagactgtgtcagagctgagactcagaactctgaggaggagacacctagccaagtgcttgatatctgtaaaggaaaccatgaggctgatttggggattgtgtgtctgtatgtgtgataagggaacagtactctggaagcagttgccactgccagggtgaaccctggctggtgagacactatcagaaactagaagtaagcaggagggaataagactcttcttcctccagtcttgtattgtctttttagaacctcctaatgttagtgcctaaaagggagccagttggtaaattaaatgcatttgtgtagttccaactcccatataccaaagtagagtatagaagaatggatttgaacctgagagaagtagtgtaatcatcagcacagtcattttttgttcctttctttcaacctttaaatgtcattatgttttagctgcttattttgcatatatagtatgtatttgggttttgttatttttatccaaccttagagtctttttaactattaagtttgatatatttacatttactatgataacatatttggagttaggtctttcatctttgttttgctacctatattatgatcatacttttcatttgtttttagtttgttttccttattttggattaaattacatcatctctctttttccctctactagtttaacattataccttccatttctattgactttggagatatccttgagtttaaatatatatatatatatatatatatgtgatatatatgttttataaaaatacattaaaactgagttttatctcttttttgtgtttgtgctctggtgtcaggagcaaaacaataaacaatgtatgtttaaactttaagggtaactccaaagtaggcgtgcacacacacacacacactctctctctctctctctctctctctcatcaaagtatagtatatataaatatatataaactttaaggataaccctaagtaggcagtttgaaattaatcaatttcagacaaggagtcatggctcgtgtctgtaatcccagcactttgggaggttgaggcaggaggatcgcttgagcccagcttgggcaacatagtgagacctgaactctacagaaaataaatcccagctacttgggaggctgaggagggaggattgcttgagcccaggaggttgaggctacagggagccatgatcatgctactgtactctagcctgggcaacagagtaagatcctccttctgaagaatataaggattttagaatgctttaacttaactcatcccccttttgttttatgtgtcattgttgtctagttgatcccaagttatattttaaacttccaaattaagtaatagataaataaatgcacacatttatcaaatgcaacaggcactgttctagattctgtggatatagtaatcaacaaaacagagttttatctcttttttgtgtttgtgttctagtgtcaggagcaaaacagtaaacaagttatatatagtacatcagagggtgatgataagtgctatggagagtaatggtggggtactgctattagtattttacatggggtggtcatggaagaactctttgttaaagtgacacttctgagaagagacccaaggggagccatgtggatatacaactctgtcttaatagatattaaaactgagaatagaggtacagttcccttgtctttcctgcttctgttatactattgcaaagtgtgttttcagtttaattttaaaaaggcaatctgttttttcccttgttttaatattttattttttgctttgttgttctgtaattctattactatatgtctatgtgtgggttattctttaaaggactcataatgtttcatcaatctgaagacttacattttcatcaagtttagtaggttctcagttattacttctttcaaaaatgtctctatcctatttttccgttctgtccctctagaatttctgataccttttgtttctgtagtgaaggaagattgttttacaaatgaaactatttgattaccgtgtgattatatatagttagatgatgatgtgttaattagggaaataatgcaaggtaattggtattaatattttatattagatggtcagaaaaaatttctgataaggtgacatttattcagagacctataggaagtgagagtgatttgttcagttatgtgaaaggaaagcatccagataatagggtaacaattgtaaagctgacataggagtctcaagtttgacaattctgggtacagcaagtaggcccatataattaaatgaatcaaagggatattaatacaagggatgtcaaagaggttgtaggggatctgagcatgttggatcttattggtcattttactcttgagtgttatgtgaaggcatcgtaggggtttgcacagagtagtgatctaaactgatgtaagatttaaaaggctcattttaactatagtgtgctgaatagagggtaaggaggagggtaagtattaaagcagggactggttggaaggttattgttgcaattctggtaagagatggaggccctcccacccttttttccttcctcctcatatttagtcaatgtctgctatgtgccctgtagtatgttagatgttgggaatatatgaagtaatattaagcactttgctttcatggtgggatggaatgatgatcgtgttatcaaaaaattacattatattgtaaaaattctatactgaagaaatatgttagcagatgatgtgcctgcctatgaatgttggaaagactttagagtaatacagtttccttttaatttttattaaaattaactatgaatgtttttatgttagttgtatatcttctgtagattctttgattatgttctctgccacttctgcttttctttccatgtgttagaatatttctagcaatatctatatcaatatgtaaatacaaacatagagactctatttagtaaggttattaatattactatatttgtgctgtttccatctgtttgccatttagttttgtttatgattctttttcttataggtaatttgcattttagaaaaatttcatgtctgtcatcaatttatcaaaactattggttttatgcttaagtacctgctttctcagggaaatttatatattgccacacttctactttaaaaatttttttaaacatttatttccaaataatttagatttcattttgatatttgtgaaattagtatttatgttaatttcttacccaggaggcaattttctcaacattattattgaataatccatcattctgccatttttttggtgcctcctttaacacttattatatattctaggaaaaatacttaaaatccaggaggagagaggaagtaaaaattatgctgtagtgattagaacagaagaaaaaggaccaccagtaaagagtgctattctagaatcatgacccagaattctagaaatgaaggctttcatgaggaagggtaatagttaacagtgttaaatatcctgataagttcacagtactgtgtaaggtacataaaaaatggcttgttggtttcaggaattagggagctgtggtgacagcagtagagaagtttcagtaacattaacaaacgagaggagagattgcagttgcatgagaaatgaagatgcagaaagtagaaaaatattttccacagggtgtttgtgaaaaacaaatgaagtattgataatattttgaaaactataaagcattacgtatttgtgaatgttttcaatatgtttttcacagaattcagaggtgtctgtgtttgaagtcaacattcgatttattggaggcctacttgcagcatattacctatcaggagaggaggtgagcaaaatcaagcaatgcattgtttgttttggaggggagggttggaatttaataaaatgaacaatttccctagaagcatattagttttctaaattggtaatattgaaccagtctagaactggttgcttcaggcagaactattccttgggaataataatttttccattttgaggctctcaataaaacatgaattcatcacagatcctagctttatatacaccatgtctcctttgcaagagtgatccttctccaggattttgccattgcaattaattccatggcccaagtaaagggggaaaataaactaataaggacaaaattaaataacaaatcagaaagaattaatatggatcctcctaagaccaaaaattagtaattcaaacttactgtttagaaattgaatccagtttttggctataaataataacaactctgaattctcctctctggaaatcttggtacagaacacatggagacacttgagacctaaggtgatggagaagtgggtgtaggaaattcccttttactattgaaataggttaaagaatgaggttgaagagtgggagaaagagaaactaaaggaagaggttataagtcatttatttgttttttgagcaactgtttcacccatattttggtttgttgatctagacaatttgtaagagctctttgtagatttaagaaaatttaccttttgttatatgtattataaagatacatatctatgttagctgtattttgtttaatttttttttgttgttaatgttgaagtaatcatttaaaggatttttttttccccccagtgttttggcttctagattttggtccttagaaagcctttcctatgtctgtgttattacaaaacaaaaattcccattttcgtatggatttttatgactttatatacttttatctatatatttcatttattgttgttcctttgtgtgtaaagagtgagctatttatgtactaccttttttttttagaagaaatatgtttaaagatgctggtatttaatatattagattacatttatcttaatgtgtaattttattgtcaaattatattgtgtgatttgtttatacctctaacatatatttctatagtcagaacatttaaattcacatttaataaaatagaaaaaaatgatatatactctggccaagaggttatcaaactttagtatgtattagaatcacataaggtgttttataaaaatgaggattccaagccctgcccaaaggaccgattcagtgggtttagcgtggagaccattatcctacgttgttcatgccaaatactccttgttaaaggtgattttggaaacattggttctatattttgagaaactctgacctggcttataggaataaaatcattgtgaattaattgttatttttagtaaggtttattgaggtattatttacgtacagtaaaattcagtatatagttttatgagtttttacagtgcatagtattgtaatcaccagcatgatcaagatacagaattttattatcctagaaaatttccatttaccattttataattaccctatcccattgccagcccctgataattactgatctcttttctgtctctacagttaagaatgctggcttcttttacttagcataatgcatttgagatttatccatgtattagtagtttattcctttttactgtattacagtactccattatgcattttatatatttatcagtggaattatttacagttttggagattgtgaataaacctgctataagcatttgcctatagatttctgtgggaaaataaatttttatttatcttggataaatacataggaatgggatttactgagtcaaaggttaagtgtatatttaactttggaagaaactgtcagattcttttccaaaaattgcctctcattgttgtgagtactttgtattgtgagtctctttattattgttagccattctaatagatacatagtagtatctcattgtggtggttctattttgcattccctgatgacaagtgatgttgagcatcttttcctatgtttatttgtcatatgtattttttgaattagctgctcaaatcccttgcccatttaaaaatttttgttttttttgaattattaaattgtgatagttctttacatattttggacataggtcttttataatctatacatttgcaattattttctctatctgtggcttgtctttccagtgatttaacagtatcttttgaagaattgatgttgttaatctggaagtacaatttactaattttgtcttttatggttcatgcatttggtattttgtttaagaaatgtttgcctaatccaacatcacaaagattttctcttaagttttcttccaaaactattatagctttactttatttgtacttttaagtctgtaattgattttgagttaaatcctatatatgctgtgaggtataagttgaagtctacttttttccatatggatgttgaaaagactactttttcattaattgactttgtacctttgttgaaaatcagttgattaggtatgtgtgggtctactctagacattctgttttgttctcttgatttatgtgtctgtctttggtactaccacattgtattcattattatggctttatagaaagtcttgaaatcaggttgtgtgagtcctccaactttattccttttcaaaattgttgtggctgttttagttacttttcctttttgtataaattttagaatcaacttgttggtttctataaaatctactgagattttaactgggattataaattttgagtgatttgacatcttcacagtattgtttcagtccatgaataatggtatatctctccatttatttatttttttattggtgtttctactttttagcatacagatcttgtatgtattttgataaatttatacatatttcatgtttttggtagttctgtattttaaattttggtttcccattgttcattgtcagtatatataaatacatttgatttttaaaaaacctttaataaagacttaaattctcagttgtctcaggacattttgtttcttctagaaaactttgtgatactatcattttaaaaaagtgctaaaggtacacaacataaaatttaccattttaaccattttaagtgtgcagttcagtggcattaaaaacaacatttgcattgttgtgcaatgtgcaattgatttttctttttttctttctttctttcttttttttttttttgagacggagttttgctcttattgcccaggctggagtgcaatggcgcgatcacagctcactgcaacctctgcctcccgggttcaagcgattctcctgcctcagccttccataattgatttttatattgactttttaccctgtgatttttctaacttcattaattaattctagtagctttaaaatatactttaatagattcttcaggatttaccttataaacaatcatgtcattagtaaatagagatgagttttatttttctgtatagagaatggttatttatttatttttgttcttttcctgctccttctcctgaggcagagaatggttttatttgtgtggtccttttctttttcttgccttactgcattgcctaggacatctactacaaagttgaatagtaatgggcagagtaggcatccttgcctggttcctgatcctaggaattgcagtgatagctttattctcttccacgatcatggcatatggcttcaaaagtactgtaatccaagaatgtttattatttctgttggtctgctcctttaactctccacctttcgtacccataagatttttgcctggtttgtcctttctgtgccctggaacgaagatagttcctggaaaaactagtcccagagggagagcttttgctcatgacttgggaaggagtgcttttgctcatgacttgggaaggagtgggatttatgatttggacctctagtctctttcagtcccctcagctctcctatatgcgtttcactcctctgccttgagtctgcagtctgctgcataccccatcctccatctgcctcagccttacatacaaacagtaggtctgggctcttcctctcaaaggtcactcagagaggtgcctttcttcataaaatctttgggatttagatttccccgggaaggatggaatgttcattcttgggtctcatcttttccccttgacccaaaacttcttccccacagaaatgtctttaagaatcttctgagctgcttcatctgctaactgccagttctctaacactgaaatgtggtaggtaactggacatatttgaaggacatctttatgtaagtgatatatggagtcaggagatagccaccttcatatattgctctgtgccaagagaaataaaaccgatttctttttccaaaagaaggagacaaaacaggagagggggaagggaagaaaaggagggggaagggaggagaagggaaagggggaaggaaggggaaaggaaggaagaaaaggagggcaaaggggggagggaagggggaaggatcagaactctatctataaaaagatgcaaagttttaaaacttggaaaggaaaaaacaaaactcccaacccaagttgcttcactggcaaattctaccaaatatttaatatcgattatatgtaaatttctccagaaaaaaaagaagagtaatttttcagctcattctatgaggccagcattaatcctatgtgacacacacacagaggtattaaagtaaaactatagatcagtatctcatgtgaatattgtagatgcaaaaaattctcaacaatgtatcacaaaatcaaatctagcaatatataaaaagggtaatacatcatgaccaagtggggtttcttcccaagaatgcaaggctggtttgatgttcaaaaatcaaccaatataattcactatgtcaacagactaaagaaaaacatcatataatcttattacataaccacagaaacatctgacaacatgtaacgtctattcatgataacaacttgcagcaaactagaagtagaagggacctttctcaaggtgataaagggcatctacaaaaaacctatagctaacaatattctttttatctttttgtgtatgttgttattattatagatttcagttttatgctgcaaatccatagtacattgctaccacttttaccttaggtgatcagttatcgtttagaactattaaaaataaaagaaatgcctttttgtcttcatttcagtcatttttgttggtcttttctttttgcaggttcaggtttctgatttttcaggtttttcaggtattttattccttctgtggaaacagcttcctttaacattttttatagtataggtctattggtagtgagttcttttagtttttgttagtctgaaaatctatttccactatatttttgaaaaattttctttgggtataaaatataggtttacagtttttcctgtcaacactttagaaatgtcactgcattatcttatagcttgcatagtttgtgatgagaaatctcctttaattctttattcctctgtatgtaataggtcttttttttttcatttggttgcctttaaaattttctgtttatattttgttttgtatgaagagtctgagtggtttttactttgtgtgtgtatgtgttgggctgcaggggtatgagtaggactgtttattttgcctgaggttctttaagctgctggggtctgtgggttgatatctttaattattttctaaaaaattctcagttattgttttttaaaatatagacatccatcgacttatgataggattatgtcctgataaacccattgcaaattgaaaacatcctaagttgaaaatgcatttagtacacctaacctaccaaatatcatagcttagcctaccttaaacatcctcagaacacttacattagcttacagttgggccaattgatataacaaagcccagtttatagtaaagtgttgaatagctcgtgtaatttattgaatactgaaaacgaataacagaatggccatacgagcacttgaagtatagttactactgaatacttattgctttcataccattgtaaagttgaaaaaatcatgagttgaaccatcctaagtcaaactgtcataagttagtgaccatctgtattttttcttatcaatactttaaaaatgtcactacattatcttatagcttgcatagtttgtgatgagaaatcttctttaattctttgttcctttatatgtaatgtctttttatatattgcaagagccccctgccccacttctgggattccaattatatacatatactaggctgtcatagctcttggactcattgttagattttgagtttagccaaatttaagtgctttttaaaacaaaaaatgtgcacttctcagaagatataacagaatcagcttcctgtaaagcctatcaatcacagtgatcaggatacagtttaaaattactcaatgtatgaaaaaaatagggaaaatgatccatttttttttttccaaaagtcaatcaatggtgacctgttctaaggtaacccagatactggcattagttgacaaggatgttaaagcagctgttataactatgcccagtgacataaaggaaaatatttctgaaatgaccaaatagatgaaaatctcatcagaaatgaaataacatggaaattctagaatgaaaacttcagtgtttaaaacaaagtcatcatgttgactgttgtcattggaagggtgagagtcagtgaacttgtagatagatcaatgtaaattatccagtgtgaagaaagagaattaaatatttattaaaaatgaatggagcttcagaaacttataggacagtattccaacatacatataattggaatcctgtatgaagagagcagatagctgtaaaaaatagttgaagaaataatgactatattttttctatatttggtgatggacctgaatttcaagaagctaagtagatcctaaacatgataaataccaaccaaatgtaggcatatcatggtcaaacagctgaaagccaaatacaaagagaaaagtttgaaagtattcatagagaaatgacacatgttatatgtggaggtactttaatttgactgatgactgaacactcatcagaaaccacagagattactttttcaaaatttctttaaaattatgtgaatgcttaggcaaaaaccatagcattttatattgggttataacatacatagatgtaatacatgcagctgtggaataaaagagggagggaggaaatggaactacaagattgtaaggtttctccattttatatgaagttacaccatattactcttaatagtctgtgaaaagttaaggacataattaatccctgggacaaacattaaagaaaaatattgcagacacgtatagcttaaccaccaataaataaactgtaaatctctctctctctctctctctatttttttttttttggggggggaccgagtctcactcttgtcacccagactggagtgcagtggtgtgatcacggctcactggaacctcaacctcctgggcttaagtgatccttgcacctcagcttcctgagtagctgggaccacaggtgcacgccaccatgcttggctaattattttattttttgtagaggtggggtctctccatgttgcccaggctggtcttgaactcctgggctcaagagatcttcctgccttggcctcccaaagtgctgggattacaaatgaaagccactgtgccctgcctagaaaatatttaaataaaaaaaacagaaaggaaggaatagaggacaacaacaaaaagcaatggaaatggcgaacagaaaaccaaaaataatatcatacacctatatccagtaatatcaataatgccattaagttttagtgaatgaaatattctaagtcaaaggcaaaaatagttaaaacgacataaaagcaagaccaaactattcacagtctaaaaaagacacacttaatagagaggttgaaagtaaatgaatgggaaaaaagatacatagtatatgaacagcaagtgtagaaaggtttaaatgactacatcaatatcagagtatacttcaagatgaaaagtattgtcagagacaagaggagacctttctttttttttttttttttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggattggtgatgactcttaacgagcatgctgccttcaagcatctgtttaacaaagcatatcttgcaccgcccttaatccatttaaccctgagtggacacagcacatgtttcagggagcacagggttgggggtaaggtcacagatcaacaggatcccaaggcagaggaatttttcttagtgcagaacaaaatgaaaagtctctcatgtctacttctttctacacagacacggcaaccatccgatttctcaatcttttccccacctttcccgcctttctattccacaaagccgccattgtcatcctggcccgttctcagtgagctgttgggcacacctcccagacggggtggtggccgggcagaggggctcctcacttcccagtaggggcggccgggcagaggcgcccctcacctcccggacggggcggctggccgggcaggggggctgaccccccccacctccctcccggagggggcggctggccgggcggggggccgacacccccacctccctcccggacggggcggctggccgggcggggggccgacccccccacctccctcccggacggggcggctggccgggcggggggctgacccccccacctccctcccggatggggcggctggccgggcagaggggctcctcacttcccagtaggggcggccgggcagaggcgcccctcacctcctggacggggtggctggccgggcaggggggctgaccccccccacctccctcccggacggggcggctggccgggcggggggctgacccccccacctccctcccggacggggcggctggccgggcggggggccgacacccccacctccctcccggagggggcggctggccgggcggggggccgacccccccacctccctcccagatggggcggctggccgggcagaggggctcctcacttcccagtaggggcggccgggcagaggcgcccctcacctccagacggggcggctggccgggcggagggctgacccccccacctccctcccggacagggcggctggccgggtggggggctgacccccccacctccctcccggacggggcggctggctgggtgggggtgctgacccccccatctccctcccggacggggtagctggccgggctgaggggctcctcacttcccagtaggggtggccgggcagaggcgcccctcacctcccggacggggcggctggccgggcggggggctgacccccccacctccctcccggacggcacggctggccaggcggggggctgaaccccccacctccctcccggatggggcggctggtcgggcggggggctgaccccccccacctccctcccggacggggtggctgccgggcggagacgctcctcacttcccagatggggtggctgccgggcggagaggctcctcacttctcagacggggcagctgccgggcggaggggctcctcacttctcagacggggtggttgccaggcagagggtctcctcacttctcagacggggcggccgggcagagacgctcctcacctcccagacggggtctcggccgggcagaggcgctcctcacatcccagatggggcggcggggcagaggcgctccccacatctcagacgatgggcggccgggcagagacgctcctcacttcctagatgtgatggcggctgggaagaggcgctcctcacttcctagatgggatggcggccgggcggagatgctcctcactttccagactgggcagccaggcagaggggctcctcacatcccagacgatgggcggccaggcagagacactcctcacttcccagacggggtggcggccgggcagaggctgcaatctcggcactttgggaggccaaggcaggcggctgggaggtgtaggttgtagcgagccgagatcacgccactgcactccagcctgggcaccattgagcactgagtgaacgagactccgtctgcaatcccggcacctcgggaggctgaggttggcggatcactcgcggttaggggctggagaccggcccggccaacacagtgaaaccccgtctccaccaaaaccagtcaggcgtggcagcgcgtgcctgcaatcgcaggcattcggcagactgaggcaggagaatcaggcagggaggttgcagtgagccgagatggcagcagtacagtccagcttcggctccgcatgagagggagaccgtggggagagggagggggagggggagggggagggggagggggaggggggaggcctttcataatgaaaaaaaggatccattcattagaaagacataatcacaacattaaaacataagcaaatgtgtaggcatcaaataacagagctttgaaatgtatgaatcacaaatggaagaattaaaaggagattcctttttaattttttattaaaaaggtaattccacaaagattgttggatccttcaacattcttctcttcaactgatagaataagcagacagaaaatcaaagatgatgtagaagtcccgaatgacagtatgagctattttaaatgaattgatatttatttatacagcactttactcaacagctgctgagtacactttcttttcaagtgcacatggtatgtttaccaaaaataaattgtatgctggatcataaaacacattcagtcaatttaaaaagttagaaatagtacagagtatggctaggtgcaatggcttatgcctgtaatcccagcactttgggaggctgaggtgggtggattgcttgagctcaggagtttaagaccagcctcggcaaacatggcaaatcctcatctctacaacaaatacaaaaattagccgagtgtggtagcatgtacctgtagtcccagctactcaggatgctgaggtgagaggattgcttgagcctaggaggttgagtctgcagtgagctgtgatcacactgctgcacttcagctggggcaacagagcaaaaccctgtctctcaaaaacaaaaaacaagcacgatctttgaccatgatggaattaaattagaaatcaataatagacatcaggaaaaacttcaaatatttgaaaattaagcaatatgtttctaaataaatagacatcaagtaagcaattacaaaggaaattgaaaatattacaaagttgattctttgaaagaatcaacagaattgataaacctttttagctaaattgatcaagaaataacagaagacagattaccaatagcaggagtaaatggtattgccaatatgaggctatcattgcagattccacatacattaaatgcataataatggaatattataagcagtttttttgcaaaatttaataatgtagacaaaacaaggaaaatattacaaagtcgattcttttaaagtatccacagaattgataaatctttttagctaaattgatcaagaaataacagaagacagattaccaatagcaggagcaaatggtattgccaatattaggctatcattgcagattccacatacattaaaggcataataatggaatattataagcagtttttttgcaaaatttaataacatagacaaaacaaattttctaaaacaatcttattgaaactgagtcaaggtaaagcaagaagtatgccatttgtagtattaattgaattggtaataaaaagctatttcacaaaattaactccaagttaaatggctttattggtgaattatatcaaataagaaagaaatatcattcttccccagaggaacagggaacattttgcagctctacttcagaggccagcatagcactaacatcatagcctgaaaggcaatatagcaagagaaaactacagaccagtatactttttaaatacattagcaagaatcctgaacaaactattaatacttgtaaagcatagctagcaataatataaaagatatatatattatatataagaatataaaagataaaagatatataaaagatcttttatattctttttatataatataaaagataatatatcaagaaaaatttcttttattgtaggaaagcaaagttaaagatttgaaaaagcagttaatgtaattaatcatattaattaacaataaaggagaaaaatcatataattattgcaataaatttagtaaaagcatttgataagatgcaacacccattcatgattaaaatcactcagtaaactagtacagcgtgataattcccaatccaaaaacctgaaatgctccaaaatcctaaactttttgaacaccaacatggagtgcaagggaaatgctcattgtagtgtttaggatttcagattagagatactaaactggtgtaatgcaaataattcaaaatttaaaaaaatcgaaaattggaaacatttctggttctaagcatttcacataagagctactcaacctgtactaaaaggtaattattatttttcattctgataagggacacctacgaaaactctacagcaaactatatgttaattataaaatattaaaatgtttttacccaaggatctggaataaaggaaggtgttccattttcactatttacatttagcattgtaatgaaaatcttagcattgcaagaaagcaagaaaaataccttgttcatattcacttatatagtttttttgctagattccttttgatttctgagatacacagtcatattgtctgcaaataatgacagttgtacttctcctttttttctaaattctgtgtagccaggaatgccatcgcaatactgattcattgtagtcattactgcacacactttgcagtttgcactgatggtcccactgatactgaatactgtccttaaaaatttttggaaatgagatgaacttgccactacctattagctgaattgctaaatggattccccaccatctcctgtctctaacttccccttacctaacctaatttgcatactacctgagtaacaagaaaggccgtgttgcttactaccttagttgcagaggaggcttggaaatgtgattatatggcatttgcagcagctttaaggtaatagatggaatggagtttcttgtttgtcagacagatagaatgacagtttccatagaaagtagagggagtactttctaaagaggtcaaaagctgtaaaagagattatctgagggatctatttactatttcctaagattctccagacttgacacttatattaaaccacagtattgtgaaactatttatttagaccacattgttttatctccctgtgtttatagagctatatcacgattttctgtctgtaatagtctctcacccttccacattctttgcctggtagagactttcaagaccttactgaggttaatttatatgcaataaaatgtacctatgttgtatgtataatatgtaattaaatgtatactttgcattttaacaaatgtgtgataaattgttagaatataaattgatactgtcttttcagaaaataattcggctgtgtgaagtaaatatttaaaatttaaaatactctgacccagcgacccacttctaggaatctattatctaaaagtaacagagtagatacacaagggtatactcaaaaggatgtttaattgcagtaccgtttgtagtagaaaatatttgaaaaagacctgaatattcatccataggagagtgactgaataaattgatatatctgttaccataggataaaattaaactataaacctaaatttgtatattttaacgaggaaaaatgtgcttgatgtattcagtgactaaagcaagttatagaccagtagttggttacagctgtgtgtgtgtgtgtgtgtgtgtgtgtgtgtgtgtgtgtgtgtgtgtgtatccattcagtcagctagtcatcacagtattttgccaagaaataatggcaccttggactaagatggtgttgtagagatgagagatataaatgatttcagggtattttggagataaatttaaaaggattgggtgatacgtggaggggggtataaaacagaaggaattgattttgtctctcaggtttctgtttttggtgctagattgatggtacgatagttattaaatatcaaatgcttaaagaatactagattagagggggaagatcatgagttaattttaggtattttgagtttgaggatttttttatatttaagcgaaaataagtagtagagagatgtaatgggtctggtgttcaatggagaagtattgactggagatataagtttgggagtcagttgctgggtagctgataattgaaatcaagcacattgtgaaattgtccagagagacaatttaggataggaagagaaaggggcctagaattaagccccaagaaatacaacatcaaaggccagatagatgaggataaaccaaaggaagcagggagattataggattattgaacacagaggaagcatgtattttaaggaagaactcgtgaataataacaaaatgcttttgctcacatgtgtggtcaatccttaataagatctgtttcagtgaaatgatggcagcagaagccatgttggaataggttgaggagtgaatagaaaggagaggatatggatatagtaaattagacaattttgtaaaactggaaaagttacttgtgttattatgtcagtagcagccaaacatggaataaaaatccagctacttaattgtatgttatgtatagaaaaaaaggatggaaatacataaaaacattaatgtatttggttcaagatagaggaactgtttatgatttaaacttttttattttttctatttttgaaactaagcaaatattttgtaatagataataaaatatggattattggccttgcgcggtggctcatgcctgtaatcccagcactttgggaggccgaggcgggcggatcacctgaggctgggagtttgagaccagcctggccagcatggtgaaaccctctctctactaaaaatataaaaattagctaggcgtggtggcagatgcctgtaatcctggctactcgggaagctgaggcaggagaatcacttgaacctgggaggtggaggttgcagtgagcctagatcacgctgttgcactccagcctgggcaacagagtgagactccgtttcaaaaaaaaatgtatatggattatttatttttcagaagtctagtcaagagacagaatccatctagttacttgaacagagaaaatttaatataaagattaattaggtataaagttgttaactaggtaaatgctagattaaaaagaatactctgtaggaatcatagaggtggctcctacaggaagcaaacagggttgacataatatggggaagaggttttaattagtaaaacttagaaaccttaagaggaaggggtatccgaagctgaaactcagacccctgaagagagtgggctagcaggttattgctggtgctgatgtctttggggtgggtgataatgactgatgtctttgagggtgataaaactggttctacaagtattggaaaaacttccaaatggatccagctgctgctataggaagggactccccttgctgatgtgaaggcttagaaaagcaatccagcactggggcctgagcatatccctgcacatttgtgctagaagtaccaggaatgcaagtccctgactgctctttatccatataatcacaattgtgcttgtagggatgaggtaatgtccaccctggataaacaggcttactttcgcttactatagaagagataccacaagctgagtgttctcctataatgtaacccactgtgtgtacaggcattcatcatgggccctgtgcatcatcccagtgtgattggggtggaggtggggcatgtatagtccaatgcaaatgaacttgaagctttggctgctacttttctataaataataaagccttttatctctgacccagtagtcttgtgtcttctgccaacatttataaaactgtgaaaggctgacttattagcttgcaaatataataaaatcttagatttcattatgagttttaaaattattatttgcaggttcattttaagagggaagtgtgtgtgaatgtgtttctgtctctttgtgttaaccctcagttttgcagtgaccttcacttggttctgaggaacagccatctagcctttaagggtactcgtgctctctcagtgatactgaaaaatttatccagaatgaagtatagagagtcaaagagggaaaataagcaaaagagttgagagatgaaaatagattgagaggtttcagagaatatttggaagaagtctcagatgagtttaatggaacaaataatatgtgaaaagataagaacaaagaggaaatattaaaagctaccaaagagaaagggctgattacttaaaaaagaatgacagctgacagtggagttctcagtagtaattgaagtcagaagattttagagtagtatctttaaactgctgagataaaatagctaccaacccagaatttgaatctgtcattcaagagggaaggtacaagataaaagacaaagaggtatacacatcaattaataaaatatttttgaggaatttaaatattaactataaaaattaagattagataatgcaaggtgtaggagtgtgtgtgcgtgtgtgtgtgtggtcaagaacatggactctagagctggattgtctaggtttaaattcagactaactgcttaactacctgtatgaccttgtgaaatacattacttattcattttatatcagtttttctactctgtaaaatgggggcaaaattaatacttatctcactggcttgttgtgaggattaaatgagttaatatgtttgtcatcatcatcaccatcattatcccaacatttttgtagaacatattaaaaagtccttaaagcccttgtatattaatatcacatattagggggctagagttggtatggaaatgggaggagaaaatttgtttattttaaatctccaccttttgtcttaatttattcaacacttgttgagcatctgctatatgctaggcactcttctaagcattgaaaacaaatttaaaacaaattgttgtacccctatggcttatggtttactgtggggtaataggcaataaataaataagatagatatgtgagagagcatgtatgtatacacatatacagtcatgtaccacataactgtgtttcagtcaacaatggatatgttggtggttgcatgaaattataatggagctgcaaaattcttatttcctagtgatgttttaatgatcctgaccctgtgtaggcctaggccaatgtttgtgtttgtgtcttagtttttaacaaaaaagtttaaaaagtaaaaaaaaaattttaatagaaagtagcttataggatcaggatataaggaaagaaaatctttttgtacagctgtaaaatatatttgtgtttttaagctaaatgttattataaaagagtcaaagagttaaaaagaaaaaccctaaaacgtttatatggtaaggttacagtaagccaaagttaattaattattttgaaggataattgtaaaaaataaattagtgtagcctaagtgtacagtgtttaaatctacagtaatgttcagtaatgtcctaggccttcacattcactcaccactcatcctctgactcgccagagaattttcagtactgcaggtttcgttcatggtcagtgccctgtacagatataccatttttaatcttgtattctgtatttttactgtactttttctatgtttaggtaaacaaatacttaccattgtgttaaaattacctacaacgttcgatacagtaacatgctatataggtttgtagtataggagtcataggctgtaccatataacctagatgtgtggtaggccttaccatctaggtttgtgtaagtataccctatgatgtttgcacaatgacaaaattgcctaatgatgcatttcttagcactatctctgtcattatacatgatggaacatacactgttagcagtaagcaccaaggagaaaaataaagtgggatggggcataaaggagtttaaatttcaaataggatggttagggagtccatgaaaaggtaacatttgtgtgaagacctgaaggagattagtgggtgaggatattttttgtaagaacatttaataggcatagcaaataaaaagacagtgaaacgaaaacatacctggcatccttagagaacaacaaaagaggcgagtggagctaatgtagagtgactgagggacagagtgaatgaaggagagtgcatgaaggagggggtgaagccatagaaggtaatggggatacatctttgatataggtatatacccttattaaggactgtggcttttgctctgagatagggagccatttgagggttctaaactgttgacttctatttaacactcccacattgactgctagattgagaataggctgcaaaaatattatcttagtaacttaagtactctaatagagaaaacaggcataagaagcatatatagatcctaatgtcacttccctcctcaagaaactacagtggttctatgttacctattgtgttgtcttacttttttttttttggagacagagtcttgctctgttgcccaggctggagtgcagtggcgtgatctcggttcactgcaacctccgcctcccgggttcaaatgattctccggcctcagcctcctgagtagctgggactataggcgcgcaccaccacacctggctaattttttgtgtttttagtagagatggggtttcaccatgttggccaggccagcctcaaacctctggcctcaagtgatccacccacctttgcctcccaaagtgctgggatgataggggtgagccaccacgcccagcctaactttcgttacttatactttaaagctctttgtgttaacaagatatcatgaaaaagccactcataaattgctggtagaagtataaattagtaaagcatatatggagggcaaattggtagtaacttaccaaaatttcaaatgcttatactgattgagacaacaaattcacttctggaatttatcttagatagccatatactgtagaaacaaattaaatgtccattaatagaggactgagtaaataaattacagtgtatccataaaagaggaaattctgcagccaccaaagagaatgagctggtagtcctttgtaggctgctttggaaagctccccaaggtacaaaacaatatgttaaagtaacaagttcagaatgtgtgatattctgtgttagagagagacaaagactctgagtgtgtgtaaattgcaacagaatttctgtttttgtgaggtttgggaatgaggattttatgtgacatgaccaggaaccatgtataccatgggactgatttggcacaaaatacaaagaagctaacaggtggttgcattgtaaaaggaattgtgtggctgagggacagaactgaaaaagagacttaattttttacttttgatactttttggattttgtattatttgcctgcattgcatactgaaaactaatttgcagttgcctaccaaaatatttttctgaaaatagggaagataagtctaaaatatattgttaaagagtttatatatttataaattaagatttatatactatgtaagggattttttctcaatgacattagggtgttgttttcttttagacctgtctactataactgtttatatgttaattgctattaatgatacaatatttttagttgaaaattagacaatatattattggtttattctggaagtgaattgagcatgctttctatttagaaaaagttcataggtcattttatcagttttaattttatatgtagaaaagatatgatacaaaatgtgtgattaacaaagatatagtattaatattagtttctagataagaaagttgatttctttgtctttatggtaaacagaagcaatactgtttgctctataaggtaacttgtgtttactaacatgtaaatgttaataaagagagaactgattttacatttgcttttcctaattaatgagatgaatatgagaacattattacaactttgactttaaattataatgtttttctttggggttttgatgttaaagtagatattgaaggaaatggtaaattgtagatgtgtgaatatatctaattaaaagttctgctaagaagcttgtgccttgttgagggaactttggaacatcttaatgagggacagagtgaatgaaggagagtgcatgaaggagagagtaatggggatgcattacctctatgatatttccttatctacttgtacatatttctctctaatattttctatccccagtaatgttggtatgctttgttataatataatctcaactcaaaattttgattcattccagatcttcaactacttattatattattagaagaatctaataatatttttatcaaaagtatttggctgcagtaaaaagatggaattttaaataactactcaatttggagaccatttgagaggggatagacttgatgcatataagagaatgtgctacttttcctaatagaacattatgacccagtcacagtttggaatctgtaagtcagtggtctctaaagttacgtacacacacttacctattgggatatactaagaaaatagtagaaatttttctatatacatcttgataatactacatgctaagaaaatagtagaaattttactatctatatgattttaaaagtttggaaaccactgatatttaggcaattatttttggataccaaaaaagcagcaattggaactgacaaatgaagcatttataactctcaaagtaaacttagtatgtgaactcaaatgttttctttccttttctatcatatgattaaaccttgatggaaaattttgagacataacatattcagagtaatttaagggcatttatgcaaattgagttacctctttcttttgtttatattttgaactaaacctgtttaccttggatgaaaagtccatagcctaatgtttcttcttaaattttttgccagatgaaaatagactatcaacaccaaaactatgtccttccttttcaattaattgttgttttaggccttttgcatggttagctttccttagtatccagtttgcaaacatgctctctgattgccaaatgctgcctggtaccaatgagatgctttttcctaccctgtgctcccgtgtacccagtaccttgtgctatgtatactatgagagagagagcaataagtaaatgcttactaatggctataatttatgaatattcatgttttaaatctcagatattcaagattaaagcagtgcaattggctgagaaactccttcctgcctttaacacacctactgggattccttgggcaatggtgaatttgaaaaggtaactctatgtgggtattcttattctggaagaattattttgacctttttagtcttagaaatttctaatgagtcacccccacattttttttaaagacatattgtttttctctctatatataatctttgttttcttttgtgtatatgcataaatgtgtttctttaaaacattttctgatttttaaaataagtcctttgaaacaggttaattgtcttaacttgattgcagtttttactactcgtttctgtaagtctagatttctcttcctcacctgtatggtatacaatatttgtttcttttatttgcttattcatttccatttagtgctagaatagagtcaaagtacatcctccctctttttctttttatataccacctcctgatcttctaagtgaaaatagaaaataatatacctagaaatgagggcttcctattgctgaatgtcatattaaagataaagaaagacgtaatttatgatgttgactgcggggtttttattatagcatctacactagtgaagttcaaagtgaactcttaagcatcaatctttataatctgttttctaatcgaaaacattggttttttacttagaaatagatgaaatgttttctttggacaactttataaattatgtagagatatacaattaacatttgaataatgtcaacatatttgaacttgcatttaagtaatttatgctgactgaaatttgttgtgctcattttttctcctagtaaaatttattcatcataatgttggaatttggaaattacctaaaaatttgattgttgttctctttgcactcagaccctttagaataaaagttaggaacatttatttttctggagatgtgaatctatgacattatttttagaaacgactcgactttagtaaaatttttctaattgaagaactttattgagtttagatttacattgagatgtcagcagcatttaatactgaacattaaatctaactttactatctctgatttcatgcactatgtatagtgcagattacctctttggtgaggaaaaagctggctgaagttccagagcaagctccatggaaggatatggccaagtgatgttgtgtatacgcttgttctcgttccttagttttgtgacagattttgtgatatttccttcaggatcatcgtcagaatcagacattattatctacttagataataattaaaacttaattccgataggaagacagactggaggctctttttttgtctacatagaggaaaagaacttgaaaatcaagattaaattgcagaacttctaatttaagattgagattaaagtaaaaaggtttccaaggaccatgttgtgagctttttataagattaattttaatttaatttctttggtatgtaaacaaatacataattttacttgagtttttatatcatgaatgtaattatttacctatttaaaactttttaagtaaattttttgcagagaagggatcttattttgttgcctaggcggatctcgaattcctaggctcaagtgatcctcctacctcagtgctgcgattataggtgtgagccactgcacctagcattatttacctgtttttgaaaatttttttttttttggctggggtctacgcatttcccacacataggccttcccttagtcttgatgactgaaagccaacccatcttaataatctatcatatttatcttctacaatatgatacagcagacagaaacaaaagcagagctttttttgtaatgtttatttggtttatcactttaatggcttgcttttctgcttcttatctttctcactcaataatactccatggaaatacgattccaggttactcaataaagatctaaataaatctttgtgatgaataccaagtgagaaatgggatagttatactataatttattcattaattttcatatcagtggtatttgtttccattattttcctaccacaaacattgctacaatagcatcctgttatacatgttcttgtgtagtaggaattttatttcttggaaaatggttctcaagaatacaattgctggattaaaaagcatctgctttttttttttttttaatctgtgggacagatttctagatgtagcgttcctggatcaaagggatatgtatttttaaatttaatagatattgccaaaatgtgttccagaaaggctgtagtacatttccaccaacaatatgtgagagtctctaaatgtctgcaggtataaattctttttaatttttgacacgatggttgctataaaatcttcattgtattttctgactagtgaattttgaacatccttttcataaatttattgggcatgtagatttgctttttggtgaattgtctattcctaagtcttgcttgagttctttgtctttttctaattaatttataaagtgttttgtagattatataattaattctcctctctctactcttctgttggtctgttgtctttataataatatatgactcataagttttaagcttatatatacaaatatatgttttataacttttagtttacagtcttggttaaaaaattgtctccatctatattttttacattcttcgagatttccataaaagctttgaaatactgcttttctaaaagaattgaagtatggcattagttgtggagttttcatcagttatatcaatttcctttatcacattgaggaaatttccttctattcctatttcactgagatgttcttgttgttgttttatcatgaatggatgttaaatgttgccagatactttttttccatctatggagataatcataaggtttttcacctttattcttttaatatggtaaattacttgtaagattttcaaatgttaaatcaaccttgaattccttagatattccttggccataatgtatcctttttatattttgctgtattttatttcctaataccctttgaaattatatgatggatattggtaggaattttatttttggaatgcctttgtcagattttggtgtgagttacctggtcttattaaatgagatattattaaattattaaaatttttgtttgcagaaataattcgtggagtgctgtagttacttctttcttaactgtttgatagatagacctaaatgcaactacctgagccagaaattttctttgttggaaagtttttaataacaaattaaaatttgtgtgtgtgtgtttggagggggctggtttagagacaaggtcttgcgcttttgtatcgactggagtacaatggcacaatcacagctcactgcagccttgacctgccgggcttaagtgatccccccatctcagcctctctagtagctgagactacaggtgtgtgacaccacacctaggtaattttgtttatttttgtagaggtgggctctcactgtcttgcctagtctggtcccaaactcccgagctcaagtgatcctccctccttggcctcccaaggtgctaggattacaggtgtgagccactgcaccctgcccaaattttcatatttgtgtgtgtgtgtgtgtgtatgtgtgtgtgtgtctgtgtgtgtgtatatatatatatatgtatatatgtaaatttatatgtatacatataaaagaaaatttatatataaatttatatatatttatatatgatatataaacatatatcttatattcagattttgttttattttgtgtcagttttagttaattttaaagaaatttcttcatttcacttaaattagaaaatttggtgtaaagtcgttcttgtgttactttgttttacctttcatctttgtagattctatagcaacaaccactttcattcctgattctagtaatttgtattctttcttttctctttactagtttaatgaggcatttgtcaattttgttaatcttttcaaaaaagtacttctgtttttgttaatttttacttttttttggttttattgatttctggtttatttttattatttccttctcttttcttattggagctactttgctctttttctggctccttacattggaactgtaggttgtatctttctacactgatcttatatctttctctcttttccccccataaactactgtttttctatagagctataaatttccctccaaggactgctgtagctgcattccagaaattttgattttttttgttattattcagttcaaaataatttctcatttcctgtagaattttttcttcaatgcattagttttttataattgtgtggttcaattgccaaattttaggacgtttcttagatatcttattgttttgatttctaatttaatttcattgtgatcataaaaattacaatttgaatcctttcaaatttattacaacttgtttatagctccgcatatggtctttcttggtaaatacacttgataaggaagtgtattctgcagttgttgggtataacattctgtatatatcagttaggttaaggtggttaatggtgtttagatcatgtatatctttccagatttttttttggtataattgttttatgcattcctgaaacgaagtgtcaaaatatcccaagtatgattgtggaattgtctcttctctatttctgtcaattttttgcttcatgcattttgacgaagctttactcttaagtacttacacgtttattatatgctttctgattacttgagccttttgttattccactgtgtcttcatctctggtaatgtttttgtcttgaagtttatcagatattaatgtagctgctctactttatgcttactgttttcatggtttatctctttttttccatttattttcagcttcactgtattgttttaactatagttctgcttttggagacagcatatagtttggatcataatacaaattttgttattcagtctgacaatattgacattttacatcatttagcaatagatctaaaaaattattctgtatcaacactttatatataatctcattatttttaagagcttcataatataatgcttatgaaaatgttgtgacttaaaattaattctgtattagtgaactattagattatttctagattttaatattatcaaaaaatattggaagaagtatcctgcatatgttgggaatggtgtgtgtgtgtatgtgtacatagacatgtgttggtatgactttagtagaaatagtggatcaaagaattaaatacattttttctgttgataggtactgtcttctagagaggatatgccagttgacatttccttaataagtgtgtgagaatggctcttatcgaaccttttgaaaatatggtttacttttatttatcagatagataaatataaaatcttgttccaatgtttattaatttttgagtgagattgaatttattttattcagtagatagcctttttatgtcctttgtttgttttttattggctattttttaaaaaatcagtccttaaggtatttttgtgtattagctagattagtactttgtcatataaattgcacatttttttgctattagtagtatagtttgaagttgggtaatgtgatgcctccagctttgttctttttgcttaggaatgtcctggctatccgagctcttttttgattccatatgaattttaaaatagttttttctaattctgtgaagaatgtcagtgatttaatggaaatagcattgaatctataaattgttttgggcagtatggtcattttcgtgatattgattctttctatccatgagcatggaatgttctcccatctgcttgtatcctctctgagttcctggagcagtggtttgtagttctccttgaagaggcccttcacttcccttgttagctctattcctgaatattttattctccttgcggcaattctgaacgggagcttattaatgatttggctctctgcttgtctgaatatgtttaaaagaaaactgaacatgttttaaagaaagaaaataaaattcagatatccaacaatatacttttataatatccgtaatccaatccaaaattactttactttatggcatgcaaagaagcagcagaaaaatgtagctcattattctgtagcccagagaaaaatctgttcatagaaacagacatggaaataacagaggtgatggagatagcagtaaaggactttacatagctattgtaagtgtgcttgaggatttaaaggcaaatgtgaagaatgagaaaagagattttaaaaaggaccaaagtggaacttctaaaggtgagaaatatatgaaataaaaaatttacttgacaagcttgaaggcagatttgacactgcatcagaaaagatcagtgagcttgaagacaaaacaatagaaaccacctaaactgaagcacagaaagagaaataaaaaagctggagtatggagagaagcatatccagtgacctatggggcagtgtcagatggtttaacatacctgtaatggagtgatgggagtggcgaatttgggagtgggaggagtggcagaaaaactacaagcatgaattgttttattgtgcttcacttaattgttctttgcagatattctttttttcctttttcttttttttaaacaaattgatgatttgtgtcaactctgtgttgagcaagtctatcggggctatttttccaacagcatatatcacattttgataattgtcacaatattttaaaacttttcattattattacatctgttatagtaatatgtgatcggtgatctttcttattactctagggcaccatgagcaagcagtcatagatgatggcaaacttaatcactaaatgttgtctctgttctgacggctccacagattggccattctcccttctctctccttctccttgggcttccctactccctgagacagaacaatgccaataaataacctttcagtggccttgatgtattcaagagacaagaagaatagcatgtctctcactttaaattaaaagttagaaataggctgggcgtggtggctcacacctgtaatcccagcattttgggaggctgaggcatgcagattgcttgagcctaggagttcgagaccagcctgggcaacatagtgagaccctgcctctacaaaaaatacaaaaattagctgagcatggtggtgtgtgcctgtagtaccagttacttgggaagccaaggtgggaggattgcttgagcccaggaagcagagcttgcagtgagctgagatcctgccactgcactccagcctgggtgacagagccagaccctgtctcaaaaaaaaaaaaaaaagctagaaataattaagcttagtgagaaagtcatgtcaaaagctgagataggccaaaagctaggcctcttgtgccaaacagtccgccaagttgtgaatgcaaaggaagagttcttgaaggaaattaacaatgctatgccagtgaaacacaagaatgatgagaaagtgaaatagccgtattgccaacatggagaaagtttgagtggtctgtgtagaaggtgaacccagctacaacattctcttaagccaaagcctaatgcagaggaaggccctaactctcttcacgtctgtgaatgctaagagaggtgaggaagctgcaggagaaaagtttgaggcttgcagaggttggttcacaaggtttaaggaaggaatctgcctccaaaacttaaaggtgatgggtgaagcagcaagtaccagtagagtgggacatcgctgaaaagatgcctgaaaatgtggaacaactttggaactgggtgacaggcagaggttggagaagaagaagacaggaaaatgtgggaaagtttggaacttccttgagacttgttgaatggctttacctaaaatgctgatagcgatatagacaataaagaccaggctgaagtggtctcagatggaaacgaggaacttcttgggaaatgaagcaaaggtgactcttgttatgttttagcaaagagactggtggcattttgctcctgccctagagatgtgtggagccttgaacttgagagagatgatctagggtatctggtggaagaaatttctaagcagcaaagcattcaagaggtgacttgggtgctgttaaaggcattcagttttataagggaagcagagcatagaagttcagaaaatttgcagcctgacaatgtgacagaaaagaaaagcccgttttctgaggagaaattcaagcctgctgcagaaatttgcataagtaacagggagctgaatgttaacccccaagacaatggggcaaatgtctccagggcatgtcagaggtcttcatggcagcccctcccatcacaggcccaaggcctaggaggaaaaagtggtttcgtgggccaggcccagggtccccttgtgtgcagcctagggacttggtgccctgtatcccagcctctctagctgtggctgaaaggggccaacctaaagctcagactatggcttcagagggtgcaagcctcaagcttccatgtggtgttgagcctgccagtgcacagaagtcaagaattggggtttgggaacctctgcctagatttcacaggatgtatggaaatacctgcctgtccaggtagaagtttgctgcagggacacgactctctctcatggagaacctctgctaggggagggccgaagggaaatgtggggttggagccccaacacagagtacctgctggggcaccacctagtggagctgtgagaagagggcaactgtcctccagaccccaaaatggtagatccaccaacagcttgcatcatgcacctggaaaagctgtactcaatgccagccagttcaggcacccaggaggttgggctataccctgcaaagccataggggcagagctgcccaaggctgtgggagtcctcctcttgcatcagtgtgacctggatgtgagacatggagtcaaaggagatcattttggagatttaagacttgactgacccaatggatttcagacttgcatggggcctgtagccctttgttttggccaatttatcccatttggaatggctgtatttacctaatgcctgtacacccattgtatctataaagtaactaacttgattttgactttacaggcatgtaggcggaggggacttgccttgtttcagatgagactttggaccatggacttttgagttaatgctgaaataagactttgggggactgttgggaaggcatgattggttttgaaatgtgaggacatgagatttgggaggggccaggggccgaatgatgtggtttggctgtgtccccacccaaatctcatcttcaattcccatgtgttgtgggagggactcagcgggaggtaattgaatcatgctattcttgtgatagtgaataagtctcacgagatctgatggttttaaaaaggggagttttgttacacaagctcttttctcttgtctgccaccatgtgagatgtgcctttcaccttccaccatgattgtgaggcctccccagccacgtggaactgtaaggccattaaacttctttcttttgtgaattgcccagtctcaggtatgtctttatcagcagtgtgaaaatggactaatgcagcatgatggtgcatgcctgtagccccagctacttgggaagctaaggtaggaggactgtgtgagtccaggaggcggagcttgcagcgagctgaaattgtgccactgcactccagcctgggggacagagccagaccctgtctcaaaaaacaaaacaaaacaaaaaaacagaaaaaaacccagccaggcacagtggctcacacctgtaatcccagcactttgggaggccgaggaaggtggatcagctgaggtcaggagttcgagaccagcctagccaatgtgatgaaaccccatctttactaaaaatacagaaactcgctgggcatggtggtgcatgcctgtaatcccagctacttgggaggttgaggcaagagaatcacttgaacctgggaggcggaggttgcagtgagctaagattgcgccactgcacgccagcctgggtgacaagagcaagactctgtctcaaaaaaaaaaaaaagttggaaataattaagcttagtgaggaaggcatgtgaagtaattaagcttagtgaggaaggcatgccaaaaactaggcctcttgtgccaaacagttagagtagttgtgaatgcaaaggaagagttcttgaaggaaattaacagtgctatgccagtgaacacatgaatgatgagaaagtgaaatagttatattgccaacatggagaaagtttgagtggtctgtatagaagatgaaaccagctacaacattctcttaagccaaagcctaatgcagagcaaggccctaactctcttcacgtctgtgaatgctaagagaggtgaggaagctgcagaagagtttgaggcttacagaggttggttataaagtttaaagaaggaagctgtctccaaaacataaaggtgacaggtgaagcagtaagtgctgatgtagaaattgcagcaagtgatccagaagatctagctaaggtaattgttgaaggtggctacactaaacaacagattttcagtgtagatgaaacaggtttctactggaagaagatgccatctcatagctaaagagaagtcaatgcttggctttcaaggacaggctgactcttgttgggggctgatagagctgatgattttaagttgaagctagttctcatttactgttctgaaaatcctaggacctttaagaattttgctatgtctactccctgtgtggtctgtaagtggaacaacaaagttcagatgagagcacatctgttgatggcagagtttaagcccactgttgaaacctactgctaagcaaaaatctctttcaaaatattactgctcattgacagcgtacctggtcacccattttctacagtgaagatgcccaagattaatgttgttttcatgcctgccaacatccattctgcagcccatgggtcaaggagtgattaagactctcaagtcttattatttaaagaatgaattttgtaaggctatagctgccatatatagtgattcctctgacagatctcagcaaagtaaatggaaaatcttctggaaaggagtcactattctagatgccattaagaacatttgtgattcatgagaggaggtcaaagtatcaaacaggagtttggaagaatttgattccagtcctcatgggtgattttgaagggttcaaactcaagtggaggaagtaactgtagctgtggtggaaatagcaagagaaccagaattagaagtggggcctgaagatgggaccaaattactgcagtcttatgataagacttgaatggatgaggagttgcttcttacagatgagcagagaaagtggtttcttgagatggaatctattcctggtgaagatgctatgaacattgtcaaaatgacaataaggatttagaatactacgtaaacttagttgatgcagccagtgtcaggatatgagagtggcctccaagttggaaagaatttttactgtggacaaaatgctgtcaaacagcatcacatgctacagagagatctttcgtcttgcagagaaatcaaacaggaagaatcaatcaatacagcagactttattgttgtctcattttaagaaattgccccagccaccccagccttcagcagccaccaccctgatcagtcagcaaccatcgtcatcaaggcaagaccctccaccatcaaaaaagagtatgacttgctgaaagtctcagatgatcatttgcatttttagcaataaagtatttttcaaattaagatatgaacattatttccacataatgctgttgcacatttaaaaggctacagtataatgtaaatataacttttatatatactgagatacgaaaaagtttgtgtgactcattttgttgcaatatttgctttatggaggtagtctgtaaccaggcccataatatctctgagatatgcctgtttttaaagaagtaatgtctagaaatttttcagatttgttaaacagctgtaaattcacagattccaacatttgatggaacccagcaggataaatataaagaaacatgacgtctgaaaatctgtgactagaaaaagaaaagttaaacagccagagaagaaaggcatttacattggggaaccaaaatagaaatacttccttcttatcataagcaatacaatccagaaaacaatcgaatccatcttgaaagtgttgaaagaaaaaagtcgatctcaaattctatagccactgaaaatattctttaaaaacaaaggtgaaattaagacattttcaggcaaacaaaagcttagagaatttattgccagcatacctgtattgttagaaattttaaggaactttctaatgacaacagatggaaaaacagatttacacaaagaagggaagggcactggaagcagtaaatatttgaataaatataaaaggcttattttttctgttttggtctttgtttaaagcaaaaataataactcgcatagtggggcctatagtatacataggagaaaaatttgttaccacagtagcacagaggatagtatggagacgtgaagcccttacattatatgtgaagtggtataatatataaaggtctactgtgggaaggttaatggtttatgttgtaatgcctagagcagtcataaaaaaataagccggtaaagaaaatggaatactaaaaactactgaatccaaatgaaggcaggaatagagaaggaaacaactaatgggaaaaatagacaatgaaaaggcaagatagtaaacttaggttggtaggatgtaaaatggtagagacactttggaaaacagtttgactgtttttcaaatgtttatcacatcaataggatataggtaaatagttgtcatattcatccaatggaataccatttagccataaaaagaatctaactgctgagacacacagcaatatgggtgaatctcaaagacatgttgagtgaaagagccaaacacaggagcatatactgtatgatgtttgtatgaaattctagaacatgcaagactaatcagtagtgagaggaagcaaattgagaattgtttgagacttggtggaggaagtgtgtgtgttgattgcaaaagggataaggacatgttttggaaggattgacttggtttgtataccagtctttgttttcatttgtcataacccattgaatggtgtacctgaaaggatgcatttttgtatgtaaattatacgtcagtatatacttaaaaagaaaaataaaccagatcctacacttggctgaggggctgtgtaataacaaaaaataacattaccttataattgaaggacaatcttaactttgaaaacatatttagaaaaaagtttgtaaaaatacagaattaaaattagaagagaccagtgagtatttaaaatgtaatagacaactcaaattatgcttatgcagttttccagaaggatagatgagaatgtgttaacagattgctttggtactgagagtgattggaagaggtagagggcttagagagatacttttttttttttactttatgctttttcagtgccatttaaattttaaatcatgagtatattacatatcctctcaaattaaatgaaaatgtaacaaaaatcagacttcattttaaaataaaaattaaagctgttatattcatctgctgtcaaacaaggaagtttttacttaaaaaatttttaaagcatctgctataataaaaaggtgagaagaaagccattcttacatttcagctttacttgtagactagtgtattatctgtcaaaagcccttaaagcttgtttcttttgacccagcaattcaacctttgttaatgtgcccgaagaaattggatgtatggactaaggaagacatctacaaaattatgtttatcacggcgtatttcacaaaatcataagtacaggttgaacgttcaagagtaaggtcatttgttaagcaaatttggtagtccataaggtaaaacaatatgttgccacataaatgatatcatagataaaatatttacagtatattaaaaatgttttataagccagattatggcatcatataatgagaatgaccatatagtgtgttgttcataagagtacaatttaagaatgaatgggggagctgaaataattaaaactatttaattttctgagtatttaatcactgacaaattggttttattttattgggtatcctgtaaaataattctgctataaacctattttctaaaatgaaattattaaaaacatacattcttgtgtatttatctaaatttgaaattattggcactttcaattgactcttgtatgcttttattagagaaggtattctccctacagttgctcagagcaaattctgcttaattttaggatattctcaattctaaatttttgcatattaaaatgtttaaatatttcagaccagatatttttacaaatcccattcttttgctttcattcagaataccttccacaaatctgagatatttttacattgacttttatttgtaattattttaaataatcatccagtttagatgatacagaatcatagggcttctcaatttcattccattgaagtatacaatataaataaatctaattgaaaataggagctccatcaaaccattattcctacaaatgaagatacttcaacttaagcttacacattgagtgttttaatttcttcagttcattctttgcttttgtcggaatgcatttcaatatcagtgtgtttgcaagctttgtttctaataattgcagtttactgaaagctttactccattctttcaatacattgattaaatatattcgactgactttgaacaaaatgcaaaccaaaatatagaagactcattatcaaaacaatttaatatgattgtagaccacttagggtgatttactgtcaagagtttaccaaacatttttagaatctttccttttgctggtggtcaggtaagagaaacatacgttttgcttgcttgtttttgttttttggtattcattgcaaattttttgttactcaggttctctgagtatatacgtaaattttagtatccagaccttttattttgatcagttgagaaaaaaacataacatttgcatgaaatgatgatccggttattttttggcagctcatcatcattttatagttggaaattttgtcctcggcagcattatatcttgttcttagggattttcttatttttctgagttgctaggatatatgtaagtatcaaatttaatattttagattcttcctgtgacactatgtaaaaaatttaaaaaccttatttagaatttagtattttgaaaagtgttactttttgacttttggcgagatgttctttttatagagaatggcaaactgttggacttcctaagttttgtttttatacttgaccacactataattcatccgctatgctgaaacctagttaatctttctaaatggtatgctttattccttaagtattatgttataatccttaaagttattcatgactttccatcacacttaaagactaaaattttaccatggcctacaaaattatttcatagtccagattataccttgctttctaacctcatcctgtgtcattcacttccccttactttctgaactctagccaaactagcctccttcctttccctcaaggccattacatctgctgtttcccttactgggaattctgttcttccagatattttcattagtggctcctcatcattcaggtctcagttcaaatcatatcattttagaaacattttctctgaacataatatgtaaaaagccttttttgtaactcactttctatctctagtactcaacattctatttttcctttttaattttcttcacagcaactatcactatttaaaatgatcttatttattgtaggagcaggaatagtatatgtcaggttcaccactctctcacagcatagtaaacacttacatttgtgaaatgaattactgtcttatgtagttactatatccatatttattctttgattctcacttctagctataaaatatcctagtggtatttgccttccatattttcagacagtttaaaaatagcaccaaacaatgaaggaactttaagcaaggttgtgatatgttcttacatctattttaatgttctctaaacacaaataaaatataacatattgaattgacagaatacaagtgaatataagatgagaaatatatatatatctatatatatatatagatatatatatatttttttttttttttttgagacagagtttcgctcttgttgcccaaactagaatgcaatggcgcaatcttggctcactgccacctctgcattctgggtttaagcgattctcctgcctcagcctcctgagtagctgggattacggcgcctgccaccatgtccggctaagtttttgtatttttagtagaaatggggtttcaccatgttagccaggctggtcttgaactcctgacctcaggtaatctgcccacctcggcctcctgaagtgctgggattactggcgtgagccaccgcgcctggcaaaaatatttatatttatacttctcccaaaaaataagacaagatcctagagaatggtctagagttcttgtaggaataatccaggaactctgctgcttgaatcatctagacttccagttccaaccaggaaatactgtttatcagactacccttctaccaaaagcagtcatgaaagctagacaaaatatataaaaccaaatggtttgaagacactgaaatgcaattaggtagagcttgaggggctgtgatcctaaggtcatcgccatataaacattggctttttccctgaggatatgttctaaaacatgttcagagcaatagaggccatatctaaagtggcagtcatttcgggcagaggagacaatggtcaggccccagagctgctaaaatgactgaaacatagggacaaaatctcatatagaaagaaattgcagaggaaaagcccaaaatttatggacaaatttccctgaagtcattggtgattccataaccacatatatggggcaagcaagactcaaagaaacccagcagaaaatagcagaagaaatttaagggctaaggaggaaatttaacagccacatgctagtggggaaacagaggttaggctgcttaggtgcccttggtaaatacccctggcttccaactgaaattcccagggccatttctggaagttggggtaaaaacggaaatggactatttttaacaaaacctaaaacacaatgtaatctgcatttactcagtctgtgttcagaagaaatttaacctttttagaagataatgtcattcaaagcctctacaatttttcattttatgtagtttgccttcagataaaaaattactagacagattaaaaaaataaaacgcaagagcatattctagagattatatctgcacaaatgaaatgtttatgagattattcactgaaaaatgttcatggtaacaaaatattggaaatagcccaagggaccatcaatagggaatttattaaattgtgtatatttatgtaatatattaattttcacacaggcactatcatcgtttggtgcaagccagttctttattgtatgatactgtcccgatcattcactacagggcagtttataactttggacctggcacaataagtggaggttgcacattcaaattttgagacaactcaaaatgctcccacacattttcatgtgcctctagggtggggcattccacttgagaatcattaatattatggaattccgtacaactgtaaaaaaaaaaaaaaaactgagaaagttgtttatgaactgatatggaaagaccaccaacttgctatgttttgtttaagaaaggaggacaatgagcatatatatttggattgcctacatttgcataaaacattctgtagtaatatgtaagaaacgaatgaaagtgattttctgtggagcctgatgaggtgaatggagatgagaatgggtgaaatgtatttactggatttaaaaactactgttttaatttttagaacatggatttattacctatttaaatttttaatacaattttagatataaataagctatcgtgtcagatataataatttataagagatctatttaaaatttacatattcattaaacgaatgttttggtcttttcccaatcctgtgtctccttttacttttccttttcattcagtggagtagggcgaaactggggctgggcatctgcaggtagcagcattctggctgaatttggtacactacatatggagttcatccacctcagctacttgacaggggacctgacttactacaaaaaggtttgttttcttgccttctattctttgtttgttataaagagtcctttaagattggcccaaagatttgattaatgcttaaaaggtttgcctttctagatatatgtttattagggctgtagcctttattttttcttttgaagttactcaaagaaatgtcctttctatttagaacatatttaaaatatgtattgttatttgagaagttataaccactgttacatttttcaaaaatttcactgctatttttatgcagcattgtgctgcggtacctacccagcctggtaagacaagaaaaacaaaataaccagatgtttaggaattgaaaaggaggaaagaaaacagtagttattcacagattacgtgattattgacctaagatattaagacagtctatatttaaattactagaaataagagtttaatatgtttttttaaatagatgatcaatatggatgttaaaaatcagtagcatttctctacaccagctacaaaaggcaagaaaatgtcattttgcaaaaagatatcttatgtaatagaacaaaagtatatatgtttcctacaaataaatctaacaaaagataaagttcaaatttttactcagccatggaaaagaatgaaatcctttcatttgcagcaatatggatggaactgctggaggacattatgttaagtgaaataagccaagcttagaaagacacgtattatgtgttctcattcatatgtgggagctaaaataaattgatctcacggaggtagagaatagaatggtggttatcagaggcttggaagggtagtgaggagagaaggataaaaaggggttggttagtgggtacaaaagtacagttacatagaatgaataagatctaatgtttgatagcacaatagagtgactataacaatgatttgttgtatatttcaaaatagctagaagagaagacgtagaatgtttccaacagaagaaatgataaatgtttgaagtgatggatgtttcagttactcaaattttatcattatacattatatgctagtatcaaaatatgtataactctttatatccataaaaattaaaaataaaaatttaaaaatacaaaactttattaaatgatattgaagaggatataaataaatggagagatatcgtatttatatataggtaaacaatatcataaaaatttcagtcatccccaaattgatttatagcataaattcagtgccaataaaatctctaatggcctttttcctcccagtggaactcgaaaagacacttctagaatttatacagtaaagaaacattctagacacttgtgaggaaaaacacactggctggatttacattgcccagttatcaacattgacagtatagtatttgttaatagggacaaacagactgacaaacagaatagatagctcttaaacagacctacatatatgtagaaacttgttttaacaagtgtcgcactgtggattataatagttaattccaggaatattaaaggcttaactttaaaatataaaaccctgacactttgagaataaaaaaatatatgcccttggggtaaagaaggatttttacaatgggaaacaaaaaatattacctagtaaaaataccctgtaacccagcaattccattattcggtatgtacatttacattgtatacgtagaagcattgtttatattggcaatttatataataaaatacaaaatagtaatgaaaaatgaattatgtttatatctgttagttaaaagaatatgatacaatttttataaagttcaaaacaaagctgaacagtatattggttagggattcaaaatggttttgataaattgttgaagtaaaaataatatatagagatgaatctctaaattaaatgttttatttggaagcacagaactccaattcagggcatacacacagagtagggtggttggtcctcagtacatccagagaacaaagagaaggttggaagttttattagaaatgttatgtatagttttgaaaggaaatgtgttgacacgagtaaagcttctagaagctgtctggctctgattggtgatggcagtagataaaactataatcttagggttatagcagctgagcttgtggaaaacgtaatttttggagctggtgttatgtgccgcaggtgattttctgctgggccccttgactctgatttagttgggtatgacaagaatgacccaattcgtataatttgctttcacaaagtcaagataatgacaaatatgaaactcaagactacagatacatctgggatatggggaatagtatgtgaatgggcagtgaacagaccatcaaaggtgttcgtagtgttgtatttcttaaattgagatgtgagtagagtcgagatatatatgtatattcctttctgtgtatgaagtacttcatcaacagagaagaattttcaggaaaatggaactagatgacataattttccctgttctgactaaataaataataaaaattaaatatttttatattaattatgttaaaaattatttttatatcaattatattaataaaaatattaaagacagtacaaattcatcaaaggcaataaaagaaggaaaaaatgtaacttcatgtcatatttgataaccaaaataaacaaaaacgaaaagatttctgatttctggaatgagacataagtctgcttcctaccgtatcctgaaacctttctgggaaaagagagtcagccaactcctagtattccctatctgtcttgccagggagaccagtgcccagggcgtcaaatatgtaattgcctacagctccagcagagttctcacctctcatccttcctgaacacataggcttcaagtgatcaagtagaagtacactagtactccagatctcaaattgtatccaagaagggagaaacacacacatacacacacacacacacacacgaggaactcaaggagaaatcaacaaagttcaggtcagaactgaccctggtaaatgtgaacaagataaaacagaaagcatggcaattgtgcaaacatactgctagaaacaaaagcagagtggtatatagcatgtagaagactgataaagaatccagtttcaaattttaaaaacagtaaaaaaaaaaagtcaccatgagtaattcataccataatagaaattaaatttaacagagttagaactcagaaccaaaataaaacaataaagtgatacaaaaatattgtggagctaaagaaacaagctgagacctaaaatgatgtatccccatagctaatggaaaacaacaaagaactcgttgcacatagttaaaaactgaattacttacatggaataaaagcaagagatagtcatagtcaaaacaaaggaaaagcagagattaaaaagataatagatttgtaaaataaacataatttaacgtatgggccttcctgaagtagaagacctaaatcataggaattaacctaaaagctgcaagaagaagaaacactgctgggcacagtggttcacacctgtagtaccagcactttgggaggctgaggtgggtggatcgcttgagctcaggaattcgagacaagcctgggcaacatggtgaaaccacttctctaccaaaaattagccatgtgtggtggggcgtgcctgtactccccagctacttgggaggctgaggtgggaggatcactgaagcctgggaagcagaggttgcaatgaactgagatcgagccattgcactccagcctgggcgacagagcaagactctgtcaaaaaaaaaagaaacagaacactgcaaattccatttctaacaaaattaagggatacttgatgcttcataacaccaaataggaagaaaagtaggcatataagcagtaaagatcagagagaggtttggtataaatggaagagaggatgtttgggtctgcagactgaaaaatacaaagccagtagagcacaattctctaaattagatggtgtaacttgacatacaaaactcaaattctcatgagcagcaatgagaacaggatcacaggctaatggtgagtacttctttggaccttactagatataatgtgttgagaagctggaaaaacagaatcgagtaaggtttctcacagacaagctgtttgcgcctgcgaactttggtgagggaagggaatgaatgacagattcactattgtgctgcatttccaatctcaagtggctggggagaagcaaagtctaaaaaaaacatttatgtctggactcttacctggtgttttatgtcaaaactttcattcaggaaaatagtaatgagtaatttgttaaaaaagaacaggtacagaatttatacaaagatattaccagaaaaaaggaaaaggagggaaaattgtgggcacaaaatacgtaaaagagcaattgaaaattccaagcaaatatcaccatgagagaaaacatagtaaagccttcatctctgtagaacaagtatataaacagagatacaagagctcagagacaataagatgtgatatcagtaacaaagtataagaaaaaatagttatcaacaaaatgaaggccaaaatggaagcaatacaaagaaaaacagtgttcaaaatataaggagcttagaagacaaaattgagaaaagctagtaaatgtgtggaaataaaaggagacagaaagaaaatgatagataaggaagaaaaagaatagtatacagtttttggatgacagaagagttaactttctcaccttttataacatcattcagaactatctaaaaagtggtctatggaatttttcagattgagattgttatacatagtgttggtctcaaatgtgaaagaacacaggtaatatagacagcatccctgagtccattcctaaaactacttaaagacaaaatccagccaaatgaatgacgatgggaaaccttgtggcagaagaattgatattgtactcaggtccagaaaagtgaagtatatatcaggtcctctgaaaaagaaagttttcccaagtttataccagccaggttattcatcaaatgtaatgacaatattctcaaacaaataagagtacaaggaacataacacctcctcccacctccaggggcccccttaaaagcacttacaaagttcacctaatctatagttgaatcaaaataaatccctaggaaagtctccagcttcttaatatatttcatgatttttctttcccccttactctcagggagatattttaaaatttggaatttcaggaacttaaagatatctattgtgggaacaatatttaaagttcaacagtttgttttacttcatttacttttttatctgttcaattcaaattaataacttttcaaaatacaatggcattttatgattcaattcctgtgaagttatttctgttcttatatttgaatatatatgtgttgactgtgtctagaatgatgtttaaaataactgatgtttcagatggtatttctaggtagtagcatgttgagatttaaaatggtttctatctgtgcagttttctctgtattatttttattattgcttgattttaaaataatgaacacatatcatcttataaaaatgagtcatttaagaaatagaaggcttccctgacttccccctgcccctccaacacacacacaaaggcagggaataggtgtagattctgagtaagaaaaaacacaaagcctacattaaaaccaagccttgatgacacttatttttattaattgcattcttaattttattttactcaggttatgcacattcggaaactacttcagaaaatggatcgtccaaatggtctttatccaaattatttgaaccccagaacagggcgctggggtcagtgtaagtattctagtatacctgaggctttcttaaaaaattatttgtctgaaaactctttgcttgatgttgtaaaaagtacactacgtggagttagaaaccctcagtgtctaaccttgtggtctgctggtgctgttcttaggcatgtttctgatctctcttagcttcagttttcccacttataaaatggaaatgttaataacatgtctcctaagagtattttatttcctgtattgctaaaatatagtgtggcagtttgaaggttgtacttaaaaactcttattaataaattatatcttcatgtaaataaaagcactgcttaggagagggaggtagaggaggagtatgaaaaacaaatgagtatttactagaaggggggcagttgttcttggataagccatgtctgttcattcattttagaagagggcatcctggccttcattatttaccagtctctgtgctaagttcttagaagagattgagatggagaaagaacatagggcttggcctgaattcacaggctggcaggataggctgacacataaatgttactgtacaggaaggaaccaattgttatatgaaactgtggtaaaaatgattccctctgcctgaggggaaagtattttgtttagggagagggtaatttttcttattagaactcatttatttttgaaggaattgatttttaaaagtaacaactaatatttctgtggaaatgtggaacttacagaattttagtaattgtaggtttatcaatgctattctcttttaaaagttaggaaaacaaaaacaaataatagagattgcaactttgccgctaataaaacatgattcagttatttttgagactaatgaaatcttaagtagtaaataagagacaaaagtaatgatcatttaattttagtattgaaaacactgctgattctgccagtaagaaaataagctggtgtgagtaccaagaataggaaaacatttgccctggaattgtctttttgttcctttctaggaaattgtcttttattttatgaaaggaaagcagataggtcaatataattatgtctttcatggatctgggaatagatctcaatcttctttgactctttttatacttacttttcctgtttcctgaaattatttacatatgactcatttttctctttattttgaagaagataaaagctctaatgcctagactgagtgggaatgatattttctggaaaaacaaaaccctgagagctgcatttctaaaatgtaaaaacgtagttttcttatttcagataagagtgactggattggatgtctacttagtaatttggatgaattctatcaatcataaatctttacccctgtgagttgtattgagatttgagaatattatgataatataatgatataataatgtatatgaaaaattatgttcagttcctgtcttagactatatgccagtgtatattctatatggtattactatttaaatgtaaaagatgaaatcataaaagtactaaaaaaagggttgaatatataatcaggaaagccttttctaagcatgtcatgtaaaacagaaactacaaaaaaaagatgtcagttttcctgtatattattgttaacctctgtattagtctgttctcatgctgctataaagaactgcctgagactgggtaatttataaaggatagaggtttaattgactcacagttccacagggctggggaagcctcagaaaacttacaatcatggcagaaggggaagcaaacacatccttcttcacatggtggcaggaaggagaagtgccaagcaaggcggggaaaagccccttataaaaccatcagatcttgtgagaactcactcattatcaagagaacagcatgggggtaacatcttcctgtacccactctccagagtgtatatatttgtatgctttttgagccagcaactcatttccagcaatttattccaaataaattttcagagctatatattaaagtttatttacaataatcttggggttgtttataatagggataatttggaagcaatctaaagcagttctatctaacagaactttctgtaatgaggaaaagatcctattatctgtattatccaatacagtagtcactagccacatgtgaccatggagcacttgaaatgttgctagtatggttgtggaattacatattaaattttaatttaattaacttacatttaattagctacttgtagctagtgcttctacattggacagggcagtttttaaacgtcttgtaatagggatttggttaaatacattttggcctgtccagatatagtatactatgcagccattaaaagttatattttagaatacctgacatagataaatgacatatctagaaagatatttagaaaaggagaggaaacactatagaaatagaaaccaaagtgttatgtgtggttttctttgaatttgtgtttttattttctccttttcatttactgttactatccagatttgattatgaacatctattacttttgatgttagcttaaaaacatttttaaataaaaagagaatcccattttccatgccagtataaggatactcagaaaagtaaatcacagtttgagaattgccagccttaaaatgatcaaaagtacaacattgatgacatggaggcaggagagtcacttgaacccaggaggtggaggttgcagtgaaccgagattgtgccactgcactccagcctgggtgacagagcgagaccctctctcaaaaaacaaaataaaacaaaaccaaatccaaaaaacagaactctttctcttcaacgttgtgttgagaaaactggatagccatgtgaaaaataatgaagttgaacccttactctatattatctacaaaaattaactcaaaacagatcaaagactctaaatttgagaaccaaaactgtaaaactcttagaagaaaacataggggaaaatcttcgtgacctttgatttgacactggattcttcaatatgacaccaaaggcacaggtaacaatacaaaaataaaagataaattggatttgattaaaattgaaaatttttgtgcatcaaagcatactatctatgagaaagaaagacgacccacagaatgagagaaaatatttgcaaatcacatgtcttttaagggtctatacacagaatatataaagaactcctacaactcactaacagaaggcaaactacctacaactcaacaacagaaggcgaatcaccaaattaaataatgggtgaggacttgaatagtcatttctgcaaagaagatatgcaaatggaaaataagtacatgaaaaagatggttaacattaaaatacaaataaactcactgagataccacttcacagctactaggaagactgtaatcaaaaggatgaaaaataagcattggcaaggatgtggagaagttggaacccttgtacactgctagtaggaatgtaaaatggtgcagctgctgtgaaaacctagcagttccttaaaaagttaaacatagaattaccatatgacccagcacttcatctcctctgtatatacccagaagatttgaaaacagagactcaaacagatacttgtagcctagtgttcattacattatttatgatatccaaaaggagaaagtaactcaaatgtccaacagatgaatgggtaaacaatatgtgagtataaacatacaatggactattactcagccataaaaaggaatggagttctgatacatgctataatataaacaaaccttgaaaacattatgctaatcaacaaaagccagtcacaaaaggacaaatattgtatgattccacttatatcaaatatctagagttgtcaaatccatagagacagaaagtagattagagttgaccagaggctttggatgagaagaaagtggagaagaaaatggagagttattgctagagtttgtatttgcagtgatgaaaatttttggaaataggtagtggtgatggttttacagcactgtgaatataattaatgctgctgaatggtacactttcaaaatagttaaaatggcaacttttgtgttatatacatttcatcacaataaaatttacaacaaaaaagataacttttattcctctgttttttcctcacaaaataaattcaaattactttataatatattcactctcagcagtttttaatttcagtgttatagaaagagctattcactggttattttggcagaagatctttaaaatcctagcgagctgccctgatatccttttagcagctgtagtccttacagaattgtccaatttgttccttttaatgtttttgtatattttatatcagcctctgaaaagtatatcaaattttattattatctttgagctatatgcatctgtcatatttataaatagtctgcaaaacaaacatttaattgaactgaaatttaacaattcagctttggctaactgtattataattagagtaatgataatgtctgtgacatgcacatagcaatcacagaagataattactggtaattaccttcaggaaaagtgcttggcaacagatgtaaaagaatatagcaagaaacctagatttaaaggcaaattactagtttttttttcttttctaaaacttttttttttgctagttttctaagcacaatacttagcctatgtcatttaatgattaaagtgaagaaaatataggaaatcagtcattactgattcattgttttatattactaaatttataattgtggaaaaaacaagaatggacatgttatgcccctttgagttagaaaatgaattgattgtcttgcttaataatttagataatttatttaacttctctatgcatctttatctgttctcattgtacttatttaatagaaaattcatgtggatcatatttataatatgtttgaaaatgcttcaaattagtttttattctagaatttcccataagaagacttcaagaaatagcttctgttagaaacctgccattaactgtataacatgttgaaataaatcatatgaatcattgctatttaggagtattttataatatgttaatcaatttctgaatatcaaaaggaccttagagtgacatggtttatcaaatttgacatgtaggcatataatctacaggaaagagaagtagcttcaagttccttagtggtatccttttgctttaatgtaatttcagatgttctgtaaagcaagatggacagaattctcacttgagaaggttttttttttgtttgtatattttgtttttattgaagataattgacaagaaaatgtaaattctctgttcaataataaggttaattttgttttaatatgatttgttattataacatttctaattcacattcttccttttgcactcagtgaatatatatactctgttaaaagttaaacaaggcatataccataaggtgtcatattcagatactgagaagaaaccggatcaggttttgagaaaactaatgaaggaacaagattagttttattctgttaaaactgtctataaaatacattgtaataaataggctaaattaggaaaaggaaaggcttacagcagaaggacatactagaaagctaatataatacggatctggatctaggatagctgtctgtgggagtggtagtcatcatagattttatctttccctttgtatcctacattcattcttcactaagtcttgtcagttctgactatttctgaaatattcgtttccccattttaactgcacctttttccgtttggaataccttccgccttctctatgtcctcttatcaataaattcctacctattcaatgaaaacagaaaaggaaaatcctaagttaaataaactattcaaatatagtaatctctcttgcaaccacctgttagggaaaaggaaaaatattagggtatatatataaatacccattaaaagattaatatcaattttatgtgtgatagtattataggaatatattttctctacaggatgtttgcattcactaatttcactgatactaaatatcaaccactgttccagatgctaggtatatagatgtgaacaagtagacagtgtccctaatacccttggagaacttacattctgctggagagatatgaaataaacaaatacatgatgtgatgtaatataatggtaagaatttcttttttcttaaagcacttttagtttctaggacaatacattcttttgcttttctcatagccttacttagcttcatgcttcactcagtctttttattattattattagttttctccttttctcctagcctcttagtgttggaatgccttagagcaagcttgcccaacccagggcactggatggctttgaatgcagcccaacacgaattgataaactttcttaaaacatgagatttttttttttacaatttttaaaaagctcatcagctatcattagcgttagtgtattttatgtgtggctcaagacagtgcttccagtgtggcccaggaaagccaaaagattggtggacaaccctgctgtagaggtcagtcctccattctctcttctctccagtgtcatagttttaaataccatttacatgctggcatctctcaaatctagaactctagtcctcaccttgtccttggcctctgtactcatatatccaattatctacttgacatttttacttaaatatcttatagatacctgaaacttaatatatctgtaaatgagctcttcctaataattctatccacctcaaaacctgttattcctccagtctttctcatttcagttaatggcaggtctattcttgctcatgccataaatcttgttgtcatcctttacttctttatctcacaccccactccagtttctcagcaaattctgttctgtctgcctttgaaatatgtctagaattcaattgccactaccctgagccaagtcaccatctcttgcctggattgttataataaatagcatcctaattggcctttctgtttctgcctctgcccctttcagtctattcctaatacaggagccagtaattttttacaaagtaagtcacattatgccattttatttaactcttcattacttttcatgtcagagtaaaagctaaagtccttttggggccctgtgatctggttcttattatctcttttccttcatttattcttctccaactacattggccttctgtcacttgttgaatccattaggcacttcaccaccacagagctattgcagccactactccctttgcttggaatgatttttcgagagatattcacatagctcaatccctcactttcttcaggtttttttactcaaaagttaccttttcaatgaagtcttccctggtcaccttacgtgataggcggaagtacagaaaattgaaagacatgttttatagatttcttccaccgagtggtccatattttctctgtgaattagaaggcatttaactgctgatagcagagaagaaggtagagcagtaggggacttaagacaaataacaaatatcttcttcaggaaataggaaagaacattaatgaaggagttataaaaaagttgacaggcagtgttgaggctcatgttgatggtgaaaacggtaaatttggaggtaatagtaaaacagactgacagctgggctgacccacagttgatgtttaactgtctgggtacaacaggagaacagtggagtaagggtcttgaatggttggacaagtgggattacctgttgcttcctttcgtattcaacctgactgcaaaggatccaaacttatttgagaatatatatatgtatacttttctctttctattttatctaacaaatcccaaaactcgtatcaacccagccacctacttttcccatttacatacagagtcaactaagcattgctggtgaaaataacagtacagattaaagttactataaacgtacaatttccagttttatgtggatcaccagtattccatgagttttttttttttactttgatcaatttactttcctattctttactctccttaagttttctatgtaacccctctatccatctccagctcttattttgaccatttctttattttcaagttcctaggcaattttagtttagatatatctttagtaaaaatagtatttatatagatttaaaaaatttcagtttgagagtctcagtgttttaaaaactgagtcaaaacaactaaattggtggaggttactgatagatttggactaattccaaatattctttggttttgtttatttttgaaaaactgctttattaagatacaatttacatataataaactgtacatatttaaaatgtacaacttggtgttttaaaataggtgtacacctatggaaatcatgatcacaatcaaaatagtgaacatatctatcaccccttttcctcatacccttacatgttccttctctcaacctcctcccttccccctcccccaaaacaactactgatctgctttctgtcattaaagcttgggttgccttttctagaatcttagataaatggcatcctttatttgtactctttatgtggcttctttcagcataattattttgagattgatctatgttgtgtatatcagtagttctgagtggaattccactgtatggaataccatagtttgtttatccattctcctgttgatggacatttaggttgtttctggtttggggctattacaaataaagctgctatgaacactgacttacacaccttcatatgttctcacttctctcggggaatacttaggaataggctgcttttatcaaatagtagatgtgtatgtttaacttttttaaggaactaccaagttgttttccagagtacatataccattttacattgctatcagtagtgtttctccatatacctgccaacacttgatatgatcagtcttttagttttagccattttattacattgtatttttttttcctttttttaaaaattatacttgaagttgtgaggtacatgccagaacgtggtttgttatgtaggtatacacgtgccatggtggtttgctgcacccatcaactcgtcatctacgttaggtatttctcctaatggtattcctcccctaccttcccacccaccgacaggccccggtgtgtgatgttcccctccctgtgtccatgtgttctcatttttcaactcccacttaggagtgagaacatgcagtgtttggttttctgtttctgtgttagtttgctgagaatgatggtttccagcttcaaccatgtccctgcaaaggacatgaactcatccttttttatggctgcatagtattccatggtgtatatgtgccacattttctttatccagtctatcattgatgggcatttggattggttccaagtctttgctattgtgaacagtgctgcagtaaacatatgagtgcatgcatctttatagtagaatgatttataatcctttgggtgtatacccagtaatgggattgctgggtcaaatggtatctctggttctagatccttgaggaatcaccacactatcttccccaatggttgaactaatttacacttccaccaacaatgtaaaagcattcctatttttccacaacctctccagcatctgttgtttcctgactttttaatgatcgtctttctaactggtgtgagatggtatgtccttgtggttttgatttgcatttctctaatgaccagtgatgatgagctttttttcatatgttcgttggctgcataaatgtcttcttttgagaggtgtctgttcatatccttcgtccacttcttgatggagttgtttttttcttgtaaatttaagttccttgtagattctggatattagtgctttgtcagatggatagattgcaaaaattttctcccattctgtaggttgcctgttcactctgatgatagtttcttttgctgtgcagaagctctttagttgaattagatcccatttgtcagtttgggcttttgttgccgttgctttttgtgttttagtcatgaagtctttgtccatgcctatgtcctgaatggtattgccgaggttttcttctagggtttttatggttttaggtcttaggtttaagtctttaatccatcttgagttaatttttgtctaaggtgtaaggaaggggcccagtttcagttttctgcatatggctagccagttttcccaacaccatttattaaatggggaatcctttccccatttcttgtttttgtcaggtttgtcaaagatcagatggttgtagatgtgtagcgttatttctgaggcctctgttgtgtttcattggtctatatttctgttttggtaccagtaccatgctgttttggttactgtagcctcatagtatagtttgaagtcaggtaatgtgatgcctccagctttgttcttttggcttaggattgtcttggctatatgtgctcttttttggttccatatgaaatttaaagtagttttttctaattctgtgaagaaagtcaatggtagcttgttggggatagcactgaatctgtaaattactatgggcagtatggacattttcacgatattgattcttcatattcataagcatggaatgtttttcgatttgttcgtgtcctttcttatttccttgagcagtggtttgaattcctggacacatacaccctcccaagactaaactaggaagaagtcgaatccctgaatagaccaataacaagttctgaaattgaggcagtaatagtctatgaaccaaaagaagcccaggaccagacagatgcacagccaaattctaccagaggtacaaagaggagcttgtacctaccattccttctgaaactaatccaaacagtagaaaaagagggaaatcctccgtaacttattttatgacatcaagatcaccctgttaccaaaacctggcagagacacaacaaaaaaagaaaattccaggccaatatccctgatgaacatcgatgcaaaaatcctcaataaaatactggcaaaccgaatccagcagcacatcaaaaaatttatccaccatgatcaagtcggcttcatccttgggatgcaaggctggttcagcatacacaaatcaataaacataatccatcacataaacagaaccaaggacaaaaaccacgtgattatctcaatagatgcagaaaaggccttcgacaaaattcaacactccttcaagctaaaaactctcaataaactagataatgatggaatgtatctcaaaataataagacctatttatgacaaacccacagctaatatactgagtgggcaaaaactggaagcattccctttgaaaactggcacaagataaggatgccctctctcactactcccatacaacatagtactggaagtcctggccagggcagtcaggcaagagaaagaaataaagggcattcaaataggaagagaggaagtcaaattctctgtttgcagatgatatgattgtatgtttagaaaaccccatcgcctcagcccaaaatctccttaagctgataagcaacttcagcaaagtctcaggatacaaaatcaatgtgcaaaaatcacaagcatttctgtacaccaataatagacaaacagagagccaaaatcatgagtgaactcccattcacaattgctacaaagagaataaaatacctaggaatccaacttacaagggatgtgaaggacctcttcaaggagaactacaattttagccattttaatagatgtgtagtggtaactcattttggttttaattagcagttcccaaatgactaacgatgttgaacatcttttttatatactctttgctatccatttatcttctttgatgaattatctgatcaaatctcttgtctactgcctattaaaaacattattttcttaattgttgagttttgagatttcagtatatattctggatacaattcctatatcagatatattcttggaaggtattttcaccccatcttttaattctcttaatagtgttgaaaagcagaagattctaattaggaagtccatttttccaatttgctttttatgaattatattttatgtcatatctaagaaatctttgcctaactcaagcacgcctaacccaagcacacaaagatttcttcctatgttttcttctaaaagtttatagattcgggttttgtatttacatctgtgagacattttgagttgatttttctatagggatcaaagtttattttttttacatataaatattctattatttcagcatcattggttgaaaaggctttccttttttcactgcattgcctttgcagctttgttaagaatcagttgtacatttaagtgtatgtttatttttagactctattctgtttgttattaaatctacacaatcaacacagtgtgtaccatcctgttttgatgagtgtagatttattataaatgaagtcaaatagtgttagccttccaaatttgttctttctcaatagttgtttttgctctctaggtcctttgcattttctttctttctttttttttcttcttcaacttttattttaaattctgggctacatgtgcaggatgtgcttgttacataggtaaacgggtgccatggtaggttgctgcacagatcaacccatcacctaggtattaagcccagcatccatgaggtattcttcctgatgctctccctccccctatacctccaaacaggccccagtgtgtgttgttcccccatgtatccatgtgttctcatcattctgcactcacttataagtgagaacatatggtgtttggttttctgttcctgtatagtttggttttctgttcctgtatagtttgctgaggctaatggcttccagctccagccatgtccctgcaaaggacatgatcttgttcctttttatggctgaatagtattccatgatgtgtatgtaccacattttctttatgcagtgtattattaatgggcatttaggttgattccatgtcttcactattgtgaatagtgctgcagtgaacataagcttgcatatatcttcataatagaatgatttatattcctttgggtatatatccagtaatggggattactgggtcaaatggtatttctgcctctagatcttcaaggaatcagcacactgtcttccacaatggttgaaataatttacactcccaccaccagtataaaagcatccctttttctctgtaacctcaccagcattttttattttttgactttttaataatcattctgactggtgtgagatggtttttcatggtggttttgatttgcatttctctaatgatcagtgatgttgagctttggatcagtttgatcaattgatcagtttgggattgattttgattcaatccttattcttattgtgcattatttttttttgcctctgcatgcctggtaatttttgactagattctatgtgctggatatttttttatccctagaaatcttcttgaactttgcttagggttacagttaagttacttggaaataatttgacctgtttcttgttttgcttttaggattttttaggtgaatctggtgcattgctcagtgaggcaagatcttcctgagtactctactaaatgtcctgtgaattatgaatttttcttgtctggctggtatgaacatccactgttcccagtaggctctttgtaagcaccaggcagtgttcccaccagtcctttcatgtggttctttccattgtctcagttagtttcttcacgtgcaagtgctgctcagtactctgcttaatactcaagggagatcctttgcagatctctggggttctctttctttgcacatttgttctctctggtatactatcctataaactgtagcttccccagtctttccagactcagccttatttctgaaacttagagagtccataggtctgtgccttaattttttctctctgtgcctttgcctgaaaattttcttgatgcagtaatttacaggcaataatgggactcaccttgtttgttttccatcatttagcgattactatcctctgttgtctgatgttcattgtcttgaaaaccagtgtttcatgtattttgtccaaagtttttggttgttttaggtttcaggctaagctcaagtacccattactctattttagccagaagcacttttttaaaaaaaaagtcaattcctattatgttatttttcctcctatttactgggcattcttaaaatatcctaccccatgctgcctcatttttttactcatttgagtatttgcatatatgtatatttccatctttttctaacagttgcccttgaattttaacttacatcttgtttatattttttctaacaacatctagacttaatcattactgtatcttccctctgaacaacatgaaaacttgtgtactttcactaccccattgcctagccttatcatgaacttgaggttcaaagagttaatccctctgttcattattgctttttgcacactccattctattctcttagattttttgctgtaatttttagaacacttcctctaggagtttctaatggttcgttacctacacctttccctcaaccccacccagatgacctaagtcaagatgaaagaaaagatccttctgcaagaaatctctttacctatcaactcatttatttgcccacttgatcttctgtttctccagtctcagagaatccagcatccactgttctgcccagtatttatccattgacctgtgctctgtctggatcctatcttctctcaactcttgaactttttcttttttggtgtttgcatttacttatgctatattaaacctcttggttcctttctcatagccagtaggttcctctctctacttcaactgtttttcaatgccatagattccttctggcaaatattctgtacctcttcttcatgtcttggtaaagcctatttaaaaaaaaaaaggaatagtctatttttcttgtttgccttctgttcacttctcaatacattgcattctgggctctgctccccatcacttcactaaaaataatttgaccctcttactgtcctatagactagtccaaaaaaaggacaatgtactaggtattgctgtataacaaacccctctaaaatttagtagcttaaaacaattttttatttctctggaatcaacaggttgcctgagtgattgtgcttttctggcttgggctttgcttatcttatctgggtttgttcatgtgtctgcaggtagatgacaagttggctgaaggctagcttggccccactggggaggactcagctctgcttcatgtggtctcatcatctatcaggagataccatgctttttacatagcagtgatagttccacaaaaagaagtggagcatgcaaggcttcttgaggcttaggattgaaactggcacactgttaacgttttaccagattcagttaaacaaagcaaaatgcaaggccagtccagtttcaaaggatggaaatttgtttcatgttctttacacagcttcttaaatgttgatattcctagaaatttttcttctaaccctttccattttgcctcaccaacctcatctctttttacaggatgacaaaatttgccctatatattggtgacatccaaatcagcaattagcaaactatgggagaccagcctgtggcctgttgttatatggcccactagcttagaatggtatatatatatatgttctagggtacatgtgcacacgtgcagggtttgatacataggtatacatgtgacatgttggtttgctgtacccatcaactcatcatttacaactcaccgtatgtctttacagtagcatgatttataatcctttgggtatatacccagtaatgggattgctgggtcaactggtaattctagttctagatcactgaggaattgtgacactgtcttccacaatggttgaactaatttacactcccaccaacagtgtaaaagtgttcctgtttttccacatcctccacagcatctgttgtttcctgactttttaatgattgccattctaacttgcgtgagatggtatctcattgtggttttgatttgcatttctctgatgaccagtgacgatgagcattttttcatgtgtctgttggctgcatatacagacatatatatatgtctcaaaagaagactgttttgagaagtgtctgttcatatcctttgcccactttttgatggggttgttttttttcttgtaaatttgtttcagttatttgtagattctggatattagccgcttgtcagatgggtagattgcaaaacttttctctcattctgtaggttgcctgttcactctgatggtagtttcttttgccatgcagaacttctttagtttaattagatcccatttgtctattttggcttttgttgccattgcttttggtgttttagtcatgaagtccttcccatgcctatatcctgaatggtactgcctaggttttcttctagggtttttatggttttaggtcttaggtttaagtctttaatctatcttgaattaatttttgtatgagatgtaaggaaggcatccagttttagctttctacatatggctagccagttttcccagcaccatttattaaatagggaatcctttctccatttcttgtttttgtcaggtttgtcaaaggtcagatggttgtagatgtgtggtgttatttctgaggcctctttctgttccattggtctatatatctgttctggtaccaataccatgctgttttggttactgtagccttatagtatagtttgaagtcaggtagcgtgatgtctccaactttgttctttttgcttaggattgtcttggcaatgcaggctcatttttggttccatatgaactttaaagtagttttttccatttctgtgaagaaagtcattggtagcttgatggagatggcattgaatctataaattactttgggcaatatggccattttcatgatagtggttcttcctatcaatgagcatggaatattcttccatttgtttgtgtcctcttttatttagttgagcagtggtttgtagttccccttgaagaggtccttcacatcccttgtaagttggattcttaggtattttattctctttgtagcagttgcaaatgggagttcactcatgatttgggtctcaatttgtctgttagtggtgtacagaaatgcttgtggtttttgcacattgattttgtatcctgagactttgctgaagttgcttatcagcttaaggagattttgggctgagacgatggggttttctaaacatacaatcatgtcatctgcaaacggacaatttgacttcctttcctaattgaatcccctttatgtctttctcttgcctgattgccctggccagaacttccaacactatgttgaataggagtggtgagagagggcatccttgtcttgtgccagttttcaaagggaatgcttccagtttttgcccattcagtatgctattggctgtgggtttgtcataaatagctcttattattttgagatgcgttccatcaatacctagtttatcactggtatgtgtttcaggtatggggagggattttgcatcaacttttaagagcatcttgacaaataatcattgtataaccacagttgacccttgaacaacacaggggggttagagtcaccaaccccttgtgtaatcaaaacttcacatataacttttgactcccccagaagttaactactaatagcctaccgttgacccagaagtcttaccaataacatagtgcatatttcgtatgttatatatattatatactgtattcttaaagtaagccagagaaaataaaatgtcatgaggaaaatcataaggaagagaaaatacatacacagtactgtactgtgtttattgatgttgtaaatttatgttgtctgtttacaagatgaatagtctgtgtcaaatggtggcaactacagtggcaaacctcaatctacagtacaaatcaaacagtccaactttttgttgtaatatcatgacttttcgctgcttcttgggaacactttcagattgctagtggcacttcatatgggtcccatggtgtttttgaaggtttacactactgtgccaaacaatgaaaaatatgcaagaaccatgagaaatcgctttttactgcaatatgcaatttactgaagacacggagatgattagtgtcacaagttgttttaagtggatgctcttaacacttgagttcactgcatagcaaaaagaggtgtctgtgaaattattacagtagtaaagtatgtactgcaataaatcttacacatttatgatttaatactgcatctttacatttgtttacatttctcttgactatcaatggcaccatgtatgtctgtgtatatgtaagttttaatacattttaactttttataatagatttgtatttcatgatactaaatggtaaaatagactagtatctacacatatgttattcattcgtgacacactcaactctttcttaatattttctctatttctaggccatgtggcttgtctatatgtttttccacattgttgcaaatcttaaagataatttcaatatatttatttttaaaaattcacgtgtaagtggatccacgcagttcaaatctgtgttcaagggttaaatgttttatgatttttcaaaggtttttctgtgcaacacattttaaaaaggttttctatgtaaaatcatcttgaataacaaagtggttataaacttacaagttccatgccataaataaatacaggaattaaaccaagattcctttagcttccatgtgctttggtttttattcatgataggacaaacaatgggagcagattatgagacagaggaataagaagttaagcatgtatagtattaactaattgcagttatcaaagaagtagtgaacttgataaggttatagtagtacttctgcttcatggaagaagattgaactataacgtcaccactgtggccattcatctttcttgagaccataatgaaatgaaagtagataaatatttataaataggcataaactcataataataaaaagatttgaaggcaagggggaggtaataatggacaagatatttcaacaaatttgcagaacatagagtggctgggaatggctacagagggactacaggaaaggtaactgatggaatcccagagagattttgggttcataaacaatagataccagtaaacaaatatattcaaagtacagcaaaaaccagatatttattcaaggtcgttatgtggaacatgggctctacctgaaatccttatgttccacctccatccctggtatttaccactagaataactatacagccctcttttttaaaaaatcacatgatttcattgaggaaagttaaagctttcaatatggatgttagtttcccaaaataaagtctcccttcattgtgaaatttaaccaggtccacagtccctcaatatccattcctgattctgaaacaaagcctaccagttagcccatccttcctcaaagtattctacatagaaagcagccagtcagtattcccactcaggggatagaattagtgacaattaggtctactcagtggaggaacacctgctattcagtagaggaaacccacactagctacccagaactttattcttaagcacggataattaaataatggttgactactacagtgggataacatacagaaatgcaaataaatgatacatagttacatataacaacatggttgaatcttgagctatagaagctggacatgacaatacggttacatttaattaatatattaaatataccaataggcaaaataagctcatagtacttgggagagggtatcagatggtaaatgtattaaaaattcaaagaagtagttaccccaaaagttaagatattggttacttttttggtgggtgggaattatgattttgtgggatacatggaaggtattgttctgactgtgggttatacaagtattctctataataaggagaacatttatgttttatatgcttttctgtatacatgttaaatttcacagtaaaaatatagtcaaaaaagggatcccacaggagacagacaattctataaacatttttaattctccactttagtcaaataactcggagaagttatattcatagagtaaaaataggatgctatgaaaaggaagcaattagagaatgaaaaaagagttcagattaaaagtatgattgctgacattaaagcttcagtgaagagactaaagataaaattgatttaataaagttcctggaatatacagggagaataaaggactaaaatttgagagaaaataatagaaactcagtccaggaggttcaatttccaattaatgagcgtttcagaggagataactgagaaagtggagtacagaaaatatcaaagaaatagtagaaaagatttttcccagagctgaaagatactgatctttagtttgtacctagcacattgtacctagcacaatgactgtaagaacaaacaaataaaaaaaagactatacctaaatttaatcagtgtttaagtgaagattctaaaccttggagaagagagctgagtgtgagtaagtaagattgggaacatattaagcctattaaaaataacatcagatttcttatcaattatactggatgttagaaggtattggaatggtactttcaagaagctctgggggaaaattatttccaaccttaaatttgatacccgtatgaaataaaattaagtgagagagcatagcaatgacattttcggatgaaagggtttgcatcccacacacttttgtgggaagttatttcagaatgtgattcagtaaaacaggtgtagacaaagacttaggactgaagaagcaataggcataactctggaaagcaagaaaagagaagtggcaagatgacagctgtggagtatccctagaaaatgaccagattgggaggaaggtctctagcggagtaaggagggaggggtgactcagtataagtaacatggttgataggctaggatacaataaatgattagggaaagtgatgggagacaataggaaaccagttagaaaatctggagaaaactaaaagctatacaagaaagtcatagttaaaacataaggacaactaaaatgtagcatgattttacgcagttgatgtctaagaaaagactgggcagctgataaaatggtagcgtcactgaatgagtcaagacattttaacataaccgcaaaatagatgttgtaatattgatgggaatattttgtcatagttgttttgatatatacatatttcaaaatagttaaaatgtaaaatcactgctctcttgtttattaccaaaaaatgtgctgaaaaggtaccactaacctttaccccatcccaaatgcccattaagtataagggactctccctatctactctattcatttctgtattgttttaatattttacaagttatgtgttaacttttatgatttttttgtgattataaaatgtgtcaatttgttagaattaatttagcttctaactataatctattgtataaatccatcatacattaccatccttataaaattattaatgtaagtatgatgagtatggaaagctattcaaaatttaattgtgaatttcttgttctatctgaaatgtagaataagacatcttattattgccctgtcttctactcctccaagtgacttctgtaatacccagccacttaatgtttgacattcaggaagctttcataaagcagaggtgtccttttagatatttagatggaaaataaagaatatcattaatcttagttgaaagcaaatggctttttttttttttcttgagacagagtctcacgttattgcccaggctggagtgcagtgttgcaacttctgcctcctgggttcaaggtattctcatgcctcagcctcccaagtagctgggattacaggggtgcaccaccatgcctggctaatttttgtatttttagtagagatggagtttcaccatgttggccaggctggtatggaactcctgacctcaagtgatctgatcacctcggcctcccaaagtgctgggattgcaggcgtgagccaccatacccggctgcaaatggccattttatatagtgttcaaaacctggcaaaacaaatttatggtgataatagaaattagaaaaaaatggtgtcattaggtattgactgtgaaggccacatgaggaaaacttttatgatgccagaaatgtactatagttttatcttggttgtggctttgttggtatatacatgtgtaaacatcaaaattatacacttagcattaaattaaaaaaagtgagaagtaatagcatttgagatgaggtaaaagtgaattatgggaatattagcagacatactgcttaaggtgaatgatagctcttttcccccatttattactttctacaacgaaagatgatttttaattatataagttacatgtatttagataattgtaagtgtctaaagttaaaattgaagggctccttccttagagcatcgcttagcccaggagtttgagatcaaatcttttctatgtatacaccaacattctttaaaaacacattttgagaagtatcaaactatatagataattctgaaatttgctccttctgcccactcaacagcatataatagatatcttgcagtgttggattatagattcaccctgattctctttaatgattgtgcagtcctccatagtacgtttatatcgtaacttagcctcctccctaaacatttcaggttatctttagttttttattaatgaaaataattctgattaagttcttttacatttatatttgtatatttctgcaaatattgttataggataattccagaagtacaattcctaggttaaattttgttagcttctgcaaaattgtccttcagtttcaacaactgggaaccataatcttgccaacattggatattatcagtcttttaaaatgttcactgatctaatggacaaaaatggaatctcactgttttaatttgcctttttctgatcactagtgaaattgggcatcctttcttatgttaattataaattgatgtttctttttttgttgtgtgtaccctattttaattttccttatttgtcaggagtcgtcgtttatgagagtaatccttttcttgttacgtatgttgcacatttcttctccaatttctagtcttttagatttatttgtcttttagctttaacgtacgaagctatccatttttcctttatgactccttcattttgtatttcgcttaagatcatttacttgggaagaccagatatgttcttatattttgttctggaaacttattcttttgcattttacttttaaatgattaatcatccacaagtgtgttttgtgagctaaatatatgaatattaatatgctttttctttcccataatggatagccagtttttgccataaatcactgaataatctgtcttttcctcaccaatttaaaaaccagggatattactgtatgagtgaatgagggttataagaaatgtactttttttttttttaatgcagagaggaggatgtcagttttgaagcagagttcaaggatatagggcagggtttgtagaaaatccaggataaaggagtgtggttgccttgggagctgtagtgtcaaattggataggtttaaaagtataggtgggatgaagtaagaatatatctaggacaaacaaatataggcatacccatatgtttatatgcttagctatatgctttgctttactgcacttcacagatattgcagggtttggtgtgtgtgtgtgtgtttgcaaattgcagatttgtgattaccctgtgctgagcaaatccgtcagcatcatttttttgacagcatgtgttcgctttgtgtctctgggtcacattttggtaattcttgcaatatttcaaattttttccttagtattatgtatgttatagtgatccgtaatcagtgatctttgatattattattgtgtttgttttgggcagcatgaacagcacccatagaaaatgacaaacttaataaattatgttgtgtgtgttctgactgctctaccaactagccatttccctgtctctctcctttggtctccctattctttgaaagacaacaatattaatataaggccagttaataaccctataatgtacacctagtatgcatcaatattaatctttcaatggcctctaaatattccaagtaaaagagtcatatgtctctcactttacatcaaaagctagatgtaattaagcttagtgaggaaggcatgtcaaaagccaagagaggccaaaggctaagcctcttgcaccagttaggcagattgtgaaaggaaaggaaaagttcttgaaggaaattaaaaatgctatgccagtgaacacatgaataatgagaaaacaaaatagccatattgcaggcatgggaaaagtctgaatggtctgggtaccattcagaccaaaccagctacaacattccctgaagccaaagcatcatccagagcaaggctctagctctcttcaattctgtgaatgctaagagaggtgaggaagctgtaggagaagagtttgaggcttacagaggttggtttatgaggtttaaagaaggaagctgcctccaaaacataaaggtgacaggtgaagcagcaaatgctgatggaaaaactgcagcaagtgatccagaagattttttttttccagaagatctaactaagttaattgatgaaggcagctacactaaacaacagattttcaatgtagatggaacaggtttctactggaagaagatgccatctcatagatgaagagaagtcaatgcttggctttcaaggacgggctgactcttgttgggggctaatgcagctgttgattttaatttgaagtcagtgctcatttaccattctgaaaatcctagggcctctaagaattttgttacatctactccctgtgtggtctgtaaatggaacaacaaagttcagttgagagcacatctgttgatggcagagtttactgaatattttaagcacactgttgagaactgctaagcaaaaaagatctctttcaaaatattactgctcattgacaatgcacctgatcaccattttctgcagtgaagatgcccaaggagattaatgttggtttcatgcctgctaacaacatccattctgtagcccatgggtcaaagagtgattcagactctcaagtcttatttaaggattgcattttgtaaggctatagctgccatatatagtgattcctctgtcagatctcagcaaagtaaatggaaaaccttcgggaaaggagtcactattctagataccattaagaacatttgtgattcatgggaggaggtcaaagtatgaacattaacaggagtttggaagaatttgattccagtcctcatgggtgattttgaggggttcaaactcaagtggaggaagtaactgtagatgtggtggaaatagcaagagaaccagaattagaagtggggcctgaagataggactgagttactgcagtcttatgataagacttgaatggatgaggagttgcttcttaacagatgagcaaagaagatggtttcttgagatggaatctactcctggtgaagaagctgtgaacattgtcgaaatgacaataaggatttagaatactacgtaaatttagttgatgcagcagtgtcaggatatgagagtggcctccaagtttgaaagaatttttactgtggacaaaatgctatcaaacagcaccacaagctacagagagatctttcgtcctgcagagaaatcaaacaggaagaatcaatcaatacagcagactttattgttgtctcattttaagaaattgccccagccaccccagccttcagcagccaccaccctgatcagtcagcaaccattatcatcaaggcaagaccctccaccatcaaaaaagagtatgacttgctgaaagcctcagatcatttgcatttttagcaataaagtatttttaaaattaagatttgaacattgtttatttaaatatagtgctgtcaacacaacttttataactactgggaaaccaaaaagtttgtgtgactcactttgttgcaatatttgctacattgcagtagtctggaaacaaacttgcagtatctctgaggtatgcctgtgtgtactaaaatttgtatgaatagtaatcaaggggagcaagtcaacagctacttatgttatacaaggtgatattataaaggaattcttgggctttttttctttttgtagatgtattttaatttattatctttggcttaggaattaccattaaccattgtataggaacatgtctaagagtgagctctttttgcttaacatcagctttaagttgagctttcatatttagacataacttatttatttaaagctattaatatataaaaggtaattatcaattctggaaaagtttggctctatgacagtgaacaaactgtaattcaagaaaaagactactaagtatgtgaagcaccacatccagagaaaaaagattttctagcaaattggatacacatatagaggaaagtgattatgtgtgattacttctgggactaaatttgaagtatgttggaaatagggttgtcaatgtaattttaaaattattgacctctaacatagtcattataattgaaaatgttactttatttgtcttgtcttcccttgcctttacctctatccttctgttttctcctttgttacagatcatacatctgtcggtggcctgggagacagtttttatgaatacttactgaaagcatggttgatgtcagataaaacagaccatgaggcaagaaagatgtatgatgatgctattgaggtgattatttccagaacatttttctacttaatggattgaatgtacagtgtattttgtagtgactagatgaatatcttataaccattttattatagacattcagtaaatacatacaaacattttattatatgcattcactgtagagtttgttactattttaatagaaaagcctcatattaagtcttcttttatttgtgacatttttaaagaaatttttgaagaaagaatttattgtagtccaggtgcagtggctcacgcctgtaatctcagcactttgggaggctgtggtaggcagatcacttgaggtcaggagttcaagaccagcctggccaacatggtgaaaacccatctctactaaaaatacaaaaattagctgggcatggtggtgcatgcctgtagtcccagctacttgggaggctgcggcagtagaatcgcttgaacctggaaggcagaggttgcagtgagctgagatctcatcattgtactccagcctgggtgacagagcgagactccgtgtcaacaataaataaaataaaataagaatttattttagtgtattcatgaaaattgattttatttacttttagttaatgtttacagagactggaaaaacttctgactttatatacattttcataaacatttttctttcaaatgaacccttgaatctacacattgagagccttatgggtaaatacttaaataatgacaacacacttatatagtattttctacatgccaggcactgttctaacccttcttacatatatgagatcatttaatcattatcaccattttacacatgaggaccttaaggaacaatgaagttaaagtaacttgctgaaggttgcattgctggtaattgatggggcgtggaactgaacagtctggctgccgagccagtgtttttaaccactgtattatattgtttcatatttaaatgacttcataccatgatattgtgacagtttataattggaacaagattcattctaggaagaatttatatggagtatttctaagaaaaaactgtgaaatagaaaagtaagtcagaagtgtgttaagtgtgtttagcaggttattagcttcctgctctattataaactgatacccacttaacaattttagttattttttaaaagttgtatattttgtatataacaactctgctgatgtagtcagtaattagttgtcagagttataatttctgtttggtttgtttttttcattaaaccaagaatcttatccattttatatccctactgttcaggcacataatttgttacaattgtttttaaaaaatgcacaggagttgaacttaatatgtggctcacagtgttttgcccattataggtactcaacaagtgtttattgagatattgtgttaaataataaattgaactaaaggtacaaccaagaatataaattttagtaggagaactttattctcttttattaaaatttaaacgtagaaagttgtatgatccaagatgggttattatctgggaagaatttaatattcttagaaccatattgttgaaaatagctcttagtaattcccactagactgtggcctcctttgagggcagagactaatttatttatcattatctcagcacctagcacaatacttgaaacataataagtattccgtagtatttgataaatgcatgaatatatttaatattatatttgagaacatgtgatatatcatataccatgtaataaattaattttgtctgttttcttgtaattttctttaaaactattttgacttttgcttaattttttccaaaggaaaaaaattgtatttgtcattgttttttttaatcatacatgctttgaaaggcatgataactgctttgaaagttaaccttataaattcacactatttttcatgaatcatctgctatatgttatgtatcttgtaaatatttctgtacttgctttcttttccctgtttttattagttttattagtttattaaatcaagaataggtacctaataaatgttttttaataacagttgatcagctttcactttgagacatgatctcaagtatgcagtctttgcagtgttaattattttcaaaaactattctattagcgtattataaaataaatgacatatggaatgtatgaaagagataggaatgaccacttaagactcattgtaatttgaaatacattatttttaaactttgtctttctgagctattttacttaaattattccatacccctcctaccttcccctatccttacagatacccatattctttgtttctactttcttttaaaattattggtaaaaagccctaactgactgccttttactttagttctagtaagtccaggtggatatgcttggatatcttttaattgtaatatggtaagatttaggttacaatgaacagaaatgacaaacatatggataccatctttaggcatttttggaataccttatatgtggaaaacatggtactatcatgaggttcaaaaagatgaaaaataccaccccatactcaaaaaactaatctttttgtgcttcagagtgctatggttaaaacaatgacaaaaacttataatccaaagataattatcattttggttatcagccacctctcattccccaacatcaaatacaattatctaagagcaccattcatttatgaaattacttaataattaaacatgtattgagtgcacactacattatatgccttctggaatacaggtgatgagtaagacatagtcactccagttctgttaaactcacattattattatggagaatacagagtaaaattttccaaggctgattgttactaaacttgtcagagaacaactgacagtaaaaatactcttttttcagaaagaaaagttaaccactaatcatgtataatagtttctactaaagaaaactgagttaatggccattgcttatacttttccatagaaatacctctaaaggtagaaaatagctcatctcagcaaagtctaagaacatattccaaaggagcaaagctcttgaaaatctcattttaaaactgaaatgtgattgttatactctgatatactcaagtttaatatagactatttctctcaccattcctacatcttttgagaaaaatgtatgttccagtagggtagacagtgtttataatatggcttctcttatccatgacaaagcatccaaaacaaatgcctaaatttgagaagtaagggactaaagataatattatgtagaaggtaatctttaggccaagtctctcctcttccactctgtcttattatggtagtgattcagatattggttccagattatatgcaatttgatcacccactccgacacttgctgttaattaagtctcagtttgggaaagttactactttatagactatcatattacccaggttttataatggccagaaggatatagtaagtttgaacactaatagtttgcatctaaaattttgaatatcttttctttcctgtaggctatagaaaaacatcttattaagaagtctcgtggaggtcttacctttattggagaatggaagaatgggcacttggaaaaaaagatggggcatttggcctgctttgctgggggaatgtttgcactaggagcagatggttccagagcagataaagctggtcattatttagagctaggggcagaaattgcacgtacttgtcatgagtcatatgacagaactggtaagaatattaataaggctaattatatagtctaaaataatctctaagttaaaaatgtgttcagcaataagaaggagaatatataggcactttttacttccaaatagtttacaccaacaaggcaaatcattttcttaagaacttgaattttaattctggaaatgtgtctctgcattattttttaaattctgaattctgctgctgtttctgttaaagattttgaagtaattgttttaaagacaagaatcgtggggtatttgggaatatatggaataacttttaatataagaatctatttttgccatttcagcttctataaaaacagttacttaaaagaacataaaattgactgacttcagttatattgccttgcctatcctcttgtgataagaagaataaccaaaagataacaatatttatctttattggtatctggctaactagtagtttttcaattagttcaccagtagtttttggaattgtttatggctttaactaaaaagatcctctgacattgcactgggcaaatattttctgaacttcagtgtccttacttggaaaaggagatgattcctaaatggtgacaaaaattgttttggttggggctgagaaaatttttactctttttatgtataaagcacagatatacatatagtcataaatagatacacagtatatatttggtattaaaattttatggagggagaaggcaattaggcttttttaaaaaagacaaaaggtttcttaggggtgcagtaatgaaaagggggctgaaaaacactggactagaccttccaaggttttctctggctttaaaaacatgagtttctatatgaagtaatagataatgagctccctgaaagccaaaaaactagaaatttctatttgatttcggaagttgaattgttgattttattaaataacaatttctgttttagggttaatttatcatcagataccatgaaacaaatatgattgacctaaaatttatgctagttcataaatctgtcaagttatttttatacagtaaggaattaaacttatggcaaaattgattcttcagttctcattaactaaataagggttccatttcttgaaagaatataagtcaagaggacggtgaagtagtgttattttagggtagtttaagtgttgttgtataatacatataatggcagcgatctgagttcaaaatagaggctaaattaaattatcgtgttgatacagaatgccaattatgccttaaaatatagctaaaattagtaaaacattgaggaccaggatggatattcaattttatattaggatccatgagaataaggattgttattttgcagattttgaccaaaaatcaaataatagacctaaaataattgaatttcatatagcatacattctaaaatatggtatatcatagttactataattaaatatttactccatgaaacagggaacagccattatatgccaagtattatgctagatgcttataggttaaagtatgaacaagatacattccctgcctttcagaaattcatagtgtaccagagtttgaaaggatttccttatatttctgattttaatgtttcataatgacattgctgatgctgattcttgttctgattgtcattttcacattgcaagttgatgaacccatgaccctctttgttatggtaaaccaaaaaatgattatttgatttgtgtcctgtattttcaagtcttctgttgtttttacttgtctttaatctcaatttagatcctttaattaaaaagtacaatcctagttttgctaactttccagcaggttattatatcctctgctgtgttttcttatagctgtgctataatttttggccaccatattttaaaatatccattcatttttccttagtagttattccagctaaatatatactgtaattatctacaactaaatcaattcataatctaagctctaaaatgtttccttatatgtgtgtattatggcaaaatgtctttaaaattaccttgcctttaaaaaaaacatccacacagtgtcattatctatatacttttattttagaccacaatggactgtatgatgtgcaaatgtctagtttgcatttgtttccaaaagattactagactctttttggtagaattagatttagcagtatgttgatacacattattctgagaaacattttatgttagaataacaggaatgtttataagtctattttaagaaaaccaaatgtggatcttttaaaatgactcattttgcactgagtgcaaacagcaacaataaaaataaacaacaaaaattacttcatattctgttctttcagggaagaaagaagtccttgcaaacaaacataaatggtttattttgctcagttatttcttttgtcatgttacagcattaaagctaggtcctgaatcattcaagtttgatggtgcagtggaggctgtggctgtccggcaggctgaaaagtattatatcctccgtccagaagtaattgaaacctattggtacctatggcgattcactcacgatccaagatacaggcagtggggctgggaagcagcactggtaaataagccaatattccattttatctgcaagagtgttaactcatgccctcctatgatgccacataccctcacccatgttacctcatttttagtatctgtagggcagtttttatttatctgatgaagaaactcttagtcaatttaagtttctgggcagtagaaataaatcttacgatatatattaaatatatattaaaatatattaaaaatatataaatatatatatttcaaaggaggaatttttaatggttagttaagtaaaggaagcaagtggtttactcttaaagtctttcagggaatccatagctatcagtacctagggaggaaaaaactattagtcttttatgaaagtatagcttattcccagggtaaggggttgttttattctttgagatttactaattgtgataaatagcactaattatggtgactattcgtattcaaattgtttaacttaagcttacaatctagatagaatgactaaggacatcccaaatgaggtcagtagtgctggtaaattgcccagacaggaatgtatgagatatattttaaggcaagatgtataccagtttatgtaaagcgaacgtttcacagtggcaaagtgggagagaagattggagccattatgtagacagccttacacaccaaatcaaaggttcttagttgttcaggaaataagacgtgtgcacaactccctccccgtaatacacactctcttagttacttctgtcagctactgcgttaagtgctgtcatatgggaaatggtaacagaaagttctttgcttatccaaaaagcccttcagatcttacttttcttttttccttagcatcttctacctgcaaaagctccttgacttttgagaattccttacagaactgctaaatgttttataagggggaaggaactcctgaaggcttttttcagtggggagtaacaaagcaaaaggatctgattgtaatccacaaattggtgggtttgggagaccacagccataacctaggaataatgtgagatcttgaactaaggggagtacacttatttttcacctgtcattcagacctagatagtcctgctggactttaacaataagagcatattaatggaaacaagtggttacacaggacaggaacagatgcagcatttattgatgctgcttttccttggccccttggctccagaattgggagcacagctactagtgaaattctctgtgtaggagggtgctgccacagttgagaagacagccaaactattgccacagtggtttgggaatagaatacacacacacttctattgttagcagtggcttactaatgcttccgtaaattaagcactctttcatgtaagggaaataggtaaaataatcatataatgaatctgtttcacttgaatgtcccctgatatttaatgctccttatttacaggaatgagggggatatgtctgaatcacgtgaggagtggaaagtggtggcagaagcactttttgtcattgaggaatactttaggataattcatccttttcctaatgtccttttttcctgtgtgctttcttcaagtatggccctacttttgtctgttaaggagaggtgtgacagggtcaaactttagcccatgtctgtctaaatttgaattataggaggtagaattttgcttttgtagcctatatgcacaaacacaaactcaatgtataatcggtcaagaacaagaactagagtagttatactctaaattcaagtttcagaagtgtgcagtggaagtgatgagaagagggaggaatggaggcaaaagaggcggtgtcatatcttaaatagtatttgctcatgcatcaccattggcctctcctcttgggtgcgaagaaagcaaagggaaggctgggtgaggcagaatagcagtatagcgtgtcttctgtagccttagctattctgtttacatattcaaacttccaaacttgccctcatgactttaaatgtcttaaagattagtcatgcctccccactactttcttattattcttaaaccattttgatagttcatgtggtggtgaagacacatgattattgtgaagaaaagtacttaaaaactcttgtatccaaaatttctttagaatatattagagaaaagcaccaaaccccttaaatttagttataatcaaaatggagctataaaatgagcagattgattaaataaacacctttttaatgttaattagcttttcataggaaggagaagcccagaagagtaagaaaagtagcaagactaggaacaacaagccatggcagacagcgatggttagttaagtaaccatgccttcattggatgaccttgcagggttaggtagaatagaaaaacaaaactaccacatgtgctttccacttttcatgattggttgaattctggactgtgctgtacctgcataagcagactgtttggttgctttgaattaaaaaataaggttgtgaatagattccatttgattcagtatattttatttaggcatgcccaaagatgcaaaaagagtaagaattttaactctcagtcaagcagtaaagcacagtagttaataatgtagagcaaattactctgtgcctcagttttcccatctgaaaagtgaggctgttaacctcatagagttctgaaattcaaatgtgactgtatttaaagctcttagaacagcattcagcacatagtaaataccttataattgttaactctttatattgtaattattattgtagtaggtgggctctttctgccagttggtaccacctgtaatggctaactcataggattatgataatgcaatgtctggcatatggtatgtatttagtaaatattatctcttaccgctattactatagagtgctcctaagtaatattttttagcatgttgtgggttattgtttgtccttggaagtgataaaattgcattaaaaattgttaattgaaactgacctccatcttgatttgttagaactaatggacctttattttgccagacagacccctcatttagaaaaaatagcctaaatttgatttctaagttaggaaaatataagatgtcttaaaaagattaaagagttttggagacagagaagttctataggaaacatcctgtttctcgtatgagttaatttttccagtatgagaatatttccttttgataatatattattcttaagccatcaaattttcatacaaatctttatgagcttttgactattgtccttcaaagttttgttgtccttcaaaacttgaaattctacggaattgcttattttgtctgatctctttcataggccattgaaaagtattgccgagttaatggtgggttttctggagtcaaagatgtatattcctctactcctacacatgatgatgtacagcagagcttttttcttgctgaaacattaaagtaagtatatagctttaaaaaatatttttatactagactggttttgctgtgtgatcactagatgatgaattacaactatgtgacaggttacactaaattttgttgtaaatatctttttatgtaattgggtgtgtaaatttttagctacatctcaaaaagaatgacttagactataaggtaggtattttatcaaaaaagtacttagtacctgttaaaattttttgttctttgctctttaatgtgcattaaaatcacctggaaggcttcgtaatacacaggtaactaggtccacactcacgaagtttcagtagatctggagtttagcttaaaaatttgcatttctaacaagctcccatgtgttactgataatgctggtcctggactcatacctgagctccctactgtagctaatgaaatctgttaggaatgatcatgcagttttgatagtactaaatgaccatagccactcatccacccgatgagccttactgtaaagatacacataaaaggaacaatggaaaagagtagacaactttattttcgtcttatactccaaaccccaggtagaggtctctgtaaacagacctggaagagatggagattgtaaatatgtccacttccctaaagactgaccaaataaatatctcttcatactcgctcttaaatttattatttgtatttcttgcatatctgtacatgaaagccttgtaaacattttattttttcaacaaatgtgtattaccaggcactgttcaagccacttgaggatgtttcagtaggcaagcaggacaaaaattcctgccttctggattttacattctagtatacttgtagtttacattctcatatattacaattaaaatgtaccgttctcaaactaagtttctaaatgtctatcttattctaatttttcttttattaccccagtactgttgttttcctatctttttagcttatacattatagaatcatctgcttcctccttttaatatatcaccaattctttatgcttctttctgttacatttttttattttgctccctcctttccatttctacaatttaccctaatccagccccttattactgctgggatggtttagaacatctgcctggtactcagtttcctacatctagatgtttcttattctgacttatcctttgtgattaggcttgagactgtagaagttgaaagagcactagactagaaaataaagtgacgggaactttagttgtacactagctacatctagctgaatgaacatgtcaaaataaaattttttgcttttggtttacatgtctgtaaactatggaatttggcccagattgtgtagtatctctcctgttttttttttttttttaaacttcagaaaaactgtaagataggacaatgattatttgtgtcttttcacctagttttgccacatttccttctctttctttctgtgtacactcacatatacacatagttttactttttttttagctttttattttgctggacaagttgatggtgaccagcaatatatttcaacagtaggtttcaagaaaaggtcatcatcttacataatcaccattcagttctcacacttgcgaaccttaatattcatataataatgttgtctaatatgtaatcccattttcaaatttctccaattgttccaataatgtactttatttttgtttaatgccaattcaggatccagtatgggatcatttgttacgtttggttgtcatcgtctctttagtctcctttaatctagcacagagttttcctgtttttcttttatcttttatgaaattgacatttttaaagttttcaggctagttgctttgaggaatgttccccattttagatttttttctaattgttccacatgatcagatttaggttaaacattttcagcatgaacattatatggatctgtgttcttatcattgcatcccttaaagagacacataatagtttagcccattattggtgattttaaatttgagcataggttatatttgattattgtcatgtaaacaatcttttttctttttgtaattaataacttatctgtggagtgataattttgagactgtgaatattcttttaatcctagattctattcttaaaccaacctaatgtacattcaaatatttacgtatatataaagtttcttctcttgcatttgtctattttatatttcattgcttctggcaggaatgcctttatcctttctatcaattaatgcctctctctcatttctaatttcagttcaaatttcacctctttgcagactggctttcataattaattctcaaatctctcatcattacaacttggagcactttagtacatgcatggcatagggctggaaatagatggtatgctgcctcatccccttctagtacctatatggaatatcaccagttaatcttggtacttttccttgccaagttcagtcagaactcttctcaacacaacagtatgctaggtaaccagttatttatgtatatctatctatatatatatagatagatatatttgctacaatttttgcttttagaaaaacatatatctggagcaataaaagtgaaaaaggtcaaacaaaaagaaacatacaaataattataacatcacctaggctaagaaaattgtcacagttgagcagtacattcagcattgcacttcctggcagtacattcagcattgcacttcctggcagctaaagcaaaaaggaatcattctgcacagtgtcattatcatttttgggagttgagggagcatattactttgacaaatgagacagaattttttatgttgctaaattataaaatgacttaaattggataactctataaaaatattgaactattaagtgaaccatatgaaattacccttttaaaaagggtaatttgaatattggcaatttagtatagttcaacctaatacataatggtaatggtaaatattttgaaaatatttattttgtttgaaacagtgatcttagggaagatacaaaaacactcaatctgatttactctttataaaaactgatggcataatattaaaatacaattgaataaagtcatttctgtgaagatctaaattaatgtagctgtagttttattgtaaaaatagagcttaaaactttatagaggaatgaagataagtatggtctcttaaatatttctcaaatatcagttaatttaaataggctttgtcagaagctgtcagtttaagattatgtattctcccaattggtgggaatttactgcggattcattaaaaggcaacaatcaatgtgttttagctaccagagatggaaactgattgtcacggcagtggcaaagttaaatgaaaaaacctgtattcttgacgtaagttgaggctcattttaccttttacatgtgtcataggtgctataccatggagtagttattgctataggcatacttttttccccagaagaggccatgtctcctactttttttgtttccctcaatagaccttacttcatggattaatatttatctagcatatatactgatggcataacaaaaactatgtaatgaggaaggtcagagatagattccttcaaaggttctaaaactcttatactctagtacaggaaataaaacacaagcaatatatacaacaaattttaaatacattaagtgcataagagaaatattaacaaaatgcagaagtcttttagagaagaaagagtttgcttaacctgaaaaacaagggaatacttcctggaagtagtagcatttgaaccagacttgaaggcaaggtgggtaaaataggatgaactggtattcagggtaatagctataaagtagaccatgggatattaagaatgagatgagagctctaaaggtagaattgacaaacctgaatatctaattagatatgaggagattcagtaagaaggaagaatcagagataatattaaagtttccagtgccaacctgactacagtttctaatcagcatgttagtgccttacttttaaatattaataaacagtattgacttagaaatgtttattgaacgataaacatgtaagatttggcatatttgtgtatgtgtgttatactttgacttttaaagtttaaaatatgaatataacaaggttaagaaaatatccaaaaatagaaggatatgtttccagcttgaaagacaccatcaagatcccagcatagaagatgaaaacagacccacaacaaggcacagcaccttggaatttcaaaaccactggggtaaaggaaagatctcagcttccacagggagagagaatagaataaagtctcgtagatctggattcagagtgccttcagacctctcaagaacagtcatgaaagctagaagcattggagcagttgattcatgagagaaaattaattccaacttagaattctgggtttttagccatgtaaggtatcaaaaatccacttccaatcctctttctcagtaagtttttggaacatatgctccatgaaaactggatataaaccaaaaaagaagacataaatacaggaaagaagtgaaaggaagataaagggatactgtattgagattgaggaggacagaggctctgagagatttcttcaagattaaatgtatagactgtttatttctgagtattttgagacaagaattagttgctgaagattttaggtgcattattactaataaatacaagtcagcttgctttttaaataaggggaggagtcatgtaagaaagaaaagccatgaatagcttttagttaacatatgaacttgtttaaagacacttggttggagtcttgattgttttgtaagaagagctaaatggtactactgtcccctctccagctgcaagaaagagaaatatgttctttgataatggcttttgtccctccaaggattgtcttattcattggattcagtgaaatagcagttggtcaaaagtctcttaagctgaaagaattgcgaggaaattagcagatagaacaccaagactcctaggagcggttctctagtagcagcacttgaattgctgaatgaatatctcccacgtggattctctatggttctatcactttataccatttactgtcataagcctcttatcaaaaactttgaaggtgtgtattattttatatatgtaccttagtgtctacacccattcacctagatctttctttgaattagattttcattgcaccttacctcaattctgttgcacatttatttaaagatctgataaactgagaaaagtatacattttgaggatacatttcaaccatttttttctgagttcatatatatcaggcattaggcagctcagaaatcacaagttggaaacatagtcttaacaaatttgttattaaaggaaagagaaatagcataaaattaagatcaaatttatcaccacagtatgtctactttcactggtatcagagtctctggggcagaaattatgtctgtgtctcttgcttgtgtgcttttttcctccgtatctcttgaaattcaaactttgaatatagtaaaattctggaaagctatataagaatatgtcttatattcttatatatacttatatacttaagaataagtaatcttaaataatcagagttatggacaaagatttatgtacagagatgtttattgctgttataaaaataagtcattatttgttcaataatagctgaatggttaagtaaattatggcacatccacaatagtatcatgaagccaaaacaattgcatttttatagacttttcacagtataatattaagtgggctattaagtccacatgtgcatacgtaacacatagatgaacatgttaatagtatttcaacaatatcaaaatgtgaactgtagtttagcttaattgaagttattttagtttttaaaaatactttttgtttttgtctctgtaaatatttaaaaacatctttaaaaatactctattttgaaaaaaataggctggatcactgctaagtaccaaaactaagtttctatagagcaaagctttaaatattaaaaaaagaaataaaatcatgaaacaattggaaagtttttttcaaccctagggatgaagatggcatgatacaaaacccaaagatcattgaagaaaagattgagaattcaattacataaaaataaaaaacatctgtacaaaaaaaagagcactaagtaaagtaaaagacagatggcacactgggaaaacatttcttaaaattagaaattattaagaaaaaatactaagcctactaaaaaaggtagtagcagttcttagaaaagaaatggctgtaaacacatgaagaatgcttgatccacttgtaagaaataaatgaaataatagatcagatgctatgttttatttactttcacactgcttaagatttaaaagtttttgttctggtgttggcaaggatgtaagaatctagtcactttcaaacaccctaagtgagagtacactggaagtatattctttttcgttgttgttaaggaagcaaggtccacctgtggcccctgccccgacttggaagtatattcttaaaatatccttaagtgtgtattatcagtacttcatttgtcctgatagtctatgtgaaatattaatattctcagtgctttagtttagtgtttgagttagaacaagcatgcatgcaatcaatgtgtttgttgagctatatatacataacagcatagcacttgtcatattaaaatcagttgtttaaacactataatgtgtagctcctaaaaaatcaagttgtttttaatacagctttttttgaattataaaaatagcatgtggatattgcaaaacgagttaaatagtgcagaactgaagaaatgacaaaaaaaaaaaatgagtttctttgtgcctcacatccaatctcacttcccaaagagaataattattaaatagttcttgatatagccttctggaaattttctgggtatatgcaaacatataaaaatatatataatatatatcctttagccttttttctccatatataagattatatatacctattattctgaaacttgcatttccacctttttatctaggaaaggtttccatattggcatatataaatccactgaggaatgttttataatttgtttaatcagtaccctattgttagatatagaacttggttctgtttttttgctcttataaacagtgcttcagtgaatgtccttttacatatatctctgctccctgtgtgaagataaatgttggttagattcctagaagtaaaatggatgactagggcagtggcatgtgcatttgacataactataattaagcaaaataagctgagagagcgaacttttcagaaaacttctcagagagtttcagaaaattaattagaaatggttaaaatcagatgggtattctgagaagtatggagacatttaggcactacctgataatgtgtagtaagatttgaatgaacaaaccttttgttttaagtaaatcttagacaacagagtaaatcacttaaaacttgttttctgtaagttaagaacacagatgaaaagtcaaacaatcagattcttaggaagtaaatggaatgacagtttcagtgtttgctcatccttttaaactagtgctttctggaatccttaattccacctctttgttctttatcaagatgtgagctctttttctactaagtaaatagtgattaaaatatataaacaatacaaatgtaatatatgaaatgatttatccaacaaatgtttgttgttaagtgcctgatgtgtgccagctgttttgtatgctagggctgcatcaatgaatgtaaaataatcctgacataaaataacttacatcctaaaaatttcattcactctccccctaacttataattatgctgttttgagtgcctgcctgtaaaaatatgccctatgtgtattatccaaacccttcattattctctgtccttgccctcctttatttttcttcataacactaacatcatctgtattagtccattctcacactgctataaagaactgcccaagactgggtaatttatgaagaaaagaggtttaattgactcacagttctgcataactggggaagcctcaggaagcttaaatcgtggcagaaggggaggtgggcacatcttacgtggtggcaggaaagagagcatgtgaaagaggaactgtcaaacattataaaaccatcagatctcatgagaactcactcattatcaggagaacaatatgggggaaaccacccccatgatccagtcacctcccaccacatccctccctctacatatggggattatggggattacaattcgagatgagatttgggtgggacacagagccaatccatatcaccatctgacataggtgtgtggtgttcttgtttggtagagatgcgggtcttgctaattgccctggttggtcttgaactcctaggctcaagcaatccttctaccttagcctcccaaagtgctgggactacaggtatgagtcatcatgctcagcctagatggatttttttttttaatctatcttccagtagaatgtaagcctcatagccgtagggactttttccttttaactactatgatctccccagcacctagcacatgaggcactcagtaaatatgtattgaatttgttgataaatttttagtctgttaggcaagaaaagaacttggctatttgcatctttactctgatccctctttagtttttaattatatcattttatcagttgtgtttaaggcattacctgatcatcctgtatacaatttcaaattgttcccttactccctcttacttttccctgctttacttttcttcatagcacctatcttccaacatagcacataattttcttaagcattccccaattagaatataaactacatgaagagtttacagtatttttgtatatttgggttattgttttatccgcagtatctacggtagggccactcatatactatgtatttcagtattaaatgtttgctgaataaaggattgaatcatttcatttcaaaggagacagctaaaaaaccccagcaattttataagatcttgtatataataagagtaggagggggaaagagaagagaataatagacctactttatttcctggttggggcttagagcttgatctcagaattcacttagttttaggaggtgtctgataatgagtcaaagaattgataaagcaagaagaagggacccaaggcaaaatgtgaaagctgaggatgtcagggctgcggatttgttttcagtagagagtcaaaggtccagatgcccacataaaggagaaaagcagaaacagtaccaactaattgttgttagaagttacacaaagttggtaacctagaaaagtggttctcaaacctgagtgtacatcagaatcacctggaaggcctcttaaaacatgggatgctgggctctgttgagtttctgataaataggtctagagtggggcctaagaatttgcgtttttaacaagttcccaggtgatgctgatgctgctggtctgggggaatcacactttgataaccactgacatctgtgacccagtaaaacacttatggagacaattagggattaagaaattaactatactggcagagaacctagcataaagtcaggtgggcaagtctttgcttaactgctgtatttatgtagttcagtctcttcaaataggtatactggaagaccagaaccgtggtctttacatttttaagtgcttcctatgtcctaatacaatgcaatctaaatattaggcactgggatacacacacacacacacacacacacacacacacacgtaggaacacacaaagtgaatttcacttctactatttaatataagcatttttccagtttcaaaaatttaatctttgaaatatgcttgccaatttcttttgctacagtagagggagctacaacccaaattttactaatgtagcaatacacaataaggctattcttctccatccttgttcattagtctttttaaaaaaacttttaaaatcagctttattgaaatatgttaagtgtacagtttattgcattttggcaaatgtttaagcctgggtaaacatcagccttacttgatgcatggaatatttccattctaatttggcagtcagttctacccacccccaaactctaatctgctttctgtcactataggttgctgcttgtgaaatttcatataatttgaatcatgcagtattagggaggaggtaaaggataatcattgtttaaggggtatagagtttgagttttacaaggtaaacaatgtgaatatactcaacactactgaactgtacactttaaaatggttaaggtggtaaattttatgttacgtggctttcaccacaataacgtttatgtttggttttttttacataatattttttaggttaatccatgttgcatttatcaatagttcattcctttctattgatgagtattatgctcttgtttggatataccacattttatttgtccattcactttttgatggtccgttaatcatgtgtttttgaaaggaatcagaaaaaaagaattgtttaccatttggctacacttaatcttgctcttaattttttctttctagtaattttcaaattcatcccttaaaagtaatttcatctaatttactattattaaataaatattataaaataatttgctatttattaaataaaaattctaaatgtttttaatctggtgcttctaaaagcagaaatgtaggagctaaaatttgtggcaacagtttttctctcaaaactcaggtaaatattgttgcctgcagtttattgccctaagtttgtctggctttttaaaaaatttcattgtcttctagttcttcctttgcaaacaattttactaagcaagttattcttgatatttagtttggtttgctaacttagctactttttctaagggaacatattgtagtattgtaaagaaagctagtaataaatgaatagagtaatagatttgtgataccaacttgataccaatttgtgataccagcttacctctaggaggtaagtatatgtgcacttcactgtaaaattcttccaacatttctatgtttggaagttttacaggctgggcacagtggctcatgcctgtaatcccagcactttgggaggccaaggcgggtggatcacctgagttcaggagttcgagaccagcctggccaacatggtgaaaccccgtctctactaaaaatacaaaaattagccgggcatggtggtgcatggctgtaatctcagctacttaggaggctgagacaggagaatcacttgaacccgggaggcagaggttgcagtgaaccaagatcatgccactgcactccagctgggggacacagcaagactccatctcaaaaaaaaaaaaaagaagaaaaagaaagttttataaaatactgggggccaaagggaggggaaaactagtaaattatccagaataggtattggtactgatgttattgtcgtatcctctcatagttttaattctcttttttactgctgttgttatcttcatttgcttatgaagttattctcagtataagcaaatgaatgcacagttagctagctatcagactattaaagcaaattccctgagcaaggttttgaagtaagttcagagacaactctgttagtggctttgtccataaaacatcaatagtagtatgacttttaaatttctgagcacaagtgactaagtaatatattttggagagagagaatcagtgggatcattgtgggtgaggattctcagatgaggggaaaaaacggttagagaagactgaaaaacaaagccactatttcctttgtttatcttttatcttgtctgcaactggatcttgaagttagcctcctaccatgagagaactgtttttccagctggatgaaaagagtagcatcaagtcccctattctgctgttttctgctcacttactcctggagacaagctaagtcaaatcaatatgtacttataagtacctgctttctcagagttgtatttgagaattaaagtatatgaaatgtatactctacccataaatagcttggagtctggtttagaaatctcttacctttaggcatggacaaatttaataaaagtacaaagtatatatgcagttggccctccatgtcaatgggttcatggattcaaccaaacatggattgaagatatagttttttaaaaattacatctgttttgagcatgtatatacctttttcttgtcattattccctaggcaatataacaactatttacatagatttaaagtatgtgggagcatatgcattggttatatgaatatactataccattttatatcaaggatttgagcattcaaggatttttgtatctgcgagaggtcctggaaccaatcccccatagatactgagggacaactgtattcagtgctaaatagaaaataaatgttttagaaattcagagaagggaattttggtgcaggccagagtagtcatgaagaaagactaaaatgatgctgaattagtaagatgttaataggtggggtaaaacagaaagtagctttgtgaaaagaaggattcagcctgaaaaaatacctttaaaaaaacactaaagaaactagaccgactaaagtacattcactaggagaagtagtaggaaataagagctctagaatcaaaatcagggaagcagcatggatgacccttgaggacattatgctaagtgaaataagtcagccataaaaagacaaatatggggtgattccacttctatgaggtctctaaagtagtcacatttatggaaacaaagtagaatgttggttaccagggacctggggaggggaatggaaatgagttttagttttgcaaagaacagtgtgaatatacttaatactactgaactatacgctgaaaaatggtgaagatggtaaactttatgtcatgtgtttattaccacaataaaaaaaatataaggaaagcaatggcatgctaaaaagggaattataagataaaatgcaaagcactcatactttaactccaacctcctctcctctaaccccttcaatccaacttttcccttctttaaaattatctttttcctatcccactgcttccctccattattcctaaaatattaatattaattgcaaaatcacatttgaaatagtatcttgatatataatttatttggattcttgcagtaatttaaaataacagattatattccaggtaaacaaatatggctaagatgaaactagaaccccaaaggaagaaaagtaactgattattttaaattgctactacaaatgcagttggattgaagaaaatatagatgtatttaatgtccattttcacaaaattctaggaagtcatggtatgaagacagaaaggaactagtcatcatgaagaatcagaaaggatttctaagaacaagttcttgctggaccatctaatgttctttttggattggattaataatagacttgagagtaggggattccatgaacataattacatggcattcagcaaattgtttgacacagtctctcacaatggatgagtggaacttctgcttactctaaagatggaaccagatttacccttctgcctgaaataaatgacaaaatatatgtgaaataatggttttgaaacaccagacaggaggcaatgaaggacagtaatctctgagaaacaggaaacaaatgaagtaagccctgtaattgccccagctgtcttgatagagtttccaggacatgatacagggaggggacttgagacaaagcccagcgtgctccctgaggagatgaagctgtgagtgtggggaaactaaggtagctagaattcacaggacagtaccagagagaagagagctgcagagagaaataaccaagggaatgcactggagtgttcagcagagtgctgatcatcacatgcatgtgaagaacctacctgaggtgagggaaagaatcatcctagaggattaaaggcagcagtttctggcactcacacagggccacatagggttgcaggaacagtgcctgttaccagcaaccagactgtaaaaattcatattcaagtggcactgggtagagtgagtactcaggaaggtcctgcctcaatagtggggaataacctgctgctttggacctatgtagcaaataatgaaagcaagacctgaaaggatcagactgtttctaagtgatctaactacatccctgaacaaaactcaaggtttatataaaggaatataaaaataactaccacccaacaaagtaaaatctgtaatgtctagcatcttagtcaaagattaccatgcatgccaagaggcagtacaatgtgatcaataattatgaaaataaaaccaacttagaactgataaagatgttagaattagtagacaatgacagttaaaatatttatgataactatgttccctctattcaaaaagttgagacctagaagatataaaaacccaaatcaaatttctctaaacaaaaactgtaatgtttcagttgaaaaatataccagatgagattattagcatgttagacattgcagaagtaaaaattagtgaacttgaagacttagcaatgaaactatccaaaatgaaacaagagcaaaaaataagaatcttataaaaatagaaagttgtcagtgatgagctatgagacaacttacagtggcttaaaatacatgaacttagaatctccaaagaagagaacacaagaaggtggacccccaaaaaaaccctttttttgaagaaataatggcaaaaaactttccaaacttgatgtaaactatttacccacaggtccaagaagctaaacaaactccaagcacaagaaacatgaatgaagaaaactttaccaagacaccttataatcagattgctcaaaaccaggggtaaagaaaaaaatctttaaagcaacagaggagaaagaaaaattaggtaaacaggaacaaatataaaaatggcagcaagaatcaaccatggaattttaaaccatctgatataggaaatggaaagacttaaagtaattttacagaggatctttatatcatgacagttcatgaatttcataaaaataaaaatatttgccactgaagattgatccaaattctgaaaaagcaagagtttactataaaacaaagacaaaaacctattataaagaagctcgtctgattacccagtgaaaatgcataatttaaaagaactcaaaaagtaccaacatgaactatctaagaataaaagaaaacttgttatttagcagcgcatatactttggcaatgaatactggagaaaagataaaactatttttacttttcacattattcttggaaaatcactgttcaaatcccttttataagtacatatttactaataaaaacatggtaacagaaagggatgtagtatattttaaatggtgtatgttttcttttatgatgaaatgttatggatggcccacatcttttatgaggtgaaaccattttgtaaaaatattagcgaaagaaagtgaaattgatttaaaaaaacagtaaagaagaaaaagtttttaaaaagaatgatagttgctttaaactttaaaacaacagcaattaaaagagacagagggacattatataatgataaaaggtcttgtccaacaggaaaatatcacagtcctaaacatatatgcacctaacactggagctcccaaatttataaaacaattactgatagacctaagaaatcagatagacagcaacacaacaataatggaggacttcagtactccactgacagcactagacaggtcaacaagacagaaagtcaacaaagaaacaatggatttaaactataccctggaacaaatggacttaacagatatatgcagaacattccatccaataaccgcagaatacacattctattcaagagtgcatggaactttctccaagatagaccatatgataagccataaaacaagccttaataaatttaagaatattgaaattctgtcaagccctctctcagaccacagtggaataaaactggaaagcaactccaaaaggagccttcaaaaccatgcaaatacatagaaattaaataacctgttcctgaatgagcattgagtcaaaaacgaaatcaagatgaaaatttaaaaattctttgaattgaacagcagtagtgacacaacctatcaaaacctctgggatacagcaaaggcagtgctaagaggaaagttcacagccctaaatgcctacgtcagaaagaccgaaagagcactaactgacattctaagatcacacctcaaagaactagagaaacaagaacaaaccatactcaaacctagcagaagaaaggaaataaccaagatcagagcagaactaaatgaaattgaaacaaaaaaaatacaaaagatgaatgaaacaaaaagctggttctttgaaaagataaaattgatagaccattagcaagattaaccaagaaaagaaagaaaattcaattaacctcattaagaaacaaaacaggagatattacagctgacaccactgaaatacaaaagatcattcaaggctactgtgaacacctttacacacataaactagaaaacctagaagagatggataaattcatggaaaaatacagccctcctagcttaaatcagggagaaatagataccctgaacagaccaatagagaagcagcgaaattgaaatggtaatttaacaattaccaacaaaaaaaagcccaggaacagacggattcacagcagaattctatcagacattctaagaagaattggtaccaatccttttgacactattccgcaagacagagaaagaagtaaccctccctaattcattctatgaagccagcatcgccctaataccaaaaccaggaaaggacatacccaaaaaagaaaactacagactgatattcttgatgaaccagatgccaaaatcctttacaaaatactagctaaccgaatccaacaacatatcaaaaagataatccatcataatcaagtgggtttcatacaagggatgcagggatggtttaacatatgcaagtcaataaatgtgatatcccacataaacagaactaaaaatcacatgatcatctcaatagattcagaaaaagcatttggcaaaatccagcatccgttttatgattaaaactctcagcaaaatcggcatacaagggacatacctcaatgtaataaaaccaactgtgacaaacccacagcaaacataatagtgaatggggaacagttgaaagcattccctctgagaactggaacaagacaaggatgcccactctcaccactcctcttcaactagcactggaagtcctagccagagcaatcaggcaaaagaaagaaagggcatccaaattagtaaagaggaagtcaaactgtcagtgtttgctgatgatatgatcatttaccttgaaaaccctcaagactcctctagagagctcctagaactgataaaataattcagcaaagtttccagatacaaaattaatgtacacaaatcaatagctcttctatacaacaacagcaaccaagtggagaatcaaatcaagaactcagccgcttttacaataactgcaaaaaataaaaataaaacacttaggaatatacctaaccaaggaggcaaaagacctttacaaggaagactacaaaacatgctgagagaagtcatagatgacacaaacagatggaaacatcccatgctcatgaatgggtagaatgaatattgtgaaaatgaccatactgccaaaagcaatctacaaattcaatgcatttcctgtcaaaataccaccatcattcttcaccgaactagaaaaaacatcctaaaattcatatggaacaaaaaaagagcctacatagccaaggcaagactaagcaaaaagaacaaatctggaggcatcacacttcctgatttcagactatacctcaggccatagtcaccaaaacagcatgatacttgtataaaaataggcacacagaccaatggaacagaacagagaacccagaaataaagccaaatagttacagccaactgatcttcgacaaagcaaacaaacaaagtggggtaaagacacccttttcaacaaacggtgctgtgataattggctagccacatgtagaagaatgaaactggatcctcatctttcatcttacacgaaaatcaacataagatggattaaggactttcagacctgaaactataaaaattctagaagataacattggaaaaacccttctagacattggcttaggcaaggatttcatgaccaagaacccaaaagcaaatgcaacaaaaacaaagataaatagctgggacttaattaaaccaaagagcttttgcatggcaaaaggaagagtcagcagagtgaacagacaacccacagagtgggagaagaagatgtaaaagtggtccacaaacatgagaaaatgctcaacatcactaatgatcagggaaatgtaaatcaaaaccacattgcgacaccaccttacacctgcaagaatggccataatcaaaaaatcaaaaaacactatatgtgggcgtggatgcagtgatcagggaacacttctgcactgctagtgggaacgtaaacttacacaaccactatggaaaacagtgtggagattccttaaatcactaaaagtagaactaccatttgatccagcaatcccactagtgggtatctacccacaggaaaataagtcattatacaaaaacgattcgtgcacatgcatgtttatagcagcacagttcaccattgcaacccaaatgcgtggaaccaacccaaatgcccattaatcaatgagtggataaagaaactgtggtatatttatacgatggactactactcagctataaaaaggaaccaattaacagcatttgcagtgacctggatgagattggaaactattattctaggtgaagtaaatcaggaatggaaaaaccaagcatcgtatgttctcactgatatgtgggagctaagctatgaggacacaaaggtgtgagaatgatacagtggactttggggagtttgggggaagagtgggagggtggcgagggataaaacactacaaatatgaggcagtatgtactgcttaggttatgggtgcaccaaaatctctcaaatcactgctaaagaacttactcatgtaaccaaataccacctgtaccccagtaacttatggaaaaaaatgaatgacagcagagtcctcatcagaaccaatattcctcctgaacatagatagaactaaacaagattttgacaaatcaactctaacaacaaattacatagataatatgttatgactaaatgggtttatcccaggtgtggagggttgatttaatgtttgaaaatcaatgaactaaaatagaccacctcagtagacagaaaaattatttggcaaaatccaacacccatttctgataaaaactctcagcaaactgggaatagaaggaaacttcttaccctgataagggcatatatgaaaaacctacagctaacatcatattgaaaaactgaatgtgttgctcttaagattaggaacaagacaaaggtgtctgctctcttcaccacacctggccggatttttttttaaactgttttatttcagtaggtctagttgttcatcttactggatttcttatacactattctgaaacctcttgtctttgtgtttagatcatttgggtgtctgaggtttatttctttgatgtttttcatcaaagctgctcaaaatacgttattggttttctgtgccattaaaagtgagctcacttcatgttcttgttgaattctaactgaagctcatttctcccctttttattttcagatatttgtatctgctgttctccggtgatgaccttttacctttagaccactgggtgtttaatacagaggctcaccctctgcctgtgttacatttagccaacaccacactttcaggtaatcctgctgttcgatgaaagcagttccagaaggaccattctcacctgtgttttgtttacatggaccactacagaaattagtttgaaggggcggcttttgaaaacctggacctctatgtcaacatgacagggtgaaactattccccctaagactgttcaacttgtagatacatcaactttgaaattattccattttatacctgaccaaaacatgttctgatatgtgtaggacagagacctggatgtgctttgatcgttaatgaggtggtcacatgagaaatgatacctgttactactgtattgtttttagagtcctgaagtctggaggctagacttcctgaaagcaagtcaagaatatagagcaccttgcaggagttcaagatggcctttggaaccaattatgtatttgtttcctcctacagtggagcagcattcaaatcaaatatttacatattgcttatcactttttctccattttaataatggaatgaactaaaataaacaagaacaaaagaatagtataattatatcagtaacaagaagactcaaaaaagaaacaggagtacctatccctatctgaattttcaagttccccattggatgaccagactggcaaccatttcaaatcccagtctatttcattgaaatttcttggttaagtttaattttctctgggggcatgatctcacaaagaatactcaagtctttttcttcttatggaatcatcgaaactgctatttatcataatcaccacttatgagcctgggtttgggattttgtgcatgtagttcagtctagtgttggtagcatgacagaaagtggggaaaatgccgcagtttgttgccttgaaacctaagagcaatccttggttttgttgctacattatttttccagaccaacacatctaccaagtaaattttattcactttaatttcataataaagttagtagagtcactcaacttacaactttatttatgtggcttggcaaaaatcactataaggcagctctaaatttgccttgataagctaaataaattacttttataacttactaaagcagaacaaacagtgaaactttctaaaatattctatctggaatagggacaggggatcttttatttataatctcatcagatgagtgagttgttcacagatattttatgtttttttaattttctccaagaatatttatagaattccaaagaatcagaatagtttcaaaataattttcagtgataaaagagtgttgtaattaatcatattacactaaaattgggatacatctaaggaactttatcttactatcagtaggttttgcattgatatttctttttaaataaactactagttctttatattttgacaaaaagaacttaaattttatcaggaactgtaagataaatatctagtgcttataaattttctgtccttaaatttatgtgacagtgcaagatacttttgctcttttcatttaatataggcatcttccattgacattaataaaacttagaaacagtataattagtataacatttactctgaatttgaagatttcctgaaacaaagtttgtacaagaagcccaccttggaattctgaaggcttattttcttgtttgataagcttttcttttaaacttaggttttaagttggggaaagacttaattaactaatatagtattttctaaggttgatcatcttataccacgaatcgttaattttgacagttctactgatccgtaaatgataaccactgcaaattttttcagtataaaatttttcactgcaaaaaaatttcagtagaaaataaggatgcagggccagttacaatagtccttaagagagttaaattatagcacatgttttgacattgtaatatcttttactacttgaacatttaaatttctaaatgagaaaggtatatatattactgtaactgtagaagggaaaagggaaagtatttggttctaaaaaatgttagccttcctcgtaaaagtagcacaagcccacttatgaatcactgagaaaaagtgaaaaacttgagttggcaaagatgcagagcagcagtgcagatggcaatgaactctctgaattctcttttaccttatttagaagaatgcagagtaaagggaccttcttggttctgcaggaacttctcaagggatgaggagacagaacccctacttccaagtgctctatttgtattacccagatgactgaagcttaagagaaggcagggaagtatacaagcagagccagttctggtacaaacaaagaatttgacagggacaatggaagggtcttcttcaccactccttaccttctatgtgatggaaagactagagcttataaaagtacttccatttttttattctcctgaataccaaaggcaattaaagtcagctacaaatgacttgccagtgtcatgttttatttttgttatagatttttaaattatttccttcaagatcaattcttatcccatataatgcttagcttccaagaatattctttactttcttctgtcttttacagctctttgcattttgtagaccttaatactcaggttaaatattcattgcatttataagatcttctgcaaaaagcccagaaatggtccttttcaggtgcctcttcaaagagctgacaccttaccttgtgcctttggcacaaatgtgcagaatagatacatcagttggtgcataatcgaaaaaaataggaattttgaacactgttcttccttctacatttatttctcttcattttagaatcacactttttatgttaaaccagattattattattattattattcaaccagtattaagttgttaaaaccaagggaatggggccctaaccaaaaagaagtctcaactcagaaaaataagtccccagtcaggtggttcttactttcttgtgggttgcacattttgtatctctctaacatcagcgtattcctgactttaagcaggtgtttatatgtaaaataaaacctgggtatcgaagggaaatgcattctttttatggagtattgaccctgatcctctatgatgtcatatagagcaactcagggctatacttgctagattttaaccaagcagtttgaaatattaatcatcatcctctcatcttctccactctccattgccaaagtctttgtcaaaactccaaatttgttgataaaagattgtgtttgccattctcatttataatgcagtttctccttaagcctggagttttttgaatgagtgcatgagtaaatgagagaatgtgtgaacgaacatttatgaagtatctaacatgtgccaagcattgtgcctggcactttcaatcattagaatgttttatgtgattccacagcattttctgtatgagagtagctcacaacattttaaatgtttccaatatgaatcgtgttacaaaattcttaattttatatttcatataaattaaagaggaaaaagaaaaggtttataatatattttaaaacaatgtgttactgtataatacaactataattgtagttaataactaaaacctcttgaaaatgtcaaagaaatacttgatttctgatgcaactttgactaaaatatttacttt

SEQ ID NO: 38247 - DNA, 109554 bp, Homo sapiens
cggcggagtggcgagaggcgagaggcggcggaggcggcggagctggggggggtgggaggggggggagagtgagtgagtggcagagtgagtttacccctatgagactgtgagaggcccggggcctacctcaaaggagcggggtcgcgaagctagctagcagcggcccccctccaggtccccgggcccggcggcgcggcggcggcttggttgtgaagaggcggggaagcgggtgtccggtccccgccatggagggcatggacgtagacctggacccggagctgatgcagaagttcagctgcctgggcaccaccgacaaggacgtgctcatctccgagttccagaggctgctcggcttccagctcaatcctgccggttgcgccttcttcctggacatgaccaactggtgagccggccccgcagtgccagcgctggcagcggcctcgggggccccgaggggaagggaagggacacttgagcttggcggcagggcgagccaggcgggtactgagggccaccccttcccgggacggggaggacgagtcggggagccccgtgggcatagggagtatttgggggctgagcagggctaaaggagagttagggaccacggaggcaggaggggcggaagggagatggtgggggcgagctcctaaggtttttcgaggattaggggccaagggacgtgggatgaggggaaaagacttgggcatccaggcatagtgggtagacttgggaggaaaagggttatggtgttggctgagagtaaaaagcacaggagatctggatttggggagtggggaaaaaggttggggtttggagtgaggggctgaggatgccaggattgggcggaaactatagggaaggattaggtgctgtggaacaacctgagcactggagagcttgggagttaggagctgagaacagattaatttatgtgtctgtctctttccatctgaggatagatagggaaaagggggtgatattatgggggaagacaagggggtatggtgagggagatgactttcttgagagttatgccagggaggagtaggatctactagtaaatcgacacatggaggacccggagtgttagacttgggacagggcctgggaaccaccttaggaaaagtgggggaaatgagatgatcttgggggaaggaactttctgaagggacaggactcctggcagagggttcatctggggtcaccagaatgctgggaatggagaggggcttatctgaaagaaagctaagttgacagatgtttgggaaaatggagaacttaggctgggagccaagtatttttggcttcaccttgtagaaggctgaattgggacagaagactacccgacgtaaaggagtgtttcttggctttggaagtagcacttgctgtcgttgttaagcaacgcttccccttgtactctgaatagaggttgttggattcactcagaggcagagttgcagtggagacgattagactttctttgaaaggatttcaggtgaagcaactaatatttctttgggcaaaaggcaaaaggttcagtgccctttgctctgttgggcattcagtctcctgacatgtggaatcttgtttctcttggcatcacttgcacaaccaacctctcttttattccttatccactgaatgcctcaagcaacgctggaaaagaggctgtaagcctactttttatcccactcctacctagttctaccctggatgatgctcatctattagtaggagtgttgtagccgtggctgcaccaaaggtaatgtgtaaatttttttttttttttttttttgagacggagtctcgctctgtcgctcaggctggagtgcagtgacgcaacctcggttcactgcaacctctgcctcccaggttcaagcaattctcctgtctcaacctccccagcagctgggactacaggtgcacaccacctcgcccggctaattttttttgtatttttagtagaggtggggtttcaccatattggtcaggctgatcttgaactcctgatctcatgtgatccacccgccttggcctcccaaagtgctgggaacaggtgtgagccactatgccccgccattttttttttctgtgcatcatctttgatgggtcctactattttatctttaaggtcaattattacagcaagagcaggtttaaatttctagatgtttagaaaactctttgactggatgcaggagatagtctttagaattaatcatttgtaatctccatttgtatctgttacgtctgatgatctcaagcagggaatatagcctactgtagttttctgacagctaacctgtggtgtttagtcagagagacatgggttattgaacacactgagaaaagctattactctggtgaaatttagaagtaaagttatatcttgaagagagttctcttgcctgactgcttcccacctctggctctttttcttccttgtttacactagttcagcataggaaacttggcatattgttgctgctagtttggtaggagaggatcattatttctcccaaccccttgtgaattggaccatttaaacactaccctagtaagttttaagttctttagagtcagtctttattagtataattattatggctacaaaagcagtgtaatgaattttatatgtttgaggtatgtatttaatgtctaagatttttcttaggtgttgtggaaagtgaataggtgaggcccagtgtggataagaaaaaaaataacttaaaaggctgcacgcctataatcccagcactttgggaggccaggtgaggcaggaggatcacttgagtccaggagtttgagaccagcctgggtgacatagtgagatcctgtctctacaaaaaatacagcgaaatgagtcgggcttaatggtatgcacctgtagtaccagctacttgggaggctgaagtgggaggatcaccctgggaagctgaggctgcagtgagctgaaatcgcaccattgcactctagcctgggtgacagagtggtgagatgctgtctcaaaaaaaaaaattaaaaatatagttggattataaaacttgtatttgagggaggctgagacaggagaatggcgtgaacccaggaggcggagcttgcagtgagccgagattgcgccactgcactccagcctgggcaacagaccgagactccgtctcaaaaaaaaaaaataaaataaaataaaacttctatttgagtttttatataaaaaacttatgctcaaagccatggagtagcatatatgttgatgacatgttatttctgtataaaaacaagttacatatatgagcaaaggagtgagccgttaagaaaatgtgttctgggccaggtgtggtggtgcatgcgtgtagtccccagctacctgggagcctgaggtaggaagatcacctgagcccaggaggtcgaggctgcagtgagccgtgatcatgccactgcactccagcctgggcgacagaataagactctgtctggaaaaaaaaatgtgttctggctttagagaaattgagaagttggaagtcagtagcttcttagaaatccatgcagttaagtgataattcaactttaagtcacattaccttattttttggctacataaggcatgttctttattttctttgattataaaatgaaaaatcatttgtgaactaaaagcaggaaggcttttcatttttttttcttatgaaagatagcgtcataatctaatactgtatttttgattcctatgtttacctaattcatcttgacagatttttattttatttttttgagacagggtctcattctgtctcccaggctgaagtgcagtggcacagctgtggctcactacagcctcaacctcccagattcaagcaatcctcccacctcagcctcttgagtagctgggactacagatgcgtgccaccatgactggctaatttttttattttttactttttatttaatttttttcctttttctcatgtcagacgggtaatgtgcacgttatataacaagattcaaggttggcacgtctcatacatgcatgtaaacacccaatcatcacgcatctgaattacaaaaggatcaatttaaacatttttttagagatgggtcgcactatgttgccagacctagtcttgaactcttgggctcaatcttgccttagtctcccaaagtgttgggattatagacatgagccactgtgtccagccaatatttttttttcaaacaaacatccatcataattaatgaaatctaggtaaatacatatacacataatgtgcatgcatgcatacttaatcacagtatttgtgtgtgttgcccaagtaaaaatctaaagtctagacgtgttgttctacgcatcatttaatttctaactgggcaactgttgacatagtcctaatacaggttgacaaaaaaatctctcaacttgctctgatgattaacctgttgaattgaagatgattaatcttcctatgacttcataagtgcctgcttcgggttgtaataaataccattcagttgtctattagaaaataatgtggtaaattaaaaatcattattgaaaagcgaagaccctgagtcttctaaaattaaacctgtctgagtgcagtagctcacgcctataatcccagcactttgggaggccagggcagtaggattgcttgaacccaggagtttgagaccagcataggcaagatagcgagacctccatctctacaaaaataaaaaaattagctgggcttggtggtgctcacctgtagtcccagctaagtgggaggctgaggtggaaggatcaattgagcctgggaggtgaagggtgcagtgagctgtgattgtgctgctgcactcctgcccaggtagcagagtgagaccctgtctcaaaaataaaataaaagtaaaacctgagttggaaaggttatgcttttgtgatcaaaagtaagaatttgtcatttttgaaaaactgactaaatggaatgttttggccttgtgagtcttttaccctgttaacacatattttgtttggtcttaggttgacaaaattgtgtagatacttctttttttttttgagacagagttttgctctgtcgcccaggccggagtgcagtggtgcgatcttggctcactgcaacctctgcctcccgggttcaagagattctcctgcctcagcctcccgagtagctgggactgtgggcgcccacgaccacacctggctaatttttgtatttttggtagagacggggttttaccatgtttgtccaggctggtctcgaacccctgacctcaaatgatccacccaccttggcctcccaaagtgctgggattataggcgtgggccaccgcacctggcctctatttgttaaatttagaaccaaatattgttttcagttgagcatgtttgtagcatttatacctgagctggcagccatgctgctggagattgatggaactgtctgttaacagaagtagtcaattttcagttcctaagtgagtatgtaaagtgaataaatgatatggtgaaagtaaacccaatatctaaaaccaaattgaaatgacttgtagattaatatctgcagtgttctatagatggaatgtctttcagagatactattgggctgtgaatacagaacttggaattgtaaaaccggaaactgacttaagagattctttagtttaggccaggtgcagtggctcacacctgtaatcccagcactttgggaggccgaggcggacggatcatgaggtcaggagattgagaccatcctggctaacatggtggaaccccgtctctactaaaaatacaaaaaaaaaattagccaggcctggtgacgggcacctgtagtcccagctactggggaggctgaggcaggagaatggcatgaacccaggaggcggagcttgcagtgagccgagatcacgccactgcactccagcctagtttattccaacttttcctgtagatttgcatccagcccttctaagatagccatctgtcctattcttgtatccctacgggcagagatttgcatgataccttattataatgtttaattactttctggttagaattatgtttaaaccttccttgctacaatttaagcctttttcgtttgtgtttgtcctccttggaggtggaggatatctaataaacactctgttaagaggccagaacgcttctattaattgaaattactaaaagttttcaactatgtaaaatttaaacatgttcaatttaatgggttcatattttttaatgtagtctaattggcttttttttgatgggaaaccaagattcagaggagagcttacctcactttttaagaatttgtggtaaaatatatataacaaaatttacccttttaatcaatttatttatttatttatttatttttaatttttttttgagacatagtttcactctgtcgcccaggctggagtgcagtggcgcaatcttggctcactgcaacctctgcctcctgggttcatgcgattcttgtgcctcagcctcccaagtagctgggattacacgtgtgggccaccacgcctggctaatctttgtattattagtagaatcaaggttttgccatgttggccaggctggtctcaaactcctgacctcaggtgatctgcctgcctcagcctcccaaagtgctgggattacaggtgtgagccaccatgcccggcccgcattttaatcagtttaaggtgtacagttcagtgttacattaggtgttcattgtaagttgtttagcattagtaacaagagtcaaataactcttctagatttttatacattaacttaggagttaatattggccttatttctcagtatagcagtagataaaatatcttttaatagcatatagacaatgtttctctacctcctattaggctactgctgtgcagttgtggtattgcaacatcctaggttgcctgcaggtatcttcagggagcagtgtgtatgttttggaattctacttgcatccaccatggatggaacagatgttttctagaaaagtaacttgggaaaaatatttctgtaaaatatgatgtcctattaattttctcaacattgtcagaaacaccctactagataaagatataaccacaaatcaatgaaatgaaattagaatctagatatgaaaatcagttgtacctcttacctgatcacgtattaccttctttgcctgttaatccatttctcagtcacccgtgctaaatgagtttctcatctatgctgtggtttatatgtataaatctaggaaaaagttcctttatgatagagataatacttctattaatattggtttccttaaataaatgtgtgtcaaatagtagttttaggaagagggtaaggaagggctacataacagtgatagagtattatgtactctattacattttttaaaaggtttttatttttgatttggaatattgttgatttttaaagtaagattgtgaaattgataccatgtaaaattaactattttattttcatttatttaattttaatttttttagagacgtctcactatgttgcccaggctggagtgcaatggctgtttacaggcatgatcatgtagcacactacggccttgaactctgaggctcaagtgattctcccacctcagccacctgagtacttgggattacgtgtgtgcagtactgtgcctggcaaaattaactgttttaaagtgaacagttcagtggtgtttagcgcattcacagtgttgtgcaaccaccaccactctcttgtttctaaactttttcataaccccaaaatgaaactttacacccattaagccggtgtaaaggactattctctcctcagccattggcaaccagcagtctgagttctgtctctatgtatgtacctattctggatattttcttttcttttttgagatggagtttcacttttgttgcccaggctggagtgaaatgacgtgatcttggctcgctgtaacctccgcctcccaggttcaagtgattctcctgcctcagcctcccgtggatacgtcatgtaaatagaatttgtccttttgtgtctgcatcttgttgttgttgttgtcgcccaggctggagtacagtggcgtgatctcggctcactacaacctctgcctcctggattcaagcgattctcctaccttagcgtcccaagtatctgggattacaggcgtgcaagatcacgcctggctaatttttgtattttttgtagagatggggttttgccatgttggccaggctggtcttgaacttctgacctcaagtgatccatctaccttggcctcccaaagtgctgggattacaggcatgagccactgtgcccagcctttttttttggtttcttttaatgaagcctgtaagtttcttgccatggcatctttcatttagcattatgttttcagggttcatccatgttgtagtatgtatcagtacttcattttttttttttttttttgagacagggtctcattctgttgcccaggctggagtgcactggcgctatcatggctaaccttagctttgactcctgggctcaatccatcctcccacctcagtctcccaagtagctgggatataggcatgagccaccatgcccagccagtttttgtgctttttgtacagacaggattttgccatgttgcccaggcttgtttagaactcctgggcttaagggatccacctgcactggcctcccaaagttttgggattacaggcatgagccaccccccaacccccacccctggcctcactctttttttatggcttgatagtattccattgtatatacatatcacaatttgtttcatctgttcattcgttggtagacatttggggtgtttctatcttttgactattctgagtagtaaagttttgaatatgtgcgtgtacctgtatttgtttgagtacctttttttagttcctttgggtatgtatctaggaatggaaattttgggtcatatggtcaatctgtttttgaggaatcaccaaactcttttccacgatggctgaatcattttacattcccaaccgcggtgtatgagttggtcgcaatttctccacatctttgccaacacttgttatttttctttcttcttttaaacttccagtttaatggaatatatattttataaatatatatatatatatatttttttttttggagatggagtcttgctctgttgcccaggctggagtgcagtggtgcaatctcggctcactgcaacctccatctcctggattcaagtgattctcctgccccagcctcccgagtagctgggactacagctgtgtgccaccacgccctgctaattttttttgtatttttagtagagacggggtttcaccttattggccaggctgtctcaaattcctgaccttaggtgacctgcctgctttggcctcccagagtgcttggattacaggcgtgagccaccacgcccagccaatatttttctttttaaaactatagccatcttagtgggtatggattggtaccttattatgattttgattcttatttttctaattactaattatacgaacatatttttatgtgctttttggccatttgtatatcttctttggagaaataaccatttaagtcctttgtgcattttctttcccccacccccaggggaattttgttgatggctctagtttattccctcccaaaagaccaagagcaaccagatggagtgaagttaacttcaggattttattgtcttcataataaaataaaagatgacatttagaactgtatcacttggtcctttctcgtcttatcgcctcccagttcaaaatgcttgcatgtcttagaagctagcattcttttacatctgcagttgggttccatgcactctagcctcagcacaatcttctttatagttttaacctttttctgggaaattggcttagtctgcccaccatagctaccctgcttcctgtcataatgctgctttctgcaagctccgccttccgggttcacgccattctcctgcctcagcctcccgagtagctgggactacaggcgcccgccactgcgcccagctaattttttgtatttttagtagagacggggtttcaccgtggtctcgatctcctgacctcgtgatccgcccgcctctgcctcccaaagtgctgggattacaggcgtgagccaccgcgcccggcctgcctttcttatactgtatcactttgtggggttggtgtttgccatacttcttatagaaagtctggtggcttttaggaatgttcattatgtttgctggagcactgtcagcgcaaaaaggctttgcccatttttaaattgggttgtctttttgttgttcagttgtaagaagtcttttttttttttctttgagacggactctcactctgttgcccgggctggagtgcggtggcgcgatctcggctcactgcaagctccgcctcctgggttcacgccattctcctgcctcagcctcctgagtagctgggactacaggcgcccgccaccacgcccggctaatttttttgtatttttgtagagacagggtttcactgtgttagccaggatggtctcgatctcctgacctcatgatccgcccacctcagcctcccaaagtgctgggattacaggtgtgagccaccacacctggcctgtaagaagtctttatatattctggatatgaaatccttattgggtatataaattgcactgttttctcccattctgtaggctgtcttttcactttcttgacaatgtcctatgattcacaaatgtttctaatgtgctgaggtccatatcaattctttttttctttgcttgtgtttttgatgtcatatcttagaattcattaccaaatccaaggtcatgaagatttatccctttgttttctgctaagagttttatagttttagttctttatatttaggttgttggtccattttgtatatggatatccattttgtataattaatttttgtgtatggtatgaggtgggaaccagcttgattttgtggagcttaattttgatcatgtttctgctctgggactggcctctcattagctctgtattaaatatatcctttacttttagtaaatatatattttattctcttcagccatcactaaaagttgggcagaaaaaaagtgtgcaggattttctggttggggcaggaaacttatgaatgttctgttggcattcaaaactagatgtgtttaaaaggtcaatttgccaggcgcggtggtgcacgcttgtagtcttagctacttgggatgctgaggcgggaggattgcttgagcccaggagttctgggctgtagtgtgctatgccatttgggtgtctgtactaagttcgatatcagtatggtgatctcccgggagcaggagaccaccaggttgcctaaggagggggtgagccagcccaggtcagaaatggagcaggtcaaaagtcccgtgctgatcagtagtgggattacatctgtgaatagccactgcactccatagcaagactcagtctttaaaaaaataaaaaatcaaaaaaattaaaaaataaaaataataaaaggtcaatttatccttttccttactccagccagtttttggtctcccagaaattagacttgaactgagttatctttaaggccctctcttttctggacaccccagttcatttgctaaatccagttaatttccacctggatttgacagtgtacttcccaaatgtctctttttttccattcccactgccaccgccttagtttgcagattatgttactagtttaacagagtaacataggcatagtccaaatcggttttctacaagtggctttcttccttccagtctattttgtggacataccactgctagatcagtctttctaaatcacagcttcaatctagacccttcttagaaacctctaacagggccttgttgcttcccagatacagaacagcaagctttagcttgacattcatttaggaccctgcaaagactggtcccagtttacctacttctacctttcctggcgtatctttgtagtgaatattctgcttttctctgctgtgttcaaactaggctgctgctcattcccacgtaaacttttgctctcccaattttaaacttgtttctcctacttagaatgctattctttcctttctacctgaagaagtcctatcgtttttctgaaattgacatactgatcctgttcttagcagtgtactcttctttgaactccactctttccttttttatagtgtttattatgtatagaaacacacttttaagaggacagtgccccctaacagcctttgtttctccctaagcctcttacgcactactttgtacataggtgctcagtaaacatttgttgaagtaatgtgtaagggtagatgggagaaaaggcttaatttttttcttatgcctatgttactcagtaatttagatgtgaatggacaaaaatattttgtaagctctctaaagttctcttagatcattgccattgtgtttccattgaggaaaaactttaaaaagtcatataagcgcataataagttcaaatagtttagaatagtttaaacaggggttgcaaactaatatatgtttaggtgccagatgggtaacaattgaaggtgtgtgaactggaaagccttgcctttataaagagcatgtctgatatttgccttaaatattgccctgctagaatgggggtccagtgttagatttttctattttttttcaagagaagtaaaaaatataggtttttataggaaatgtcctggttttttgtttttttggggggtggggtacagagctctgtcacccaggctggagtgcattggcgggatcactgctcactgcaacctcccctcccccatatgcctccctgggctctaagtgatcctcccacctcagcctcccaagtagctgggaccacaggcacctgccaccatggccggttatgtttttgtatttttagtagagacagggtcttgccatgttgcccaggctggtctcaaactccagagctcaagctgtctgcccaccttgtcctcccaaagtgctgggattacaggcatgagccactgtgaccagctgaaatatcctgatttttaaatgttggcaattaattcaagtatttttaaaacactgaagaccaaatataaagcacatctgcaggcagaatgtagcccttgggctactcatttgtaacccctgtactaaagatgagaagtataaacccctcctgtttccagatatagccactgctaacaatttcttcagacctttctgtgcattatattcggagctgagattgccccattgcacagaatattctgtgcaatatgtatatatatatatgtatatatatatatatgtatatatatatgtatatatatatgtgtatatatatgtatatatatgtatatatatatgtatatatatatgtatatatatgtatatatatatgtatatatgtgcatatatataacagaattttctatgcatgaatatgtatgtaaaattatatatataaacctttaaacagctgtggttattgcttttgattgtctttgctcttcagggtagtagataacaaggcccttatacctccattgtttgagtgggaactgaatttagttgtcaaggtacttggataggctgttcatatatacatatatatacacatacacatatatacaaatacacataaacacacgtgtgtatttatatgtgtgtgtgtgtatatatatatttttttgagacagggtcaaaaaggtaggtttttataggcaacgtcctgtttttgttttttttttgttggggtaacagcaatcctcccatctcaacctcccaaatagctgggactacagatgtgtgtcaccatgcctggctaatttttaaaatttttttagagatggggtctccctgtgttgctctgactggattttttttttaactttattttttttcacatcagagaaataatgtgccaatgtcataacaaggtttgagggagggcacgtgtctcacataagtgtgaacactcaatcatcacgcttatggactacaaaaggatcgatattttaaagaattaacaatgtgctgggtgtggtggctcatgtctgtaatcccagcactttgggaggccgaggcaggcaaattgtgtgagtctaggagtttgaggctagcctaggccacatagggagaccccaactctacaaaaaatacaaaaattagctgggcatggtggcgtgcacttgtagtcccagctacttgggaggctgagatgagaggatcacttcagaagacagagattggctgggcgcggtggctcacccctgtaatccctgtactttgggaggccgaggtgggcagatcacgaggtcaggagatcgagaccgtcctggctaatatggtgaaaccgtgtctctactaaaaatacaaaaaaattagctgggcctggtggcgggcgcctgtagtcccagctactcaggaggctgagggaggagaatggcgtgaacccgggaggcggagcttgcagtgggccgagatcgcgccaccgcactccagcctgggcgacagagcgagactgtctcaaaaaaaaaaaaaaaaaaaaaaaaaacagaggttgcagggagctgagattgccccattgcactccagcttgggtgacagagcaagaccctgtcttaaaacagacaaggctgggcgtggtggctcatgcctgtaatcccagcactttgggaggccaggcgggcggatcatgaagtcaggagttcgagaccagcctggccaacatggtgaaaccccgtctctagaaaaaaaaaaaaaagtaaaaaaataaaaatataagaattagtggggtgtggtggcatgcacctgtaatcccaactacttgggaggctgagtcaggtgaatcgcttgaacctgggaggcagagttgcagtgagctgaggtcgcagcactgcactccagcctggaagacagagcaaggctctgtctcaaaaaaaaaaaaaaaaaaaaaaaaatgtagtggtggactttggtcatttgaaatatagtaaaatcccttctgattaagcaacaaattcttacccagtaattatgtataattttattaaaacttagttttgctttgttaataagtaaactatctagtagtaagctcgtctgacaatattatttacaatattgttggagaacaagaaacccaaaatgcaacaggactaaaactgaaaaggtttaactctttatttttatttttttatttttaaaatgagacggggtcttgctatgttggcagactggtctcaaactcctgagctcaaccaattctcctgccttggcctcccaaagtgctgggatttcaggcatgagccgccacacccggtgaaagggtttaaactctttctaaatcaccttgtgcagagaagatgaatacgtttttcacttgttggaagggtaattgatttagtaaatggtgttctcatttgccaaagttaatgtttgtcttgggagggggggcagtttattcccaaatatagagggtcagccccactatgtattgaggtttaaaaaacccaccttttaaaatgaatagttgtgctttttttagtgtgttttgagcctgaggtctgtcaagtgtttctgagggttcacacttgaattattgtgcttgaggtcagtgattcataagaggtcagcctcttatgaagcaaccaccttctaatgattgattgaatgatacatgatgtgcttctaaagtgctttctggtcagcattttattttctaaagtaaattttattttttacttttttttttaaaccctttgataacaggccttgagaagagtggaaaccactggctgggggttggggtttgcatgcaactgtgacagggaagccctaccttatttttaaatttttaaaatgattgtatttttttatgacataaacagcacttgtccttcaagttgcctgcttgggtctcttccaggtgtactttttctttctttcctgttctaaagccttttaaaataaactttcactcctgctctgaagaaaaaaaaattgttaggatccgaatgttggcaaaaagttaaaaaaaatagaaaaaaatataaaaataaaaaataggccagtcgtgatggctcacacctttgggaggccgaggcaggcagatcacttgaggtcaggagttcgagaccagcctggccaacgtggtgaaaccttgtttctactaaaaatacaaaatttagccaggtgcctgtaatcccagctactcaggaggctgaggcaggagaatcacttgagcctaggaggcagaggtttcagtgagccgagatggcgccactgcactccagtctgggcagcagagcgagactctgtctccaaaaaaaacaaaaaaagacatgatttatgttcattgcagataaattagaaagaactggtaaacaaaacaaataaacaaaaaaataagcgataataatgggacccagagataaaaatgttaaccttttgttatatgtatattctaataacatattttgtgtgtgtgttgtacttgtgcttgctttataaaagtggggcatttactatattctagatactgttttaagtgatttatatttaatgtataatttaatacaataattctaggaaatgaatattgtcatcctcattttttacaaaaggaaaagaggcttagagaggttaaataacctgaagtcacatgggtggaaatggaattcaaacataagtagcctgtgcttctgattactgtgtttcacacattgtataagtttcctagtgttgcttaagaaacaacacaaactgggtggcttaaacctacagaaattaacttccttatagtttgagaaactagaagttccaatttgagggtgttagcaggtccatgatccctctgaagtttctagggcagcatcccttcttgcctctttttggcttttggtggctccttccaatctttggccttccttggcttgtagctgtatcactctagtgtctgccttattagtcacatggctttccttgtgtgtctccaaatctccttccccttataaggataccagtcagttggatttaaggcccaccctaatcttgtatgacctcatcttaactgattacatctgcaaagaccctatttccaaataaggttgcattctgaggttctggatggacgtgaattttggggagatagtgtttaacctattgcacaccttgttgtgtaatctgttcttcactgaatgatataaccattttcccagtcttaataaatataattcaacactttaaagattttgtagtattctattacatagatatgattaataatctttttgttggatatctagattgtttaaaattttttttcaatataaattcagtattgaacatttcttgtagttaaatctttgcttgcatccctgtttccttacaatttattcctagaattagattgctgggctgaggattgctgggctaaatataaacatggcttttaatgctcttaatacttaattgccaaattgtcttacacctcataaagattggacgcatttgtatttctgccattaccgtaacaagtgagtatttctttgaccatctcatcaatgtagcgcataatatattttttttccaatttcataggtaaaaaatgtgatcctgttttaatttgtattttgccatttcttttttttttttttcctcccaatttttattttagattcggaggtacacgtgcaggtttgttatatggataaattgcgggtcatggggtttggtatacagattgtcgccaaggtaataagcatagtacctgacaagtagtttttcgatcctcaccctcctcccaccctgttttgtcatttctcatgagtactttcatgtgctaaaggtctgttgtatttatcttatgaatttactgaacttgcacttttgtcttttttccatgaagagctttaccttgggaaatgaaatttctttctttctttctttttttttttttttttttttttgagacggagtctggagtacagtggcgtgatctcggctcactgcaagctctgcctcccgggttctcgccattctcctgcctcagcctcccaagtagctgggactacaggcgcctgccaccacacccggctaattttttgtatttttgtatttttagtagagatggggtttcaccgtgttagccaggatggtctctatctcctgacctcgtgatccacctgcctcggcctcccaaagtgctgggattacaggtgtgagccacctcgcctggctgaaatttcttttttttatactcaattgtaaaagtaataatgttggatataaaaacccaacaaattcagaatgaagccctatcggatagtactatgctcattttctgagtgatgaaatcatttgtataccaaaccccagtgacatgcaatttacccatgtaacaaacctgcacatgtttgtactccctgaacctaaaataaaagttgaaaaataaaaataaattagagccgggtgtggtggctcacgcctgatatcccagcactttgggaggccaaggcgggtggatcacccaaggtcaggagttcaagaccagcctgaccaacatggtgaaaccccgtctctactaaaaaatacaaaaattagccgggcctggtggtgggcacctgtaatcccagctactcgggaggctgaagcaggagaatctcttgaactcaggcggaggttgcagtgagctgagattgcaccactgcacttcagcctgggtgacaaagcaagactccatctcaaaaaataaaattaaaaatgtgaaattaggtaatattaaatatgtcaattctcaggccagacacagtggtgcacacctgtaatcgcaacacttttttttttttttttttttttggaggcaggatctcactgtcactcacgctagagtgcagtggtgtgatcacagctcactgcagcctcgacctcctgggcttaactgatcctttgacctcagcccgtcaagtagctgggattaaaggcacgtgccaccacacctggctaatttttgtattttttgtacatagggggttttgtcatattgtccagactggcctcgaactcctgggtgcaagcaatcttcccacctcagcatcccaaagttctgggattacaggcatgagccgtggtgaccggccctgttttgtttttaataaatggcattatactttggggaacaacaacaacaaaaaacagtaaagctgcttgtaatactaaaagctaataacttgtcagtgtgtgttcatatatatagctactcatatgcatattatatatttcaaattggagtataatcatggatacatactgctttatagcctactttttaacttaaatatattatagttatctttccatatctgtttttcatgactcctaacgtcccattatttgagtattctgtaacttcatcagtcatttattgtttttttcactattataaatatttctgttcacttgcttaattattttcatctctctctctctttttttcctttgagacagagtctccctctgtcacctaggctggagtgcagtggcgtgatctcagctcattgcagcctccgcctcctgggttcaagtgactctcctgcctcatcctccctggtacctgggattacaggcatacaccaccatgcctggctaatttttgtatttttagtaaagacgaggttttgccatcttggctaggctggtcttgaactcctgacctcaggtaatctgcctgccttggcctcccaaagtgctaggattatagatgtgagccactgtgcccagccttcaattcttttttttttttttttttaattgtgacataaaacccatgtatttatttggggcaaattccgagaagcggaattggcaggtcaaggtatgcccttttgaaggttcttgataaacattgccagattgcccccaagaagtatgtaccaattaattttaacaggcagtagaaagcctgattttggataattatgtttttatctttaccaggtagatttatctgatagataaaaggtgttacttgttttattttgtgtttccttgattgctggtgaagtcttatttcttttgtgtgtgtgatggctatattttatatatgtactgaaatttttattttcaaagaaagtatgtttagctgggcgaggtggtgtgcacctgtagtcccagctacttgggaggctgaggcagttggatcacttgagcccaggaggtcgaggctgcagtgagctgaggtcgtgccactgctctggagcctaggtgacaaagtgagaccttgtctttaaaaaaatctctctctctctatctttgcatatctacctatctagctagctagctagctagctatatctatctatctagctagctagctagctatatctatctgtacatataaatggagagagagaaagggtcttgctctgttgcccaggctagagtacagtcctagaatcatggctcactgcagcctcaacctcccagactcaaattatcctcctgcctcagcctccctagtagctgggactacaggaatgtgctgccatgcccagcatttttttttttgtagagacaatgtcttgctatgttacccaggctggtctggaactcctgggtgatcctccacctcagcctctcaacatgctggagttactgggatgagctacctgtgcccagctctatatatactgttctcaaacttgatttttaaatttcacagtatgttatggatagcatgttttttgttttctgtttttgttttttgactggatgcattggatgtccattgtggttggtcatattttatttaaccactactttgttgatggacaagagttttgctacactcttaaccaactgaagagttatctgtatctttaccttccttgttgctggcctggtgggttaaaatgtattcattttaatttgtttttctgtaattatgaatgaggttggatatctttccatatctttattggccttttgtatttttctataacttgtgtattttcctctctacctctctcagattgtcattctttccttcattgatttatgtgagctgtttgtatattaaggaaaatagcttattagattcttatggttcctccagtttgtctcgcttggtttataatgttttttactatgtggcactttttgggtgaatttttatgacattgactccagcagtcttttcctttttgatttctgctttaaagtgcagcagcggtgtggcggggaggggcagtgggagggggagaaataattctttccctgttatataaaattcacttctgttttctttatgactgcacaatttacatataaatattttatatagctgaatttttttcaatgttagtaccttaacatgttttccagatgattagtcagttttcccatttattgaaaaatgtacatttccctgatgatttgaaatgccatctttatcatatatcaaatgcttatatatatttgggcttgttttgcaccttttttgttgttgtttttgctttttatttttttgagatggagtcttgctttgtcgcccaggctggagtgcagtggcgccatctcagctcactgcaacctctgcctcccaggttcatgtgattctcctgccttagcttcctgagtagctgtaatgacaggtgcccactaccacgcctggctgatttttgcatttttagtagagacagagtttcaccatgttagccgggctggtctagaactcttaacctcaggtgattagcccacctgggcctccgaaagtgctgggattacttgcgtgagccactgcgctcggcctgtttttgcacttttttttgagttgcattggtgcgcatgtccagttattcagggcctcagtcagaatttaattaaaaaaatttttttgtgtgtatgtgtgtggagatggggggatctcaccaacttgctcatgctggttgtgaactcctgggctcaactgatcctcctgcctggcctcccaaagtgctgggattacaggtgtgagctactgtacccagctgaaactcagagttttaatgtgtacttaaaggtgtttttaaaggggaagtacatttccttatttaattttcattttatccaaattacaaatgtatggtttaaagagtaaagtagttctgtcagcttgttaaaagcaacaaggggttctagacctttttcttccttccttgactccccagaggcaatctgtttcaattctttcaactgatttttgggttttgttacctctctctcaattttttttaacctttaatcattatctgttgactttacacagggagataaggattttgctttgtgatagccaaagtagtggtgaagagcaaagttcaaagcctctgctgtgtgacatatggcaagttactgtctctgtgcctcagctttctcatatataacataagggcaccagttgttaaatgggaattaggtaaatcgatagtataaagatttgggggccgggcgcggtggctcacgcctataatcccagcactttgggaggctgaggcaggcaaatcacctgaggtcaggagtttgagatcagcctggccaacatggtgaaaccccgtctttactaaaaatacaaaaattagctgggtgtggtggtgtgtgcctgtaatcccagctactccggaggctgaggcaggagaattgcttgaacccggaggcggaggttgcagtgagtcaagatcgcaccactgccctccagcgtgggtgacagagcaagactccgtttcaaaaaaaaagatttggacctctgcctgacccatagtaattgtttgtttcactcaccccatttcctgttctcccattttagttatttgtaatttggctaaatcagttttcgtgtgtgtgtgtgtgtgtgtgtgtgtgtgtgtatgtggttgttactgtttttgagacaggatctctctgtcacccagcgtgtgtgtgtgtgtgtgtgtgtgtgtatgtggttgttactgtttttgagacaggatctctctgtcacccagcggcatgatcacagctcactgcagccttgacctcctgcgcacaggtgatcctcctcagccactccagtacctggaactacaggcatgtgccaccacactcagtgttgcactgtgttgcccaggctagttttgaactcctgagctcaagccatccttttgccttggcctcccaaagtgctggcattacaggcatgtgtcaccaatcttactgtttatctcattataatgtttaaatgtttatcaacacttgagccatttgtgtgcttggattacttttctttctcagcacaatattttgctgccctgagggtgataattgtcttgatttttggtttgttcagtctttttttttactatcctcaaactccttactaactatatatgtaaaatttattctcagtagtaggttatgacactgtaggtgttctgtcagttttatctttttgaagaattcttttctagaacgttggacctaccctgatctggactgggtgagctctaggtctgcacagatctcacccctggggtttcttttagcctttctttgttggaacctctgtttcctggacccaattttttttaagcttcctgaaagtgcaagagagataaaatttgaaacttttgcattctgaaatttttcttaccttgatacttagctgatatcccagattttgctggggagcagttttttaaggttgagaatatttttctcagaattttgaaggcactgatcctttgtcttgtgttttcagcggtaatgttgaaatattctgattctttgttctttgaatgaatcctgttttcttccctctctgaaaacttttggtaactttgctgtgtccctagtgccctgaaatttgacggttatgcatttcagcattcattttcttatattttgttcagctttggtgagccctttcagtctggaaactcccttctcttgttatcggaaaatttcttgaattgatcctttaatttcctctccttccttttctctgttctcctttattggagctcctgtttttcagatattggactttctggtctggttctgtaattatgttttctttttaccttttgacaaaatgtttgctttgttttctgggtgatctcagctttgtttccttcaagttgcatttttttattactttagttttgtttatttcatatttgatgctttaccataaatatattgtggttcttgactatatacacctatttaaaaaaaattttttttaaagagacaggttttctctttgttgcccagactggtcttgaactcctgggctcatgagatcctcccacctcagcctcccaaaatgctgggattagaggtgagccaccacacccggcccactacgtactcctatttaagagtggaacacaaaaagaggatttgggttgggcacagtggctcacacctgtaatctcagcactttgagaggtgagtggatcacttgaggtcaggaattcgagaccagcctgggcaatgtggcgaaacccccatctctactaaaattacaaaaattagccatgtgtggtggtgcacacctgtagttccaggttctcgggaggctgaggcaggagaacccgggaggcaaagtttgaaatgagctgagattgtgccactgcactccagcctgaacgacagagcgagactccatctcaaaaaaaaaaagggggtggaagctatgggcatgactatgactatagggtgtaactgtgggcttaacagccccacccatttcctccagggtggggcagtccctgggctatgcagtgttgtgactacattaggggatatgaggcctaactagtgggttaagcagatgtgtaacctctcctgtttttgtacatgtgtttattcctgaactgttttgggctactcattgttaaccaggttgctgctctacttttcccactgctggctaaggaagattcaactttttcaggttggctaagacattttccacttgtctacttcccagttcccttaattaagttgcctcacttgttcattttgtcctagtgaattcacgcctttttcccccatccctgtattttaggagggcttaggaagggagctgaggctaatgcatgcattcagccttcagtctttaactggaaactaaaaaggaagtactggatttgcatctaaaagtttttattctgcctttcattcttaggatttatatggttttttggatatgatgtaacattttggtatgccagttgaatgatccattaagttctaactgttattgccacatatattatacagataactttctttctccaaatagaatgaaaggctaaagaacaaactgtagatggttatctctggttgatgggattagttatttttcagtttctttgtgcttttactttatttttgctttttttgggacagggtcttgatcctcacccaggcttgagcgcagcggcgcgatcatggctcactgcaacctcaacctcccagactcagttgatacccccgcgtcagcctcctgagtagctgggactataggcgcatgccaccacacctggctactttgtgtattttttgttgcccaggctggtcttgaactcctgggcttaagtgatctgcccgcctcagcctcccaaagtggtgggattacacgcccggaccccagcctctgtgctttcactttaattcataaatttttctatattgaatatgcattacttgtataattcggaaaaatactatttgagtagagaaaaaattgctagttaatcaaatccttggatgaaagttggctttagggatcaatgtgctcatctgttacttaatcctaaatatctcaagagttgtgctgtgtcttttacctcttttaggtaatctgcaattagaagcactagttttagggggtgtgtatatcatttctccttttttttcttttcttttttttttttttttttgagacagggtctcactctgtcacccaggatagagtgcagtggctcactgctacctctgcctcccgggttcaagtgattctaccacctcagcctcctgagtagctgggactacaggcacatgccaccacacctggctaagttttgtattttttttttagtagagacagggtttcaccatgttggccaagctggtctcgaactcctgacctcaagtgagctgcccgcctcagccttccaaagtgctgggattacatttgtgagccaccacacctggccctatcctcatcttttaattttgaagattttcaaaccaaagaaaagttgagatactaacatggtgattgtgtatactcttcccatagattcactagttatcaccattttgccacatttgctttatcttttaagtacctttactgaagtataatttgcataccataagttaacctattttaatataattcagtgatttttagtaagtttatccatctgcaaccatcaccccaatccagttttagaacactttcgttactccagtaagatttttttctgcctatttacagttaatccatacccaccccccagccttgggcaaccactaatcttttttgtctctaaagatttgcctttttggccaggcggggttgcttatgcctgtaatcccagcactttgggaggccaaggtgggtgggttgcctgaggtcagaagttcgagaccagcctggccaacatggtgaaaccctgtctctactaaaaatacaaaaaattagctgggtgtggtagtgggtgcctgtaatcccagctactcgggaggctgaggcaggagaatcgcttgaacctgggaggcagaggtttcagtgagccgagattgcgccattacattccagcctgggcaacaagagcgaaactctgtctcaaaaaaaaaaaagagttgccttttctccacatttttttaagtggaaatcatataatacgtagtcatgtatctggcttgtttcacttagcacagtgtttatgatgttcatttgtgctttagcatatatcagtatatcattcatttttattgctgagttgtggtatggatataccacattttgtttacttatttatgttatgttaattagttttgtatcatctaggtgtgttaactctgaagtcagatgactcagtagtcaattttatgtatgtttgaatttatggttaattgtgaggccttcacacacaattattcatgtaattaatatttaatacacaggcagtaataaaagtaacaaccacatcgatggttctggagaccaatgtacaagttgtgtggttctggaagtcttttggctggcaattggtgggaggggtgtttgtctctgtttctcttgggcagagcctccacaacagctgccctgtcaaaagaaggcctcaggctgggcatggtggctcacgcctttaatcccagcgctttgggaggccaaaatgggaggatcacttgagtccaggagtttgagaccagcctgggcaataaagtgagaccctgtctctaccaaaaaaaaaaaaaaaaaaatagctgggtgtgatggtacatacctttagtcccagctactccgcaggctgaggcaggaggatcactcgagcccaggaagttgaggctacagtgagccataatcatgccactgccttccagcctgggcaacagaatgagactgtctcataaaaacaaaagactcatgcttgtaatcccagcactttgggaggccaagatgggtggatcacctgaggtcaggagtttgagaccagcctggccaacatggtgaaaccctgcctctactaaaaatacaaaaaattagccaggtgtggtggcgcacacctgtaatcccagctactcaggaggctgaggcagaaaaatcacttgaacttgggaggcggaggttgcagtgatccaagattacgccattgcactccagcctggcgacaagagcgaaacttcatctccaaaaaaaaaaaaaaaaaaattagccaggcattaatttttttaaatagtagtcccagctacttgggaggctgagatgagaggattgcttgagcccaggagttttaggctgcagagagctataatcctgctactgcactccagcctcagcgacagagtgagactgtctccaaaaaaagaaaagaaggtttcagagttctcacaggtagcctctgaaggcgtcttggataaggctgagtcttgactgtttttgtgatcttttgtagatgggcctattattattattttagccactttttactttttatcagtttattttaggtcttgggtggcaccacgtaacaagaaaagtaggtgttatcatctcagtctgttatgcatgtgtttatcgatttgaggggtgaacatcactgtgggctgaatgttacttgatgtgagggactattttgagacattaggatcacagatcattatatcaatatataagttgatgtacatttgaatttttacttactggctatattatgaataaagctgctgtgaacatttcacttgtgagactatgtggacatatttttaaatttatcttgggtagatacataggaagggaattgttaatttgtatggtaaggttatatgtagctttttaagaatctgctaaactgttttccaaagtaattaccattctacattcttagcagcattgtatgagagttctctcaagcttttatactttttttttcctgaaccatttgagataacttgcaaggattgtgagatttcacctttaagcccttcagcaaatatatcctgggagaacaagagcatcattctacatgactacagtactattgtcactctgaaggaatttaacatggaaacaaaagtattatctaatatatagcccatctctaaatttgttcccagaattgccctttacaaccttcctttttttaatgcaggatcttctcagggatcttatgttatctttggttatcatgtctctttagacttctatctagaacagttccttcgccttttgtgggtattctatgacattgacatttttagagtttatgccagtcggagtgtcctatgttgttggttagtcgtgattagaatcagattattttgttggaaataatacatagatgatgctatgtcttctattgcgtcacatcaggaggcatattatgttagtttgtcctattactgactatgctaaaattgaatatttggttaagatagtgtccacctgtttttctcctttatagttaataagtaatctgtggggatgactctcagactgggactaccctgttttcccaacagtcttcctctccactgttttagtatctattgatgatccttgactgagttgatactgcataggtggttgcaaaaaggttgttatctaattttgttgttccatcttcatttattgtttggcattcttctgtaaatatattaatttttaaatagaacatatcaaattagggaaggaattcatggtgaataaagccaaatttaggtcatgttttagtttaacattgtgagcctaagtgtatttgccttaccttcagccatacaggatccaaaaaagggggtattgagaaagatctccttgactttgtaaagcttgaactacataaacaccttcattcactatgtttacattatttggggatgtgtgctgcttttctgtctttgagagaccaaactttcttcaaggaagaatcagaataaactatagatagatttttttttcctctcagtttttagtatctttttctttgtaaaccagattggatagttttttttcatgtatattcgagtggctttatgattttttgatggaggggagggccactaattttactggtgataattacgcagtgtcatgtaaagaagctatttttaaaagtccttttattctggaatgcataagaaatgccatagttggatgagctgtctcaaacctgcttggttatcatctgaagagttggttgcccagaacatgaaaacattaacagaatacgtgagattgtttgcaagtacaacaggacttttacaggatatattctttaagtgttgtatcccttgtttgtgctgattagttattaaaaatgatagcattctctcacatgtcacatatttatactgtcattagtttgtaaaagaaaaggaggactgttaactctcaggcctgtgaattatcataaaatttgtttttattctttttccaagttccatctagttttagccccctatttgtaagtatatagctcttcttttttttgagatggagtttcgctcttgttgcccaggctggaggagtgcaatggcgcaatcttggctcactgcaacctctgcctcccgggttcaagcgattctcctgccgcagcctcgcgagtaactgggattacaggcatgcaacaccacgcctggctaattttgtatttttaagtagagatgggggtttctccatgttggtcaggctggtctcgaactcccgacctcaggtgatccgcctgcctcggcctcccaaagtgctgggattacaggcatgagccaccatgcccggccaagtatatagctttttaaaggtacctatataccagaaagcagccaaatatgtccacagagtacttggagatactggcagctgaatgagtagagttgggggtcagagtttaaatgccatgtggcattctttggtagtattaggtaacatgacattgtctttgcccatcatatattagaatttggctaaggtttgtttacctttttgctcttgcagagagaataagatagcatagggctatagatttttctcttagatgtatatcctagggtgcatttttctgggtgaagtatgttgatggtatggccagcattttttttttttttttttaagcatagatgaaactgaaggtactttgaagcacactgtcaggaaatctcaaaggcaagaattattagacaattgtaaagtattttaatcaaaagtgtatgcaaaagtgtggcatttcttcttaaagcctatgcatttttcactgtatgcagaaacaagaggatggaatgttggttcataattttgtttttttggcatttttttcctttttaataaatgaaggctgggcgtggtggctcatacttgtaatcccagcactttgggaagctaaggttggaggattgcttgaggccaggagttcgaaaccagcctgtgaaatgtaacaagaccctatctctattataattaaaaaatcaaaaacagctggtcatggtggctcacgcctactataatcccaacactttgggaggctgaggtgggaggattacttgaggcccagcgtttgagacctgtgtgggcaacataatgagacccccatatctctccttctctctctgtctctttttttgagacagcgtcttgtcgcccacagtggagtgcagtggtacaataacagcttgctgcattcttgacctcatggggtcaggccttccgagtagctgggactacaggtgtgtgccaccaagcctggctaattttttttttttttttttttttgtagaaaaggggtctccctgtgttgcccaggctggtcttgaactcctgggctccagtgatcctcctgtctcagcctcccagagtgctgggattataggcggtgagctaccatgcctagcttgagacccccatctctaccaaaaaaaaaaaaagataagatgagccagatgttgtggtgtgcacctgtactcctacttgggaggttgaggcaggacgattgcctgagtccaggagttcaaacccgcagtgagctgtgagtatgccactgcactctccagcctgggtgacagcacaagaccctgtctctctcaaaaaacaaaacaaaacaaaaaattgctggtattttttagaaaacagctctctgaccaggatgagatacatttgactgctgctggtttattgtaagttccctgtttggtaacaaacttttgaaaggcatgcttcattatagatttatctgatcatttcgtaactgctattttaaaccatttcctgaagtttcatgagcaacgataaaccatagacattttgtttataaagatagctttttctcagtcacattttgtttgtcattctgggactttttgggtatcatatattttcatgtctctcctgggccagtggtccagcattttcaaaaattacagttaacactgaacctagtgattgtttcccattttgggaagtatccatgacagtttaattcagggggcaacaagaatgggagttatttctaaatatgtatctttgatggcaaattgagttcttggaagcagagttattatgaaggaaatgactcagcaaaaaaacagcaccattttgatcccggtgctgtggcatgctcctgtaatcctagctactcaggaggctgaggcaagaggaacccttgaacccaggagtttgagaccagcctgggcaacataacaagaccctgtcaccaaaaaacccgcaaaaccccaccattttcattgcagtctttattctgctttcatattcatagttttttcttgttatgataaacattttcaaatatacagtaaagtagaataatacaatgtgtagccattatattagtttttggtgctgtgatacattaccacaaactatgtgacttaaaaacgcacacatttataattttagcagttctggaggtcacaagttcaaatggtctctgcactaaaatcatggcgtcatcaacactctgttccttttgaagaatcttttcttgccttttcctgcttccagaggctacaggcattccttagctcacggccctgtttctccttcttcaaagctgagtcgttcttacactgctatttctcagttctctctttaacttccctcttccactcttaaggaagtgattgcattggtttcatctggataattctggataatctccctattttaaggtcagctgattaacacccttaattcctctttgcgatataacttaacatattcataggttccagggaccgggacattattaggatgatgaaaatgttctgaaacatgatattctaaacatggtgatggttgtacaattctgtaaatttactaaaaatcattgaattgtacaattgaaatgggtggattttatgctgcataaattatacctcggtaaaattgctttttaaagagaccttagctggacggggtggctcatgcctatattcccagcactttgggaggccaaggcaggaggattgcttggagttcaaaaccagtctgggcaacatagtgagaccctgtctgtctctctctctctcttttttttaagtttaaaattttaaagacaaaaattttagaaacctttaggtgctctcctttcattttaagagtaaatctaaatttcattttcttctttgagacagggtctcattctgtcacccaggctggggtacagtggtatgataatagctcactgcagcctcaacctcctgggctcaagtgatctttccacttcagccttctgagtagctgggactataggcacgcgccactatacccagataatttttcaatttttttgtagagacagagtctcactttgtttcgcaggctggtcttgaactcctggcattaagtactcctcttgcctcagccacccagagtgctgggattccaggcatgagccgtcatggtcctttagtggtgaaatgtacttaacatttcccatcttaactctttttttttgagacaggatctcactctgtcatccaggctcgtgtagggtggcatcattagggctcactgtagccttgaactcccgggctcaagggatcctcccactgcagcctcccaagtagctgtgactataggtgcacaccaccctgtgtagtcccagcctggctaatttttaattttcttttaaattttatagagacaaggtctcaccatgttgcccaggctggaccagtcttgggctcaagcagtcctcctgccttggcctcccaaagtgctgggattacaggtgtgagccaccatgcctggcccatcttaccgatttttaagtgtactattccgtagcgtgttaagtatattcacgtcattttgcaaacaatctccaggattctttcatcttgcaaaacagaaactatgtactcattaaacaactacccactttccatgtaagtatttgacctttgtgacggacttatttcacttagcataaaatcctcaaggttcatccgtaatgttatgtgttttcagaattttcttcctttttaaggctaaataatatcccattacatgtataaatcatatattgtttatttgttcattggtcagtggacacttgggttgctttcaccatttgactcttatgaataatgctgctctgaacacgcatattcttttttagaactgctttcagttctcttagatacccagaagtggaattgctagatctgagtaagttttaacttagtgctccagcttctcttctatgtctttttcttttctttttctttttttttttttttgagacggagtcttgctctgtcacccaggctggagtgcagtggcgcgatctcggctcactgcaagctctgcctcccaggttcacgccattctcctgcctcagcctcctgagtagctgggactacaggcgcctgccaccacgcccagctaattttttttttttttttttttttttttttttttgagacggagtctcgctctgtcgcccagtctggagtgcagtggcacgatctcggctcactgcaagctccgcctcccgggttcacgccattctcctgcctcagcctcccgagcagctgggactacaggcgcccgccaccacgcccggctaattttttgcatttttagtagagacggggtttcactgttttagccaggatggtctcaatctcctgaccttgtgatctgcccacctgggcctcccaaagtgctgggattacaggcgtgagccaccgcgcctggcctcttctatgtcttttaattggctttgtaccttccattcaaactctccctagaagccattatacaatattgaactaatttggacctattatgttgaaagtaacaaacttacttcaaactagataatgataaaagggtttctttaaggatatttttatgttacacagaacccaaagacagaaatatgtttgtgcttcaggaacaactagactcaaggacttgaaatacctttaggtttctttctctgtgtgttttatctagatgtttgcagtggtcttttatctctgttgaagagagccatgactgtccagagctctcaaatgtgtagtttatagaccagatactatgagagaaactttcttagttccagttccaaatttctcagtacccccacctccatgagccaccgtgcccagcccttacagaacattttaaagaattgtagagtgtatagccttgtgcctaccacctagattccacaatggttaacatttttgccatatttgctttctttatgtaagatttttaaaaaatcatttgaaagttgtagacattttatgacccttgatctttaaatgtttctgcatgtattttttaaaaacaaggatattctcatacataactatgtactattacctaatacaataataaaacaatgccaccacttcctttcttttttgtggcagagtacttattttttattttctacttggaaaatggtatagctgctgaagacagaaggaccagttcttaaaagtaataaaattaatggatcaataaatagccaggaaacgaagagaggagaaacaattttagatgccatagggctctaagaagtgggtaaaatgttgatattaactttgtccctcctctgaatgtaattttccacaaattctttttactagttgtcttcacgtattaaagagtatctgcgagtacatttttaggttgacagtattgaccgttgcctttagcccaacttgaattccctatttgcggtcatctttctgtttcaatgaaagtcttagtttctttccaggctttaaaattcatagtagttacaagtatgtaatgtttggcccctctttttggtattccatgttagattcctctcacattgatgttggaaggccctggttaagagcatctattttgctgagcctttttccggccaaattacctttttggtcattcagagatagtaaggtcttcttgattcttggtggtacatggctttagtagcaatattattggcgtatcccaggtgaggaaaaccccttgtggttcaggataacaatgtcttgaagccctaagatgctgttgttcatgcctgataacatgggttcattattctgtttcccattttaatttgtgtccaaataaggttggtagttttctttttctcataaataatttgtgttcttttgagtttctcacttgttcagagaatggaaagaaaaggtatctagttttttttttttccttgagaatctgagctaatggcattccttctctatttctgattttttaaatttatttatttttttgacagggtctcactgttgcccaggctggagtgcagtggcgcagtctcagctcaccgcagcctcaccctcctgggatcaagtgatcctcccacttcagccccctgagtggctgggactataggtgtatgccaccatgcctggctgatttttttttttttttgaagggatgaggtttcgccatgttacctaggctagtctcaaacttctgggctgaagtgatccacctgcctctgcgcctcccaaggtgctgggattataggcatgagccaccacacctggcctggttttcttaactgttttctactgccatatttttgaatgatgtttctggcctcatataaatatatagatgatttttcttcctaagactgccttatgggccgggcgtggtgggtcacacctgtaatcccagcactttgggaggccaaagcgggtgaatcacctgaggttgggagttcgagaccaacctgaccaacatggagaaaccccgtctctactaaaaatacaaaattagccgagcgtggtggcacatgcctgtaatcccagctactccggaggctgaggtaggagaattgcttgaacccgggaggtggaggttgcagtgagccgagatagcaccactgcactccagcctggggatagagtgagactccgttaaaaaaaaaaaaaaaaaaaaaaaagactgccttatgtatgtatatatacaacaaaaataaatgttctatgtttgtgaatatatgcaagatcaattctttaaagaattcagtttaatgggggttacaattcatttatagaattcataatggtaattagtatgttaagaaaatcagatgttcagagtgttatataattggaaattctgggtaggttaaaacttttgaataggtgtggctctgaattctaataattgcctagcctagggcaaattaacctcgcctgtcagtgcctcagtagcctcatctataaaatgaaggttggacagagttgtattttatcaggaaacatgtcagtgttaccaaattcttctccagttcgggttaacttcattgtctgtgcagttgaaactgtgctgtgtaccaagcccatctttcaccctaagcaggaaaagctgctttgggcccatagcctctgtgcgagaggcatttggagttaacctttgtttgaatgtccctggttagctatagagtataaacactgaaggcaagggccatgcctgtcttgcaatttgctgtatccctaatgctccaggccaggtgcctggcacaagggtaaatgctcgttcattaaatatttgttgaatgaatgactgccaaccaggacatttgcatacgttgcctctgcaatcttcacagccaacattataatgagataggtagtatcaactcagttttgcagatgagtaaaactgatggggaaaggcttagctgcttgttcaaaaccccacagccaagagttggagctgactctaaagatcacagtcttttttttcttgagatggagtcttgccctgttgcccaggctggagtgcagtggcgcaatctcagctcactgcaaactctgcctcctgaggttcaagcaattctcctgacccagcctcccaagtagctgggattacaggcgcccacgaccatgcccagctaagttttgtatttttagtagagacaaggtttccccatgttggccaggctggtctcgaattcctgacctcaggcgatctgcccgcctcggcctcccaaagtcctgggattatgggtgtgagccactgtgtcctgcctaaagaccatactcttaaaaaaaaaaaaaaaaaagaaaaagaaaaattatttcattgtggtaaaatctgcatgacatgaaatttaccattttaaccattttaagtatacagttctgtggcattaactatattggcagtgtgcaactattaccatcatccatctttttttttttttttgagacagagtctcactttgttgcctaggtcagagtgagtgcagtggcacaattttggctcattgcaacctccgcctcctgggttcaagcaattcgcctatctcatcctcccaagtagctcattacaggcatgcactatgcccagctaatttttgtattttttgtagagacgaggtttcaccacgttggccaggctggtctcaaactcctgacctcaagtgatctgcctgcctctgcctcccaaagtgttgggattacaggcgtgagtcacagcatccagcaccagcatccatcttaatctgtgctttttatcactgttaacgttgcctctgtttgttcttcagggtacttttaaccatctgaaattagatttaaaacttttttgagcagaaaaactgaaggaatctggaggtttaaactttcagactgcactgaatgctgggtcaatgttttccctttcccatcaccttagccagctccatttcatgaagaattacttgttggctaataatagctgagtatgttgttttgaacaggaatacctgctatcatgtctactttctgacactgaattggagctgtttggtctatgcctgctgttgctcagcctagtgggccagtaatttaaattctctgaactctgagaagctgtgtaccccacatttgtagctgtgtacctgcttgatgggttagatcactcgggctaaagtccactttctgccttgtacttgggaaatgaatttgctttgtcatcctctccagcttcctgccaggattccagttcgctgctttcagtttcagtttggggtttaaaaatgtttcttaatctttctctggctgaattacctgtataatacacatacaaataagctttgactgtgggataagttggaaaggtgtgaaaggagatttgaggataggaatggatctgcctaagttgggtagcttgactttcccacttactagtgttcctactgcagtggtcttaaagtcctatcctgatggcagagccaaagggtgaaatatgacacaagctggggatgagaattggcaattgtcctgagtgcacaaatagtttcttccctccaaaacatattttgcagccaagtgaacagaaaacaattcagcaggctacttactgaagacctgctgcaaaaaaattctgttttcaaaacggtagacatacagcttttccaaaatgttttcaaaagagcaaattgcaaactaggcttatttttctcccatattctccctgatccctaagtgtaatgctaattccagatatacttctaagcctgtttgtggatggtaggggctggatttccccaagtttgaccagtcacaaacatccttcactttagatcactgtcagctagacaggaaactgctgagaagactcaagttcaagctttgtattgaatagtcaagcaaacaggtgcagtttggccccagcccagctctctttatgtaaatattatcaagcacatataccataggcaggccattggtattgtaatttcagtcattactgactaatatgacaggccaccattgcatgaggcttgacctcaggtacctgctctaattatagccttcctttctggcagctgcaagcacctggaggagcaggcaggcccccaacagaaaattatttgctgttattagcatttctgttgatcagttgtgtactgtcagagcttgtttcatgctatgtttatgtataattaaaaacagctcagtggattcgttggtttatggttggattatgtttagaaacatgcagtttggattgttacatagcgtgggaagtggagatgatgtcactggtttgagtaagaccagaagagaagcagttaatgtaattaccaacaatttccttgatctctgtaatgaacgcagcttactgaaaccctttagtggcccttggtttctggcactgataaccaagctgacaatcacgcgcttctgctcagttgggaactctggcttaggtgcttcgtagttccttctgatgaaaggggatttgtgagtaattaaaaagaacaccaacatttacaaaatgatacttccaaaaaagaaactacaaatggctcttttttttttttttttttttgagacggagtctggcactgttgcctgggctggagtgcaatggtgctatcttggctcactgcaacctccacctctcgggttcaagcgattctactgcctcagcctcccgagtagctgggattacaggtgcccgccaccgtgcctggctaattttttgtactttttttagtagagacgggtttcactatgttggccaggctgatcttgaactcctgaccccgtgatctgcccacctcggcctcccaaagtactgggattacaggcgtgagccactgagcccagcctttacaaatggctcttaaacctgtaaaaagatactcagcctctcaagatctcactgagatatattttttttaacctattagatgggagaaatccaaaatgttagagaaacaccactgatgagcaagtggggaaaataggcgtactcttatattcttggtgggaccattagcgtacaacttttattgagggaagtttggatatatttattaaaaccacaaactctggcacagcagtatcacttaataggaatttatctcacagattgtatacacttgcatgtatacaaaactgtgtgcttaagcttatttgtggaagagttaatgactggaaacaaactcaaaagtccactggttaaatgatgatccatctgtatagtggttacagctgtaaaaaacaatgaggatgctctttatgtactaacagagatgttttcaagatacagtattaagagaataaagcaaagggcattgtatattatgctaccatttgtataaaaaagggggaaaataagattgtatattatgtttgcttgaatgtgtataagaaagttctggaaggatatttaagaaagtaatatgaacagttatatctgtgtgtgtatgttgaggaaaaaagagaacatgattttctgtattatgtgcacatattaactttattttaaaaagtgaagcttctggctgggctcagtggctcatgcctataatcctagcactttgggaggctgagatggatggatcgcttgagctcaggagttcaagactagcctgggcaacatggctgtctctctctcttttttttaatattaacaaataataataatacaaaataaaaagtagtgcttctttgaatgccgtagttatagaactctcttttaattgatttctttacccattcttgttttcctgtgggtaataagggagatttcctcatactgttgctgatggtactaatgtttgttactttctgtgtgggaagaaagtgatacacaaatttgttggtcctggtgtttttcctattgttcctcagccagaatagaaggctttaaagacgtgtataccaggagcctcaggttctgtgacaaaccctaagaaacaggctttttccttttgtttaacaattaggataatatctggacagtactgaagtctgttgccttttctctttttctataggaacctacaagcagcaattggcgcctattatgactttgagagcccaaacatcagtgtgccctctatgtcctttgttgaagatgtcaccataggagaaggggagtcaatacctccggatactcagtttgtaaaaacatggcggatccagaattctggtaagtacataatgggcaatcctcccttgcctagttttcattttcttaatagttaaataagaaggaaatgttttagcttatgtatgtgattgtgtaactgcgagctttctcttacacatgatatgtagtattttcttgtactggtgtgatgaccaaacattagtgaaatatctcctgctctaaagtaggaagaagaatttatgtctcatgcttttaagccacctataacttaatggcatctaaacacaatccaatattggttttgttactaggaactagacttctatatgatggggtattggctccacctgtacagttttacttcatcactttatttctgctctaattaatcttccagtcatttccagcaggctagaggaggtgtatccttgaatagaacaaggtagttggaaagagctgtgagcatctgctcttttgaaagctcttttttttttttttgcaaccacaaggatgattgtctctgaaatttcattaggatatctgagacattaataccactttgaaaaatagggtaggaaatatgggaatttgctcaaaatgggagacagagaaattgttggtttaaaaaaaaaatacagattgggtgtggtagctcacacacagaatcccagcactttttttttttttttttttgagacagcatctcgctctgttgcccaggctggagtgcaatgttgtgatcatggctcactatagccttaaactcttgggctcaggcgatcctcctgcctcagcctctcctgagtagctgggtccacaggcgtgcactactgtgcccagctaattttttaattgtagagatggagtcttcctgtgttgcccaggttgatctcgaactcttgggctcaagctatcctctcacttggatagctgatattacatatgtacactgcacatggcctcccagcacttttacaggtcaaggcaggaggatcacttgagcccaggagtttaagaccagctttggcaatgtagcgagatcctgtctctacaaacactaaaaagaaaaaaatacaagaaaaacattgttttgatgtactgcagcctcttttaagacaaactagaaataagttaaccataggctgagcatggtggctcatgcctgtaatcccagctttgggaggccgaggtgggaggatcacttcagatgaggagttggagaccagttgggccaacatgatgaaaccccatctaaaaatacagaaattaaccgggtatggtgttgggcacctttaatcccagctacttgggaggctgaggcaggagaattgcttgaacccaggaggtggaggttgcagtgagctgaaatcatgccactgcacttcaggctgggtgacagagtgagactccatctcaaaaaaaaattaaaaataaaaataaataaattaaccatagttctttgaaaatagtgtctatgtgtctaaattttttttctttctttctttctttttctttttttttttttttttttgagacaaggtctcactctgtcacccaggctgggagtgcagtggtgcaatcttggcctcctgggctcaaataatcctcttaccttggccttctgagtagttgggattacagatgtgagccaccgcaccatgcctggctaattttttaaagtttttgtagaaatagggtttcattgtgttgctcgggctgggctcacacgatcctcccaccttggcattctaaaatgctgggattacaggcatgaaccactgcacctggccttaaattattttctaatgagttttgggagcaggggttgggttttgtatttcttgtcacatctaatgacaatttatgttgactggtcgaaggtgttttaactttcttattattaatgagaacttcagagaaaaattctgagagatggaaaactaggctaaaaatacgtgtttgtgggggtgccctgtctagcaagttaattttatatgagatgatttaaaactctgaggactcaaataaacctataaaagtgaccttttattgatttggtttacttttcagttctttacaattcagttctttatgatggggaaagactggctagaccagccttttatgtaagaatgtaccaaattgaattgttattcttagtttttctggcatatttagaagtaactcacctttggaggaaagttcagtgtgtcattgaccaaacacatagtttggactgacccaatgttgtggatgactcaggacacctgtgactttgtaaaatttcattcgccccctttcctttttagttgtaacagttagttataacagttagtttgggaggtacatggtaacagaggaaaatagccatattttctatttttcttgaaattcttacttgttcaaagtctaatttgctttactttgcctaatttctttctcaccttgcttgattttgcctgcttttaaaaaaatatcaagacagtttcttcattttataatagcttttattcatcatgtttttattctgaatttaaaacctgctgtgttactgatcaaaaatgctttcagaggctgggtgcagtggctcacacctgtaatcccagcactttgggaggccaaggtgggcagatcacttgaggtcaagagttcaagactagcctggccaacatggcaaaaccccgtctactaaaaatacaaaaaattagctgggcatggtgttgcatgcctgtagtcccagctacttgggaggctgaggcacaagaatcacttgaacccaggaggcagaggttgtagtgagccaagatcgcgccgctgcactccagcctgggcaacagagccagactccatctcaaaaaaaaaaaaaaaaaaaaagttttttggaatctaccagtgagatatatatatatatataattttttttttttttaataaatgaggtttgtttggaaagtgtgacttgaattcaagttttatttgtttattttaaagtgaagtcagtaccttgtttacttaatagtgaaaacaatgaaaatggcctggctttctgtgagctcttcagtgtttttaaatactgaaagttgttagagtactgttgaaatgttttaaataccatcttgtggcagactaaccattttatatttcaaaaagcctcttgatatatctacttactagactgttacttgggttaatggggagctttgggaggttggtatgtagtagttagactgtcaaatcagaacccccaaagcctacctttcatgttgacttacaaaaatctctcttggtgggcctgactgcttttcccctctgcatttgctttgtaacctcagtttaaaacagcttctgaatctctttccttgtgtgaaagggcattcttgtgcctgaacaggtcttgaaaggttaggtagcagttgctagagattttatctttcaaggtgctttgcataaataggttttctcttctggaagttgtccccccagctgtagagtagttttaatctataaattggatgttttccatttggttaaggagaatctggccacccgttactgagtatcaggcatgttatttgagagaggaagaacatgcatgtgcacaggtttttggcatcatcctaatctggcctgagttatttctgtaaatagagtagtaacatggaagtagggcaggccttggcagtttttcctctggctgtcttactctcattcataacctccctaagaaataagcactcactgaaagagctacataaataataatttttatggcacttctgtcttgtcatgttttaggcgtgctgggcatgcaaatataccacagatgagactgataggaatcgcatatagttgtcccaatagctttcccgaagaaggcgaacgttgcgcactgtttaaaattaaattcctggccaggcgtggtagatagctcaaccctgtaatcccactactttgggaggctgaggcgggcagatcacctgaggtcaggagttcaagaccagcctggccaacatggtgaaaccccatctctactaaaaaccccatctctactaaaactgcaaaaaaattagccaggcatggtggcaggcgcctgtaatcccacgtattcgggaggctgaggcagaagaattgcatgaacctgggaggtggaggttgcagtgagctgagaccgcgccactgcactccagcctgggcggcagagactccgactcataaataaataaataaataaataaataaataaataaataaataaaaataaataaataaaattaagctcctaatattttttaagtccttagatttagatttgcagaagcagaactgagatatctaataacatagatgcaaaattctaggattcagacttctgtcactgtggaagcattggaagcttagtaaacctgagcaggaaactttgggagttaaaatgaaaatttaaaactgtccctctaaaaatatgagtagacagaattctctttaccagcacctagagcttctcagttgttatactaccatgctctgttgtacaattgtagtgaatattaagctgtgcatgttatgataaccctagtgtttctctgactttggtgaaatttttgtgattgtcatatgagagggtatcttgggcatattgatacagagtcgtctttattttttgaacttcatagaagtgaatataaagggatgggaaaagaacttgagaaagaacaattatttcccccatttttcttctagtgcattaaaatagttagctttctacctttctcttcagtatgattctagagaagataattttgcttctttcattcaacacattttattatgttccagtcactttattaggtacaagggaggaatggtcacaagattgatgaaggtttctgctttcatggagcttaatatgaaatgcagtgtccacacttataagggttaaaaaggagatcatcattaaggtttgtcttctgtattgctatttggatattccttactgtctccagactatttctataattgtatatacttactaagtcccctgggactgttggacttttgatttttgtgatgcttgctaccatctcaaaattgtaacatgacagggttttttttgtttttgtttttactttattttaaaaaataaagtgatatttcatatctggagaattacagccttaattatatacttgattgtgatacttaactaggaacgtcataaaacacagattagtctttcttttcttctagatagaaatctatcccccattaatccagtttgcaactgagacttaatttggagtccagttctattatacttctcgaactcagatttcaggtatgtttagtgtagtccagacaactcactggtattcccttccttctgtatcaagcatcaatatctttgaccttttcagagttacgtgacctaacagttgtgactataagaattgtatgtatcattgataacactcagaaggcagatgattggtttttcacttcatagccaatgaacacttcagagttgttggtggataactcttctagcccagaggttctttaaatactccactgagaagtaataggtatctggagtaccaagaagggcaggaccctagccaaatgccagtgtttaatgttacccatttaatgttttactgactaactcagtttctctggaatgtagcagcactccttttgcacagctaagatgacccaatcatctcagctgcttctggttgtgcctaggagagctaagtctttttcacatgcagtcttggtttaccttatttacttataagttcaaaaaacagacacattcttgggatttcatataaacagacattatcttgttgcaggtgtatgtgtatgtgtgtgtatgtatatgtgtgtgtatgtgtgtatcttaaagaataactgtgaattcagccccatgatagtagtataatttttcttttcgattttggtctttaaggagactgacattttgtaaggtgcttcatgtcagctactgttctgcttgttgtaagacaaataggcttttgccagacctcagaaatgaaaaagataagttgcgtgtattgtcagtatatcatccacagcctttcctccagcagtggttgccctttatagggttaacttaggacattttgttggcaaatttttttagaagaaggtatgctaaaacatagtggccactgctttagctgctaccccttaagacccaaggagcacagagggtgccattcataatggagctgagatctcaggagtagaactctggttgcctttctctgtctggtttctttccagtagtgagccatcaggtatgtcaaaactgggcacttagagagcaaggaactgaggcatcttagagtactggtaggagataaatgacaagcaccctctgttctaagagtcctgccatgttcaagttttcacagtggtttatttttataatgaatgtatatattccaaaaaaagatatatagaagtttctgtctacagttaaaaaggagtatatcaattgctgcatattggagagacttcacaggaaaaatcacatctagtcactgtgtggctacctataccgcttgactagtgggaactagtcaacacatagatatctcatgaattagttacatgaaaataggtacacaagagtgggtaccggctgggcgccatggctcatgcctgtaatcccagcactttgggaggccaaggcaggcagatcacctgaggtcaggagttcatgatcagcctggccaacatggtgaaaccccatctatgctaaaaatgcaaaaattaggccaggcgctgtggctcacacctgtaatcccagcactttgggaggctgaggcagacggatcatgaggtcagcagttcgagaccagcctggccaacatagtgaaaccccatctcttgtaaaaatacaataattagccaggcgtggtaatgggcgcctgtaatcctagctactcaggaggctgaagcaggagaattgtgtaaacccagaaggcggaggttgcagtgagccagagattgtaccattcattgtactccagtccaggcgactctttaaagagttacaggttaaatttaacctgtaactctataaaaatctatctccctttgacaggtctgattgaccctccttcccatcctatccgcaagtacctccaactcctccaactagtgccattgttcctgcgaccacagttcattgatgttatcaggggagatcaccccattgtttatattttcactaccacccaaggtctaaacttttactgccttttatattcatgtggtctcttgagctcttgagtattttatagttatggaccccagaagaaaagtcatacctcaggcaaaaagcaattttaaattgagaataataccattgaaattactccttgtgtgtttcatcctcttgtttctgtggaaaaactggcaacaatcagatatactgtgaaaatggacatgtgttaccttttagtagagagagctgtcccctaaacgtgggcctgtgcttcatctccatggctcttcatggacatcattcttaggttctacagattcagtgtgacgtgtggccttccctggagtcacctgaaatacttgtcttgaggaactgccttgcttttgccttttgtgcttcttcatagggttagactattggtcagaggttgttggttctgataattccttttgatcagttgtgtgagacaatatatggcttaggtatatgtggttaggtttatgtatgtatgtgagaaaaagaaagaggcctcttctacagtttcataataaactgcacccagcataggaccattgattgcctaacatttttttcttttgcttgaactcaggggcagaggcctggcctccaggggtttgtcttaaatatgtcgggggagaccaatttggacatgtgaacatggtgatggtgagatcgctagagccccaagagattgcagatgtcagcgtccagatgtgcagccccagcagagcaggaatgtatcagggacagtggcggatgtgcactgctacaggactctactatggaggtgagtatgtccttgtgcagcccagggtaaaggaactaaggtaacatcttataacatccccagtgttgctcacagagcctgtcaaattgcataacagggcatggcctctttttaacagtcacctcatgcaggtaaatgatttgcattttatgactaattgattagtctagtgctctttcttttatcctaggaatataatttagtgacctgtacgaggtattatattttgtgttctaaataaatatttagtagtgctgttgtttttattatataagctggtagatactgtaagaatactaaaggcagtccttgttctcaaagtctctagacacaagtcatataaaacagataatgcacaaaatgtgcatacttcttccaacctacttgtcaaactgctaacatatctcactcccttctctttattgccaaacgttttgagcagtgatctatactcactgtctcttctttcacattttccattcactcttcaacccaatttatcctttatccactccccactccaatgaaagttaatcagggactaccctgtttccaaatccagtagcctcattacagtcttcataccagctgaccttttaatgatcatttggcaccatactacacaagttttttgaaataggtactttcttagactcataggacatctctcctgtttgtcttcctcttctctgttctttctctgtctctgtctattctcaactttaccctgggattcctagattcttagttgggccccattcatggttggtgacctcattcacccatgcggcttcagctgtcgccagtataccatacacggtgatgctcaaattaatatctatagctgtggcctcttttctgaaccccacacccatgttttaactcgttatgggcagaacttttaacatctcccagacacaatttatatctgctgggcatggtggcacacgcctataatcccagcactttgggaggctgaagtgggagaattgcatgaacccagaggctcgagatcagcctgggcaaaacagagagaccctgtctctacaaaaaataaaattagcctggcgtggtggggtgagcctgttgtcccagctacttgggaggctgaggtgggagaattgcttgagcctaggaggtcgaggttgcagtgacccatgatcacaccactgcactccagtctgaattacagagtgagcgcctgtctcaaaaaaacaaaacaaaacaaaaaaaccaaccttatatccttctcattggcacccccctgagataatcgggtcagaaacctgggagccatcatttgttctgtcattcctaatcagaaactgattcctattggttccactatatcctgtgtcctggagatcaaaaacaaataaatagtaaatagtacttgccttcacagagctcttaactggactcatggcctgtgggccagtgggaactttggagttgtttctagacatcctagaattagtgatctcatatatgtttttggagccagtggcaactttagaaatgttaatattagaaagagtctcatagtgcttatgtgacatcattctttgcctaaagcctttgtacctactgtaatgaagctaaactccttggcacaggatataaggctcacgatctggcctggactcattttcactcccatcttcagtcatcccctaactcccccacagtcagtccccaaagatgccatatgctttcacttctccatgcccttgctcatttgtctcattgcctgaaatatccttttatttcaccaaactgctgctcatcctcaaggccctgcctgagtcacctttccttcttgcttcctcccccttgcctcctctccccactaccctaagaaaattcatccctcccccttcattaatatcatgcacatgcttgttattatatttaacacattgtatattaggtatttgttttgcttatccttttatcctatgaaattgtgaacaatttgttgaataattgaataatcacgtatcaaaatgtagagaggttatttgtctcttccctgtaggactccattttcaggcagtgtctgctaagaatccccttgacctgggattggaagttgtttctcccactgctgagctcctttatattagctcttcacctctcactcctttgtttcttctcttggcactttacgtctttctacccatttaatttgataaatgtctcatgtcatctttaaaactgaaggtgacacatgtctggtttatctttataactcaaaaatgttgagcttaatgcagaatggagaatagctacttagtaaatttttaaaatacatgctaccatttttaaggggagaagaagacaatatacatgacttaaaaataaaaaaaaatccctttgatgaaaaaatactacttctcaatgttccctagtggttaagaacgctagtcttgttttatgtgtgtgtgtttttagtgttaaatttaaaataattatcactatgtgggacattacattttatactcatagcaactctctcaaattcaaaagtagttggaatataaatatgaggggactttaaaaagatcttggaaaaatggaattaaaaaataaaagtaaaggccgggtgcagtggttcaagcctgtaataccagcactctgggaggccgaggtgggcatatcacttgaggtcaggagttcaagaccagcctggccaacctagtggaatcctgtctctactaaaaatacaaaaattagccgggcagttggctcacgcctgtaatcccagctactcgggaggctgaggcaggagaattgtttgaacctgggaggtggaggttgccatgagccgagatcgcgccactgcgctccagcctgggcaacagagtgaaggcttcatatcaaacaaaaaaagataaaaataagatatataaattttatttctcaacataagcttcatcaagttcaagacacttttgtaagtaatgataacagccatttagtccatccccaaagaactgagggtcctaagaatttaaccatgtaaatgcaggtttttttttacattattaactgaagaaaactgggtgtccattaaagatttttaagactaggaaacaaaaagaaggtagaaggagccaagtcaggactgtaaggtggatgcctaatgatttctcatggaaactgttagaaaattgcctttgcttgatgagaggaatgagcaggagcattgtcatagtggagtagatctttttctgctaaagctttggctgagtttcttaaaactaacacacacacacacacgcactttttttttttttttgagatgggtccttgctcttgtcgcccaggctggagtacagtgacatgatcttggctcactgcaacctccacctcctgggttcaagtgattgtcctgcctcagcctcccgagtagctgggattacaggcgctcaccaccacacctgggtaattgtttttgtattttcagtagagacggggtttcaccatgttggccaggctgttcttgaactcctgacctcaggtgatctgcccaccttggcctcccaaagtgctgggattacagatgtgagccactgcgcctggcctctctctctttcattctttcctttttttttttctccttggtcacccaggctggagtgcagtggaacgatcatagctcactgcagcctcaaagtccttggctcaagtgatcctcttgcctcagcctcccaagtagctgggactacaggcatgtgccatcatgcctttttttttttttttttttttttttggtagagacgggacctccctatgttgcctaggttggtctcaattcctggactcaagtggtcctccctcctcagcctcctaaagtgttgggattacaggtgtgagccactgtgcccagctctcagaacactgttattattcttaggccctctagaaagttgacaagcaacatatcctgcggagccaaaaaaaatttgttgccatgacctttgctcttgactggtccacttttgctttgactggcccacttccacctcttggtagccattgctttgattgtgctttgtctttaagatcacagtggtaaagccgtgtttcatctcctgttatagttatttgagaaatacttcaggatcttgatccccttgcttaagatttccattgaaagccctgcccttgtctgcagctaatctgggtttaacagttttggtacccattgattggaaagtttgctcaactttaattttttagtcagaactgtgtaagctgaatcggttgagattcagctgtggtgttggctgttgtttctgctattaatcattggttcttgttcagttagagcatacacaagattaattgtttcctccaaaattaatgtggatggtccgctgctatgggcatctccagcgtcatgtcgtcccttcttaaaacaggttatccatttgtaaactgctgatttctttggggcattatccccataaactttttgtaaagcatcaatgatcttccatagtggattcaaacttcactatgaattggatgtttgcccttgcttcagttttagcaaaattcatagtgaggagttttttttaaactgatgtcttgtccttagtgcctcaaactaggtgctgttcagatttgttataataagctagtaagagtttactttgatgcaaaaagaagttgaaatccatgcatagttttttcataatactcaatttccatgattttttttcttttttttagatttaattttgtgcttacccaccatgaactttttgaagatgctttgtatactagccttggagcaaaaacattaacattttaactttaaacccctaattttaacttaacaacccttttttggtcttaatagtctgtaagttgtttctcaggactttgtggaatctagtgccttcaagggattttaataattcatctgattttgtagttttcaagcatttttgttaagctatggaaccttttccttgacagaagtatatatgaatgcctccttgtaaaatgggaaaggataaacatgaaatgtttcgttgaattctgggcctccttggcttatgttttccagcccttgtgtgtctgggatgaccgctggagctctgtggggtatagtttgccaacctttatctgctccagtgaacagtttaattccattttataaagtactgtatttcattgaatccaaattattattggttgtaaaacataccctagtatcagtaacagaaagagaatagattatgtatacaaccatagccatgagcacatggaaaaaaataaacttccataataaccatgattggctcactcggcttactagcttattgagtgtaatatagtggctaagagtgtgaactgtgggactctgttgcctaggcacaaacttggacaaattaggtaacttctctggacctcatctttctgttttaacaacaaaagattgctttttggaggtttctgtttttggtggggtggttgtttctataatttgtttttttttttttttttttgagatggagtcctgctctgtcgcccaggctggagtgcagtggcgtcatctcagctcactgcaacctctgcctcccaggttcaagcgattctcttgcctcaggctcccgagtagctgggattacaggcatgtgccaccatgcccggctaatttttgtattcttagtagagatggggttttaccatgttgtctaggctggttttgaactcttgacctcgtgatccacctgcctcagcctcccaaagtactgggattacaggcatgagctaccgtgcctggctgcttctgtaatctttagatggtcttcttgagaaagaatccactccctttaatttatttattcattcattcattcattcattcatttatttgagacggagtctcgctctgtcaccagcctggagtgcagtggcgtgatctcagctcactgcaacctctgcttcccgggttcaagcaattcttctgcctcagcctcccaaatagctgggactacaggtgcgcgccaccacacccggctaatttttgtatttttagtagagacagggttcaccatgttggctagggtggtctcaatctcttgaccttgtgatccgcccacctcagcctcccaaagtgctaggattacagacatgagccaccgcgcccggcccactccctttatttttataataactcttagattgtttcagttcacgtttcctcttagaaagaatttttgctgtattcagtcagttacaggtctcctgtaaaaggtctcctccaccctgtttcagcttggctgtgctctctcagagtttctcagtgggcgtgctttcggcatgtggtgtggacacttcttcactgtgtggggcatattacaagacctctggcctcctcccactaaagatccgtggcttcacctgtttatcttgataacaaacactgtcccccaccacacaaatttctagctcacttggtccaagactaataagtatctgatttttgacagatttattttcaagccctaacattttatcttttttttcctcgattttgataccccttcccactccaccccaccaaaggattagcttcttagcttttatctaagtagcaaatactaacaaatagtagaaagtactaacaaattctcgtacttactatttgccaggtattattttgggctttttgcatatgttaccttgcgaaatattagctgcattttattgatgagaaaactaaagaccagagaggcttaaggtctagtaaaagttgtaaattagttacgaattatagttataaattaacaaaagtaattttattatctttgtcattactttggctgtcactagtatatggggttcagaaggaaactggttctagggtgttaatacttgttagagtttagtgagggtggagtatatggtccggaagtcttctctctacttccagagtgagtgggcattgaggtggagttgagattgacagggctattcttaggtagttgggtgtcagttttccccagagagttcctgcctgctagaagatactcagttctataggacattggactctgggcaaagggtaagcagcatgagtgattgtccttgttttagcctggatgccagtagtaatatgcttcatctcctactaacagagagccgccttccagatttccaaaggagagatttaccctgtaccatgacggtttcctctaactctcagggtcctagttgtgaaataagctaagtcaagtgatagtctgattatctcgcacttatgggggtttccactacttgaagtagttcttgttaaatacctcatatgggtccctagggacatttgacatatcgagtaaataacctatgcattattcatttggtttctcagagtttagaaatgaagctccccttatgaaggtcccaaaccacaatatgtcccacatgttaggaaacttattgggtgctctatgtaaactacactgtttatttcccaaaacctttgtaaattcttcctttactttctccattttatagcatgtcctacctaaccaggtaacatgaggctttccttatttcttgcttgtgttttagtaacatcatgttacaaaagaagctatggtttcatacaaacttcttcatactagaatccatgatgtcttctactcacatgctattctgcccgacatttctcccagttatcttgcccttttgcctattaaccccacctttagaacattgttcttttatgttgaactcaaaaaggcttcatctgcttctagaagatcctccataagatgctcactgtttcagttctggtctctagaattctctaataccagaaatatgagtagcccttgaaaataagattccatttttgttttttttttcttttttgagagagggtcttgctttgtcacccaggctggaatgcagtggtgtgatcacggctcactacagcctcaacctcctaggctcaagcaatcctcccaactcagcctcccaagtagctgggaccacaggcatgggtttttgtttttggttttgttttgtagagacggggttttgccaagttgcccaggctggtcttgaactcctaggctcaagcgatcctcccacttcagcctcccaaagtgctgggattacaggcatgagccacagcaacctgccaaatttcatttttgataagagaaattctagcctaagctgtgacttgtatggaaaatattttagaaggaatgtttcaaaatgtaaatgagatctgaaattctaaaatattatgttatgagatgataggctatttcatctttgaagaaggaaacctgccgtcagttgcactgccaccaggtggtggtgattgtttgttttggtggtcatttccagatagttctgtgtgagtcaaagtcggtatgaaggcccggcatggtggctcatgcctgtagtcccagcactttgggaggccgaggcaggtggattgcctgagcccaggagcccaagaccagcctgggcaacatggtgaaactccatctctaccaaaaatacaaaaaattagccgggcatggtggcacacacctgtaatcccagctacttgggaggctgaggtgggaggactgcttgagcctgggaggcggaggttgcagtgagccgagatcactccactgcactccaacctgggtgacagagtgagacccagtttcaacaacaacaacaacaacaacaacaacaacaacaacaacagcagcagcagcagcagcagcaacaacaacagcaatgtgaaatgactgtactgttcagattaacctctaaaatgcatatatgtgggtcttgaaccttctatgggccatcaaaaatttaaaaatctgatgaaacagtaatcctttgtaaagtatagtaattagcaagatattgaatgtctaggcagtaaagcatcaaatgttttcactgcctagtcacttggctgtgagtagtgttaatgtgtgctgttagtgctaatgatgtttgctttaaaattaattttcttactcctcaacttaccatacacatgtatagaaaaggatttggtagagggcaaaaatataatttgaaagctgcacctttttttactcatggtagccagcgcccttctgttaaacagaagcttctttagtctgaaatgttggattccagaaattctgaatttaagggagtagtgatatttccttaaaaaattcttaaaatcaagtacaattctgtactaaaatactagcatacttactgttaaaaggaaaataaatagttgtaaaaccattgactgttttaaagatgacatatttcagcataatttgtatcttaatataatccttaacttttttgtatatatgcattagtaaggactatagcttaggccagatatagttaaagtgttttacttatttagggaatatagccctgtcagagtaaaacatttgcaaatagaacttactgcacttccccagttctgaagtgacagtaattttaatatgcatccttggtttaatgattactttccttgtaggggagagaggtagagccactgccatattaaatgaaaacattagatggtccatcttcatttcagagatattaaaaatgaataaaaaggtgatacttaaaaattagatatgtatgttttctctttacaaaagaaaaatatgttgacatatatgctgaaaccatttcaggtaagaaattcttaagaaggtttcactgaattgttgtgtgatgggagtttttagtaagtgccattgtgtgcacttgcccctagatcagactagaacatgtttcttataaataaggaagtaagcataattgacttttattcaaattatcagtatatgctataaaactaatgtgtggttattttttaacataatgatgattggtatcttaaacagtgtagagggcttttaaacttttatctgatagcttagtttttgatacagtttatattccttaattattgtttagaatgtagtcataacttcattcttagaaacctcacattactctggggatctttgaagaggataatctcctattgaaaagcagattgcattctgttcctgtaacgatggtttgacaccagccttataatgatgtaatgggttttaccttgaaatggcaaggatatttttcagttagaaattagttctgtaatttttattttgaaaaaaaatctttctttagctttttatttttctccttttattgttaaagagcttatactttcctttatttacaaagggaatgtcagtgttggacattcagccccgagaaagaatgttgtgagcctactggcctctggattttaatttaatttaatttatttatttattttgatatagagtgtctcactctatcatccaggctggacagtgtcaggatcatagctcactgtagccttgaactcttgggctcaagcagtcctcccacctcagtctcacaagtagctgggactacctacctggctaatatttttaaaaccttttttgtggagctggggtctcactgcattgccagggttggtctataattcctggcctcaagcaattcttcctcttcgcctcccgaagtgctgggaatacagatgtgaaccagtacgtccagtctggatttctctttgtagtaactaatgcccttccagtttcttcttaagatttccaggcccagcgtggtgactcacacctgtaatcccagcactttgggaggctgaggcgcgtggatcaccagaggtcaggagttcaagaccagcctgtccaacatggtgaaaccccacctctacaaaaatataaaaattagctgagcatgatggcaggtacctgtaatcccagctacttgggaggccgatacaggagaatcacttgaacccaggaggccaggaggcagaggttgcagtgaggcgaaatcgcgccattgcattgtagcctgggcaacagagcaagactgtgtctcaaaaaaaaaaaaaaaaaaaagctttctaagagtttcttttcctccctccctccctccctccctcccttccttccttccttccttcctttctttctttttttcagacagggtctcactctggttgcccaggctggaggagtgcagtggcacgatcctggctcactgtagccttgacatcccaggctcaggtgattctcccacctcaacctctcaagtagctgggattacaggcacgcgtcattacaccccgctaatgtgcattttgattagagacggggttttgctatgttgcccagggtggtctcaaactcctagactcatgcagtccacctgcctcggcctcccagagtgctgggattacagacgtgagccactgtgcccagccagatttctaagagttttgcttatagtttgttttgacatgatcttgaaagcaatttaattctaaagtgggtttggttttggctcagtagatttcagtcatttttacgttttattttcatgatttctcttatatatttagaaatcagaagtgattgtgaaagtgaattttatttctgacagccttatttgaggactttaaaaaatatttaataatacattttatttaactgaatatagccaaaatattttttcaacatgtgactctagctacatcccaagtactcaatagccaccatatggctggtggccaccagctcttttggacagtgcagctctgtggatgctgtctgatacgttgtaccattttttttctgtaagaaattttatagaattggtgttattcttctactaaagaatttccagcaaaaccattcaaacctggaggtgtttaggttttcaattactagttcaacttattttcatagttataggtctattaaggtaatctatttcatcttgagtgatgtgggaaaatttcaaggagttggtccttttcatctaagttgaatttatgttcatagagttgtttgtagtatcctcttattatccttttaacatctatgtttgatgataatcccttctttcattcttgatattttgtgtctcttctctttttctttcttttgatagatttcccaattttattggtctttgaaaagaatcagcttctggtttcattggtttttctctattctgtgttcaattttatggatttctgctcttaattttattaattccttcttgatttattttctagtttcttaaggtggaaactgagattattgctttgagacctttcttcatttataatatgtgtttagtactataaattttcctctaagtgttgcttttagttgaatcccacaacttctgaaatgtatttttttttaaatttttagacactgcagtgaatgcagaaatgtatttttattttcattcagttcaaaatatcttctaatttcccttgagacttcctgtttgacctatagattatgcagaagtgtggtgtttaattttcaaacgtttggaaatttttatcttgttcaatgttagtttcttttttaaaatacatttttaatttttatttttactttgtagagatggagtcttgctagcttgtccaggctggtctcattcctcggctcaagtgatctttttgcctctgcctcccaaagtgctaggattacaggcatgtgctcccagctttgttaatagtttctagtttaattccattgtggtcagagaatatcctttgtatgatttcattccctccctccctccctccctccctccctccctccctccctctctccctccatgtctccctcccctcccctcctctcccctcccctctcttcctattctcttttttctttttcctttcctttcttttctttccctttccatttctgacagggtctcactctgcccagcttcccaagtagctgggactacaggcgcacaccaccatgcctgtcttgttttttactttttattttttgtagagacagggtcttattttgtttcccaggttggtctcaaactactggcttcaaggagtcctcccaccttggcctcccaaagtgctgggattacagacttgagctaccacactggctgatttgattttttgtttaatttattaaggtgtttatgacccaggagatgttgtctatcttggtgaatattccatgcgtacttcaaaagcatgtgtattttgctgagttgagtgttctataaatgtcagttcgatccagttggttgattttgttgttcaattcctttatatctgttgatttttgttgttgtttactagttctatctgttactgagaagggagtgttgaaaggtccaactacaattgtggatttgtgttgttactttttttctcctttcagttatcagtttttaattcatgtattttgaagctctgttgttaggtacataacatattagcattatcttttaggtgaattacccatttattaatgtgtaatatcccttttcttccctgataattttctttgctctgaagactactttgatactagtatagccactttaacttccttttgactagtgtttacaaggtctttatcttttagctttcaacctgcatgtatcattttatttggagtttcttatagatagcatgtagttggatcttttttcctccattctaacaatctgtgttttctaattggtgtgtttagactattcacatttaatataattattgaaatgtttgaatttagttttaccactttattatatgttttgttctcttagttgaagacttaaatcagttacattgctaaacttattggttacttgtgattaaattgttttaaaaatgtatttgctctggccgggcgtggtggctcacgcctgtaatcccaacactttgggaggctgaggcagacagataacaaggtcaggagatcgagaccatcctggctaacatggtgaaaccccgtctctactaaaaatacaaaaaaaaaaaaaattagccgggtgtgttagttggtgcctgtagtcccagctactcgggaggctgaggcaggagaatggcatgaacccaggaggcagcctgggtgacagagcgagactccatctcaaaaaaaaaaaaaaaaaattatttgctctgataaaaagaaatacatgatttattatagaaaataaagtctaaagagaaaaggaaacatttgttctgccatccaaatataaacacttatttttttttattttgagatggagtcttgctctgtcgcccaggctggagtgcagtggtgtgatcttggctcactgcaacctccgcctcccaggttcacgctattctcttgcctcagcctctctagtagctaggactataggcgtgtgccaccacgcttaactaatttttgtattttgagtagagacggggtttctccatgttggccaggctggtctcaaactcctaacctcaagtgatctacccgcctcagccttccaaagtgctgggattacaggtgtgagccaccacgcccagcctaaacactgttaatgtatgcatttccacatagttttttaaaatccatgtattaaaagcaaaaaacttttttgttgtttaaatatggtattgtgctacctattcttatgtaacctacttttttctcccattcactaatgttttagaacttcttccccttaacattaaatacttttaaaaacacagttttcagtaattcataccattccactagattagtattaactaaactataaactattatggatttttttttaattgaggtaaaatccacataataaatcattttaaagcatgcagtttagtgtacttagtaaatttatggtgttgtgcaaccattatctgtatttgattccaatgtattttataaccccaaaaggaaacctcatacctgttaagcatggctcccctttcctcccttcctgcagcccctggcagccactaatgttctttctgtttctctgagtagatacttctttttgctgggatagtgcaagatatataaatagtgagcaaataataaaatgtattaggctgtgcatggtggctcactcctgtaatcccagcactttgggaggctgaggtgcgtagatcacttgaggtcaggtgtttgagaccagcctggccaacttggtgaaactctgtgtatatcaaaaaatacaaaaattagccgggcgtggtggtacatgcctgtaattcctgctactcgaaaggctgaggcatgagaatggcttgaacccaggaggcggaggttgcggtgagccgagatcgcgccactgccctccagcctgggtgacagagtgagtccctgtcttaaaaaaaaaaaaaagaggggaatgggggactgagaaacactggtgaagttcatagtccaggagtgtaggttcaccaaaagactgaaacctaatcacaccttaccattacattactactggcttctttactacagtttcttttagccagtacatcctgtctacctttcagcagggtatactaaaaagcaagaaacacagtttggagaaattgaatagcatcagaatcagttttggcaggcgtgttggaattattaggccaggaatttttttaaaaactataaatagtatgctaagttcttcaatggaaaaagtagacaacatgaaagaacagatggataatgtaagcagggagatggaaattctaagaaagaatcaaaatgctagagataaacattaacagaaatgaaaaatgactttgatgagcttgttagtgactggacacaactgaggaaataatctctgagcttgtggatatgtcagtagaaattccaaaactgaaaaagagagaaaaggctgaataaaaatagaacaagccaggtacagtgatgtgtgcgtgtagtcccagttatttgggaggctgaggcaggaacattccttgagcccaggagttcaagtccagcctgggcaacatagtgagacctcattgcttaaaaaaacaaacccagggccaggcggtgtggctcacgccataatcccagcactttgggaggccaaggcgggcggatcacgaggtcaagagatcgaagccatcctggccaacatggtgcaaccccatctctattaaaaatacaaaaattagctgggtatggtggtacgtgcctgtagacccagctactcgggaggctgagacaggagaatcgtttgaacccaggaggcggaggttgcagtgagccgagatcacaccactgcactccggactggcgacagagtgagactctgtttcaaaaacaaaacaaaagaagcccagaatacagtagcctccccatcaccctatctggtggataggaaagtttcactttccatggtttcagttacccatagtcaaacacagtctgaaaatatcagatggaaaattccagaaataaacagttcttaagttttaaattgcattccattctcaggagcgttccatcttgcccaggatatgaatcatccctttgtctagcatatccacgtgtatgcactattcacttgttagtcacttagtagccatcttggttatcagatcgactgttgggatattgcagtgcttgtgtcgaagtaacccctattttacttaataatggccccaaaatgcaagagtagtgatactagcatactgttgaaattgttctattttattatcagttattgttaacctcttactgggcctaatttataagtcagaatttatcataggtatgtatatatagggaagaacatagtatatatgggatttagtactttccatactttcaggcatccattgggagtctcggaacttattttccatggataaggaaggactcctgtatccatgagctgtgggacaactacaaaaggcgtaacatacacacataatgggaataacagaaggagaatagagaaaggaacagaaacaatatttgaaacaatacggctgaaaatttctccaaattaatgtcagacatcaaatcacagatccaggaagctcagagaacaccaaacaggataatgcccagaaaatgacatctagcatatctactcaaactgcagaaaatcaaagataaagaaaaatcttgaaagaagccaaagggaaaaaatatcttacctatggaggagcaacagtaggaattacatatgatttctcctcagaaatgcaatcaagaagagagtggaattaaatattttaaatattgaggctaggcacagtggttcacacctataatcccagcactttgggagtctgaggcagaaggatcacttgagcttaggagttcaagaccacatggccaacataggataattaagaaatattacaagcaactctgtgcccacaaacttgataacctagatatcatggaataattccttgaagtacacagtttgtcatagcttgctcaagaaaaatagacaacttgaataggcttttgtctgtgaaagaaattggatcaataattaataaacttctgcaacagaaagcaccaggtccaaatgagttttctggtgaattctaccaagaattaatgaagaattatactcattctctttttatattctttttgaaacagagtcttgctctgttgcccaggctggtatgcagtgatctcaggtcactgcaacctctgtctcccaggcacaaatgatcctcacctcagcctcccaagtagctgggactacaggcatgtgtcaccacacctggctagttttcttttggtagagacagcattccgccatattgtccaggctggtcttgaactcttgggtcaagcagtcttcctgtcttggcctcccaaagtcctgggattacaggtgtgagccaccacacccagcctatactaattctctacaatttccttcagaagatagaagcaaatggaatacttcctaactccttctgtgaggccaacgttaccctaatacccaaaccagacaaagattacaggaaaattataaaactatttctcatgaacttagatgcacatatcctcaacaaaatattagcagattgaatttcaaaaatgtgtaaaaaggtgggccgggcgtggtggctcacacctgtaatcccagcactttgggaggccgaggcgggcggatcatgaggtcaggagatggagaccatcttggctaacacggtgaaaccccgtgtctactaaaattacaaaaaattagccaggcgtggtggcaggtgagtgcagctggagtagtcccagctactcaggaggctgaggcaggagaatggcgtgaacctgggaggcggaggttgcagtgagccgagatcatgccactgcactccagcctgggtgacagagtgagactccgtctcaaaaaaaaaaaagtgtaaaaaggctaggctcagtgactcatggctgtaatctcaacactttagctggctgaggtgggtggatcacctgaggtcaggagttcaagaccagcctggccaacatggtgaaacctcgtctctactaaaaatacaaaaattagcggggcacagtggtgtgtgcctgtagtcccagctacttgggaggctgaggcaggagaatcgtttgaacccggcaggtggaggttgcagtgagttgagattgtgccactgcactccaacctgagtgacagaaacaatatttggagtgagactccatctcaaaaaagaaaaaagtgtatgcaggcccaggggcggtggctcatgcctgtaatcccagtacttcggggactgaggcgggtggatcacttgagttcaggaattcaagtccagcctggctgacatggcgaaaccctgtctctactaaaaatacaaaaattagccgggtatggtggtgcatgtctgtaatcctagctactcgggaggctgaggaaggagaatagcttgaaccagggaggcggaggttgtggtgagccgagatcacgccattgcactccagcctgggctacaagagcgaaactctgtctcaaaaaaaaaaaaaaaagggccaaagacctgaacagatatctcaccaaagaaaatgcacagatggcatggcatataaaaacttacgagaagatattcaccgttatatgttttcaggacattacaagttaaaacaactatgagatatcactatatacctattaagatggccataatcccaaacgccaacaataccaaatactggtaggaatgtggagcaacaggaattctcattcactgctggtgagaatgcaaaatggtacagccacattctcttaccctcccatcagcagctgtgctccttggtatttacccaaagatgttgaaaacttacattcacacaaaagcctgcacacagatgtttatagcaactttatctataattgccaaaatttggatgcagtgaagaagacctttagttggtgagtggacaaataaagtgtggtacacctagacaatggagtataactcagcactaaaaagaaatgagccattaaggcacatggaaggaccttaaatgcatattaccaagtgaaagaagctgatctgaaaaggctacatactgttggattccaactctatgacattttggaaaagataaaactacggagacagtaaaagcatcagtggttgtcagaactgggggcagggagagatgaataggcagaatacagatttttagggcagtgaaagtattctgaataccattttttttttttgagatggagtttcgctctgttgcccaggctggagtgcagtggcatgatctcggctcactgcaacctctgcctcccaggttcaagcaattcccctttctcagcctcccgagtagctgggattacaagtgcgcaccaccatgcctggcttatttttgtatttttagtagagatggggtttcaccatgttggtcaggatggtctggaactcctgacctcgtgatccgcccacctcggcctctaaagtgctaggattacaggcgtgagccatcacaccccgcctgatatattaatataatgggggatacatgtcattgtacatttgtccaaacccgtagaatgtacgacatagagtgaatcctaacataaactattgacttttggtgataatggtgtgtcagtgttggttcatcgattgtaacaaataataccactgtggtgcagtatgttgataggcaggttgtgcatatgtgggggaaatatctcttggttttgctgtgaacctaaaactgctataaaaaaataaaatacgatcgggcaaagcggctcatgcctgtaattccagccctttgagaggctgaggcaggaggactgcttgaggcctaggagtttgagaccagcctgggcaatatattggaagacccccatctctacaaaaaaatttaaaaattagctgagcatggtgacatgcacctgtagtcctagctactttgcgggcaaatgtgggaagattgtttgagctcagaaggtcaagactacagtgagctgtgatagcaccattgcactccagcctgggcaacaaagagagaccctgtcttggaaaagagaaaaaaaggaatctgttaaaaaatgcctcctggccgggtgcagtggctcacacctgtaatcccagcatttcgggaggccgacccaggcggatcatggggtcaggagatcgagaccatcctagctaacatggtgaaaccccgtccctactaaaaatacaaaaaattagccgggcgtggtggcgggtgcctgtagtcccagctactcgggaggctgaggcaggagtatggcatgaacctgggaagcagaggttgcagtgagccaagatcgtgccactgcactccagcctgagcgacagagcgagactcgctatctcaaaaaaaaaaaaaaaaaaaagcctttcaataagaaaaaataatgaacagtaagaaataataacctttgaggtaggataggctggaaggactttctcaaatatgggaaactttaccaaatttagtcttttaactaaattaaattcatgtttggcgattgggagaaggtacttcatttctaaactgaaagaaggtgggcaaaagcataaactctggttaagcatgactagtacactttgggcattctgtgggaaagaatgggagatagattggagattacagtactttttgatgaagattagcacccactggtcatctgtaagagagttgagtagctaaccatcacagatcaaggtgtacaacttcagcatgtctgaccaagagaacatgtgtctactctgcacatcagatgtgggcgagtggtttgactgccttttgtaggattgagatgtccagatggccatgagggagttctaagtacccctatgagagatgttgatagacctactcagtttggtgctgaattaatgcccccagagctctgtgctcacatttgagctaggaaaataccttggcccatgaagggcgtgtggtggagatgagaaggaagggatgcttggtaaagctggataagaccaaagaaatgaagaagatagtaggaagaaataggaaaaaaagaggggaaggggggaggagggaaaaagaagaaacattaaggaagttctgctttgttgctatattcaactccgacttctgtcagtgaatttgatgactaaagagctagtgtagttctctttggagagaatgttgatggggagaggttactatgttatttgttctgctggttcttgcactggtccagctaggtttgtgatattgatggggagcagtttccttgaagccagaaactaaagcccatcctctttcaggaggagagggaagagagagcagagttaacacaatgtattatctaagatctctcggaagcaaaagctttcaccaagagtaactagttaccatcagtaatgatgttttatactttttgttcataattgtatccaaaatagggtttgagtttcttttaaaagaccaatgaggcgtatatcttattttgttcttaattgttcaaaactaacacattagctctgtagaagttaaagctcaccttggaagatgtaccagaggaatgggtggttgttgtttttaaatgtttggaatttaaagttgaattaggtggctgggcatggtggctcacacctgtaatcccagcactttgggaggcccaggcaggtggatcacctgaggtcaggagttcgagatcagcctggtgaacatggtgaaaccccatctttactaaaaaaaaaacaaaaaaacaaaattagccaggtgtggtggtgcatgcctgcaatcccagctacttgggaggctaaggcaggagaattgcttgaacccgggaggtggaggttgcagtcagccgacatcacactattgtgctccagcctgggcaagaagagtgaaacttcatcaaaaaaaataaaaaaataaaaaaataaattaggtaattagttggtagtctagaatttgactttctagttatagaattaataaatacttggaagtatttcttcaatatcttattctaaattttaccctttgatgaaaatctcacagatatcaagatgtaccaagtatgtcccaattatactggttggtaaattcaccagaattggtgaaggaggctgggcatggtggctcatacctgtaatcccagcactttgggaggccaaggtgggccaaacacttgaggtcaggagttcaagaccagcctggccaacatggtgaaaccctgtctctactaaaaatacaaaaattagctgggcgtggtgacaggcacctgtgctcccagctacttgggaggctgaggcacgagaatcgcttgaacccaggaggcagaggttgcggtgagccgagattgtgacactgcactccagcctgggcaacagagtgagactcaaaaaaacaaaaagaaaaagaagtattggaggagtaagaataccagccatttgtcttcctatttgcatataaaatggacaatatttaaattttaagcctttttatccaatgttatatttaagtgcttttcaacattaatgccaaaatgattttatgccagctgtatagatttgcctcttaatgtactgtagctatcattttgatttcctgcatatccttaaacacaattgtactttgaaatttaaattagtaatttaagttcttaagtgtagtttcatgctatattacgtttttttgtggtagtgctattacccactcagattatgctttttttcgtaggctatagaagtttaaattattaggataatatttccatcttttctgccaggaagtgttttctccatgagtattagttattttctgattagtggaactctcaaaactgaccaggggtggggtgggattgttgcaagatgtcatcaataagcactagaccaggagtaaaaaagatctgacttctaattctgccacataataaattactgattggccttcaacaaataacagaatcagtaggcctctgatgtttttgtttttgttttgattaattgtggtaaaataacacatacaatttattgtaaccatttttaagtgtacagttcactggcaataagtatattcacaggcatcaccactattcacctctagaattcctttcatcttgcaaaactgaaactctgtacccattaataattctccattccccttcaccccagccattggaaaccgccattctactgtctctgattttgactaccttaggtacctcacatacgtggaattatatagtatctgtccatttgggactactttatttcacttaacattatcaaggttcatccatattatagcatgtatcagaatttccttccttttaaaggctgaataatattttggtgtatatatatactacattttgttcattgatcttttactggacacttgggttacttccgccttttggctattgtgagtaatgctgctatgaatgaacatgggtgtacaaatatctctttgagaccctgttttcagatctttagtttatatacctagaggtagagttactggatcatttgtcaattctatattcaattttttgtggaatcgtattgttttacaaagcagctgcaccatttacattcctaacagcacacaagcgttctaatttctccacatcctcaccaacatttggcattttctgatgtctctaggaagcaaaagctttcaccaagggcaactaaggatttttttttttttagtagtagccatcataagtgtgaggtggtatctcattgtggtttgatttgcatttccccggtgattagtaatgttgagtatctttttaagtgctaattggacatttgtatttttatagaaatgtgtattcaagtcctttgcccattttgaaatcaggttgtgttttctgttgagttgtaggagttctttatatatttgagatattaaccccttatgacatatatgatctgtacatattttctctcattccatgggtagccttttactctgttgattgtgtcatttggtgcacagtttttaattttgatgtctaatttattagcttttggtgtcatgtccaagaaaccattgccaaatccaatgtgataaagcttttccctaagcttttttctaggagttttatagttttagctcatatggttaggtctttgatccattttgagttaatttttgtatatggcataaggtaagggtccaacttcattcttttgcacgtggatatgcagttttctcagcatcgttttttgagaagactgtcctttcaccattgaattgttttggcaccgttgttgaaatcatttgaccatatacacaaggtttgtttctgggcagtttcttctattccattggtcttaatatgtctgtctttctgccagtaccacactagttttttttttgagctggagtcttgctctgtcatcaggctggagtgcagtggcacgatcttggctcactgcaacctctgcccccctgggttcaagtgattctcctgccccagcctcctgagtacctgggaccacaggggtacgccaccatgcctggctaattttttgtatttttagtagagacgggggtttcaccatgtttagccaggctggtctcgaactcctaatctcaagtgatctgcctgcctcggccacccaaagtgctgggattacaggcatgagccaccatgccgggccactttgtgataagttttgacatcaggaataagttagtcttctttttcaaaattattttcactgttcaaaattttttagccttagtgatgctaagattaaaggattcaggtggtaacagcctgatccctccattgcagagggatctctgcaatcgatattttgcataattgtttcatcaatttgtgatgattgcctaaatcatttcattagaagttacaaagtagcgattccttctacttttattagctggaattcttttgaagtgggggaatccttttgttcatcaacagtgacttatcttgaaatttaatttctaccaaaaaggctggttaaatgcttaattctttacctttaattttcagttgttagagtaagaaggtgatgctcttgttgctttcaatgaaattaatgaagaagaagaattaaatatttggtttgatttccccctttttgtaagtgtcgttgtaaactcttagattctgtatatgaaacctgttttagttctttgcagatagtggctaaggaatatgtatttttaacacagaaaccacatgatcttgatggaggtggttggtctgcagagcagactcctataaagtagtgttatggattttaaaacagttactgttttgttgtgtatgtcttccctaccaaagatggtgtccattaacaagttagtgtccggtcttatcaaaggcagatgttatcaacataatttatcattattttaaaatgtattattatttttgagacagggtctcactttatcatccaggctggagtgcagcggcacaatcgtagcttactgcagcctcaaacgtaagggctcaagtagtcctcccacctcagcctcctgagtagctgggactgcaggcatgtgccatgatgcccagctaatttttaaattttttttgtagagttggagtgtagctgtgttgctacacttgtgggctcaagtgatccttctaccttagcctcctgggaggctggaggctacaggcatgaaccactgtgctctgcaataatttatatttaaattagcaatattaaatgttaacacatcttagtaaggaggtattttctgccttcaatttgctgtcattgttatagttctccaggttaaattagacatacccgatcctcagacgttacccttaacagtgactccaacttccaacagggcaacacagtaagcagttttttaatgctacttatggtgctaagtacttttgcattaataatttgctccttattgagcacctgccttgtgccagtcaccatcctagggaatttccttatctccatttttacggtgtctcaccttgacctaattttattttttgaatatgtgaaacattttgtgattcctaagtcaaaacttatttacgtaatatatttagatggatataatatatatccatccctgcccccttcagctagtcccatcctcctgctatagggtactcatttttattcattgtttttttcttttagcaaacactagcaaatgtatataaatttgccccttttctaagacaatcttataactacagatattgatctgcatcttagcttttttttttttttttttggagacagagtcttgctctgtcacccaggctggagtgcagtggtgcaatcttggctcactgcaacctctgcctcccagattcaaacgattctcctgcctcagcctcccaagtagctgggactacgggcctgcaccaccatgctcgactaatttttgtatttttagtagagacggggtttcaccatgttggccaggctgatcttgagctcctgacctcaggtgatccacccgcctcagcctcccaaagtattacaggcgtgagccactgtgcctggccactttttttcacttaatatgtatatcctagagagcactcttaaaaggtaatagaggccagatgtggtggctcatgcctgtcttccccgcactttgtaaggctgaggcaggaggatcacttcagcccaggagttgaagaccagcctgggcaacaaagggagaccccatttctacaaaaagtaaatagtcaggcatggtggcaagtgcctgcgtgtagtcccagctactcaagaggttgaggggggaggatcacttgagcccaggaggtcaaggctgcagtgagccatgattatgccactgcacttcatccagcctgagtgacagagtgagactctctgtctcaaaaacaagttaatggaaatcttcatttcttctgtgatacagaagaaatgaagatccttctatatatatatatattctgtgtacctactgatgaacatttgagttgttttaaatttcttgctgttaacaaataatgcagtattcttaattctcctcttctagcttcttcctcatctctctgccctccattgtagcaaaacttcttcgcaaatgtaccaataataattgtctccacctcctgatctcttactctcacaaattctatgtagctgtctatccccattactccgctgaaactgactgcttttttcaagctctccagtgacctttgtgttgctacatccaatggtttgtccttagtactctactgacttattagcagcactggactcagctggtgactctgtcctctgtcctcttgaaacactcgtcactaggcttctagagcaccatagactcccggttttcctttattgtcagggctgttccttctctatcttttctgatgcccttggtattgaatgaatacatctcttctccttccttatggtatcagctgatggctgagccaggtgggcccatttcagaggagggcagtcatgaaagagggaagactgtaaggaaaagggtgatggggtctctgcatctatgagctggaatgagggggaggaagagaggaaggcatctaggttcaaagatcaccaggaacaagcctgtagcctgacaaaatcagattattgacgtgatgcagtgagtgaaggcacttcagaggaactgtggaatgccatggaacaggaaggaggagggaagcatcttttgtagggcttgggttctagctaaaggattctgaggaagctttaagggatgcttggtaggacaggggtcagttctggattggttgctgtttctgagacaggattaggtgaaacaggaataattagggtttaggtgttgacatgaagcaagggcagtttagcaattgggtattctcagtaatagatggctatagcaaactaggtctggaagcattattggtacgaaggcagtagccacacaaagagagggtcattaggacattttactgctgctgcatgaccttgggagaaataatatttcctcttaactttgtacttgtctttatctgtgtctgtcctcccagtccaattatgggagagttgctttttcctttttcattctgaacagattttcatttttcagccccagccaggtttttactcttaattccatggcactgatttcctggatttgggaagcaaggatccttgtttcctaagatttgagagaaataagtgattaaatgattgctgtactgctccctccccatgtttaagggaaaatctcatatttttgaaatagggcataatgtggaaaaattgtgaaataggaatagtttctttgttgtttcctcttcagttctcctatcagtgcctttcttaggcttctcttctttcctgcgtgaacttgtgcccattggttgatctgatttgttactctgatgattagatttaaggtagcttaatacgttttttgaggggcatttgcattttaaaaggaaattcctgggtataatgctaaatactaaggaacaagtttctaatgcacatttgaggtaagaggtggtagggagtgagaatgggtagggatgcggagtttcagtggaggttgtccttcagcggtactctgctgctggtggggtctaagcctcggaaatcaggaggtcactgagaagctgatgaactggagcctatctctagccttttcccctttaggtgctgaggcgtaggtggcatgttgacagatgtggtgaaagaatctgagtgcccagacatgtgtcaggggagcgtggctactgtgctgagtaaattatgtggcagtgcagactagaagttgagactagacagatcagcaccgggacaactggaagttccttcttttcacaatggtatgcacacactgctgccttagcagttctaagagacacgcacaaagatgtcaagacctgctcataatactgactttttttttcaatttgagagcgcatactgtttattaactgactagattagaaaaataatcatgatagacgccttagttcattcttctattaagcgtgttgatctggtccaccctgttgccaccatctccaccttctacaaaatgtgtagttttttcttcattccacttaatgcagaagataatttgaagggccacaggaagttatttgcttctttgaagcattttccaacagtatagatctcatgatcagatcctccatgcaggtgatgccatatttaccaagaggtcgagcaatcaaagtgttgtctgtcagagcaactcacttcttattgattttgccataaccatgcttgtagattagttcatttactgacttcagatttgggtactcctatgcaatatatggttctacaatcctcagcatgttaattgaagccttgttgagcttcacaaaagttccattaaagatttgatgaaggcaaagaagctgcaacacctttcagacctttgggttcacaccattgatacctctgatcctaatgataaatgccaatttgagttctgcaggtacatagaagttgctagtttttcttgccatccttgccatttgaatttcagttctgtgcatctgcttatattccttgtgatagataagcttcctccttgcctttcaaagcaccttttgggcaaacttctttctcaggcgattgatcttcagctctgcaaaattccttcgctttttcttaagggtttctggcacagcaggaaccttcttctcttcgacaccctccatggttccagcctgaaaagagcataatactgacttttgcactgcctactgttggggcatgtttcagtccactttcaagcctttctcactgaagctagacagtacacacccagcttttctatagagatgaaatatgagcctgtagcttatagctcagcagctgactgcagccagaccccttttgtttcttaatccttaggggaagtgtgaagttcctgttctgctttgaagatgggttgatcttcctaaaggatttgaacccacaaccttcaaatctggaagtggcctccaccataatcttcctgttgaccttcaccaggctttgcctcctgatgccagggcattcatgtctcacaactcccaggcacaaggagtggtggttgctctaaagatcagaagcatccaagagtttagtctcagctatacctttaaccactgggaggtgtccatgtacgttagatttttgaagtggtcccttcccaagtcccctgacctttccccttgggaagcccagaaccaagtggaagcctattgatgaagcagtttattgtttggcttaagtggtttctctttacaactgctggtcaaaagcagactctgggattagtcaagcagcctcagcccaacatccacatcaagatgatggtggttcggttgtacagtcattgatgtaaccctagtttgaagactgttaactgatctgtaatgctctactgggaaagggagcgtttccctgcagataggactggcttctgtcttcagctgataaaacggtgtttttgaggcttctaaaggacttgggcgcatgatggttccctttttgccctgctacaaccttgttctacccctcgcttgatatcaaaacactctcttttgctagtcaattctctccatagaaagtggtctgcatcagctctattgcagtttttgtttttgtttttgtttaagatggagtctcgctctgtgtcccaggctggagtgtagtggcatgatctcggctcactgcaacctgcccctcccaggttcaagtgattctcctgccccagcctccccagtagctgggattacaggtgtgtgccaccatgcctggctaatttttgcatttttagtagagacaaggtttcaccatgttggccgggctggtcttgaactcctgaccttaggtgatccacccacctcagcctcccaaagttctgggactacaggtgtgagccaccatgcctggcctctgttgcagttttacctgttaatttctgaaatatgattttctaatactgtaccaatgtattttagtgtatgttttgtaataattaggtttacagaaaagttgcaaatatagagttcttatatacccagtttttcctattgttatcaccttacattatcatagtacacttgttaaagacatcaacattggtatattactattaattaaactccagactttatttggatttcaccaatttttttcactaatgacctgtttctattccagaatccaatctaggctaccacattacacttagttgtcatgtgccccaatctcttctagtcagtgacaatttctcagtctttcagtgtttttcatgacccttgactgtcttaaggaatactggcaagtatcctatagaatgacatgtaatctgagcttgtctgatgttttcctcatgattacactgatgttacggggtttagaaagaataccacagaggtaaagcaccctatcaagggtacttgatattcatctaatatcattggtgatgctaaccttgatcacttggttaagtagtatgtttgccaggtttttctattgtagagttactgtttttccttctccctatacaattttttggaagcgaatcacaaggctagcccactctcaaggagggaatgggagatgtatagaattaagttctacctcttggaaacagggagtatctacatatattgtttggaattcctctgttaggaagtttgtctcttctctcccacttatatgtatagcactgtggatccatgaatatatatatatatataaaatataatatatataataatatataaaaaatatataatatacattttatatatatatatttttttttttttattattttttgagatggagtcttgctctgtcgcccaggctggagtgcagtggcgtggcctctgctcactacaagctctgcttcctgggttcacgccattctcctgcctcagcctcccgagtagctgggactacaggtgcccgccaccatgcccggctaattttttgtatatttagtagtgacgggatttcaccgttttagccaggatggtctcgatctcctgacctggcgatccacctgccttggcctcccacggtgcaaggattataggcgtgagccaccgcacccagccaggattcatgtatgtttattttatactttggattgtgacttaaaactatgttatttattatgttgctcgaattgttccagctttggccagtggaagttctttctggttggtttatatgtccctgtgacatgcccttatccttttgttctttgaccactttctttctgctactataggatgtttcagattcatcttgtattttccatgccctagccgcagaatcagccatttatccaaggagctcttgtactttttactggagaatcctatatagaaaccaaaatctgggcactgggtatgttcattgctactggggtgtcataaattctagtccttcttggcaaacagagctagataatacatgtatgcacaccaacttttgtatatggacgtatctacaactgattccgtatttcttcatctattataaccaggaacttatattgacatctctgactttaattcagtaccacagcattcatttttagaatgccttcctttcttgcttatctataatatcttcaaaagtgaggaaccttgttcccactatataacatccgtttacttatttgttcagccccagtatacactgacagcagtttcagaattatatcccatcagaaacagatttaccagttgggaatgttgcactgatttttactattttattttactggagaaattgtagatgtgtatatgctgattatgatgtgatttgacctctgatgctagcttttacatgtatgcagacattttttatctgaccataatctgtgatgtctttgtatgtcagtatgaatcgttgagattatggatgtgagctccaacttaaacattttccttttattctcttacacttattctaaaaatttgtttgattggctttggttttttgttgttgttgttgttgttgttgttgttgtttttgagacagggtctcactctgtcacccaggccagagtgcagtgatgcgatctcggctcactgcaacctccacctcctcttaggttccagtgattctcatgcctcagcatgctaggtagctgagactacaggtgcacaccaccacatgtaacaaatttttttttttttttccttgagacggagtctcgcactgttgcccaggctggagtgcagtggcgcaatctcggctcactgcaagctccgcctcccgggttcacgccattctcctgcctcagcctcctgagtagctgggactacaggtgcccaccaccatgcccggctaatttttttgtatttttagtagagatggggtttcaccgtgttagccaggatggtcttgatctcctgacctcatgatccgcccgccttggcctcccaaaatgctgggattgcaggcgtgagccactgcacccagccaaatttttgtatttttagtagggatggggtttcaccatgttgcccaggctgatctggaactcctgaccttaagtgatccacctgctttggcctcccaaagtgctggcattacaggcatgagctgctgtacctggcctcttttatacttatcgtccaagattaagaaataggaaagctatgttttctctttagtaatttatgatgtatttctacaaaaggaagtttatactataataatgaggttttgtcatctgtaaagggacaagttgaatgagataacatttacagtactttctagctctaatgttctgtctccggtgctttttatttttattattattattttttgagacagggtctcactgttgcccaggctgaagcacagtggtacaacctcgacctcctaggctcaggctatcctcccacctcagcctcccaagtagctgggtctacaagcgtgtgccaccatgcctggctaatttttgtattttttgtggaaacagtgtttcaccgttgttgcctaggctggtgttgccataggctggtcgcaaactcctgagttcaagcagtctgctcacattggcttcccaaagtgctgggattacagatgtgagtggctgtgactggcctcaggtgctttaaaagaaaatctccttaaggccagacattttagaatcagggtctccatttgcttactaagtcctcattgtgttctcatggcacatgattctacctccttggctacttctctgggacatttgtggtccattcttcctgttggtgccaaagatcacaggtgccaaagacctgtgggtaaagatactatggcttgggaaatgggactgacttaaccatagctttagttccctgggtatttgggttcctatgttcctgttaggtgtgagtttttaaagctatactaaaagctgggtgttctcagtctgctttaacttaaattatgaccttgagctcatcacttttacctctagacttcagattttttaaatctagaaaacgaagcagtttcattggatgatctcttccacttgtggttttattataacagatggtaaagtatctggctagcagctagttcttatctcagtgatcaaggcattctggtaagaattgggaatggtcattgtctatgaaacaagcttattaggccatctttaccttttctttactttttcatttgtttgattaaagtaatacagtaggcagggggtgaacgcattctggaatataaggtctagaagtggtacaagatgattgagattgtaccacgtagaagttgtattttgctgttcatgatgacccattgcagcagtaacttaggagggtcagaactgatatttattgttggtgtttataaatcagtggcttctcaaatgactttccttttatagctactatgtagaatctatgtacagagctgagcaatagccaacgcaaagagatggggaggtggcttaagtatgataagttctggtgagtcatactaaggacatttttggccagtgcagtggcttatgcctgtaatcccaatacttggagaggctgaaccaggaggatcgcttgagcccaggagtttgccaacctgggcaacatagtgagacctcatctctactaaaaatttaattaaaaaaaaaaaaaaagacatcagaaagaaagaaagaaaggaaaggagagggaaggagagggggagggggagggggaaagaagtctcactgtgttgcccagaatggtctcaaactcctgggctcaagtgatcctcgttcctcaaccacccagagtgctggaattacaggtgctagccactgcacccagcctaaagatgctttagttctaaagggagaaaaggggtggtggtaggttattagtcttatttatggataacagctttcagaatagctttctcataagcatttagtttcctgagctaagaatgaagcatatgacctgtagcttagtagctgtgtgccaaatctatcatgtacttacaaaagaatttatttttaaaacagatgggtggtagacaaggaggagtaaaactacaggttgagtatcccttatctgaaatgcttgagaccagaagtgtttcagattttacatttttttggatttttgaatatttgcattatatcagttcatcatccctaatccaaaaattcaaaatctgaaatgattcaatgagattttcttttgagtgtcagattggtggtcaaaaagttttggattttcaaattaggaatactcagcctgtattgtaagacagggcttatctgtttgggaaaaacaaatagtagagtgaaggaatgctgtcttgtgttagaaagctaggataggagagcatggaatgattctccctcaggctgcctgctattggattgtcccacttcattggattgatttatgagattgagctttgaacacaggtcctctgacccactattcctggcactgtcccagattttcaagggaagtggcacactacatgtgtggtgttaagtcaagaggtttaacttttatgttgctagtttacatggggatttatattttcttttcttttttttctttttctttttctttttttttttgagacggagtcttgctcagtcgcccaggctggagtgcagtggcgtgatttcagctcactgcaagctctgcctcccgggttcatgccattctcctgcctcagcctctcgagtggctgggactataggagcccgccaccatgcctggctaatttttttttgtaattttagtagagacggggtttcaccgtgttagccaggatggtctcgatctcctgacctcgtgatccacctgcctcggcctcccaaagtgctgggattacaggcatgagccaccacacccggccatattttctttgatgataagtgtatctggaatgaatgtacattcctgtgagtcatactagtgctgctgctggtggctttaatttcctcttcttagaggagaaagaaattgctaattccaggagtgaacagcagatgtcactgcatctccacttactagggcctgactcttagctgtttggatacaaccagttcttaatacagctcccaaacctcttaagtttttatggttgtataatactttaagattcccttttttttggagataggctctcactctgtcatccaggctggctgtttggatacaaccagttcttaatacagcttccaaacctctaagtttttatggttgtatgatactttaagattccaccccaccttttttttttgagataggctcttactctgtcatccaggctggagtgcaggggcacgatctcagctcactacaacctccgcctcccaggttcaagcaattatcccatcttagcctcctaagtagccaagactacaggcgtgcaccaccacatccagctaatttttgtatttttagtagagacagggtttttgccatgttggccaggctagtctcgaactcctgacctcaagtgatccacccacctcggcctcccaaagtgttgggattacaggcatgagccaccgtgcccagccaggctgccttcttttgatatacagcccaaattaaaaatttagaataaacacagcctgagagagttttccttagtttccttcactgcttgtttttagtgtttgttctaggattatattatctctatttctaggtagctaactgatggaatgcatttgcctttttctatcaacctttcaacagttatttaggatcctagacagttcttcgtatttgtgttcagtacggttcacacagttaaaagcttcttggcctttctgtattttgctttttgaaaaccttccaacaggaatgtacgtgtcactgttctctggagtgaggtgctgaacatcaaaggttcaggaaccgctactttctttttttatttgaacccttagctttggcacttgagcaaatcaagagctgaactatgaccaaatgtcctatggtacatctatttaaaaatacatttatggtttaattgtggataggtggtagagtttccctctatagtcttgtactgtataatgatgttttggtcagtgatggtggtcccataaagttataatggagctgaaaaattcctgttacctagtgacactgtagcttccataacattgtagtttgttttttaatgaatttggtgtaacctaactgcacagtgtttatgaagtctacatagtatttagtaatgtccacattcactcactgactcacccagatcaacttccaggcttgaaagctccatggtaagttccctaggcaggtacatcattttttatctttcatatcatatattttactattctatgtttagctattttttttaattttttaatttttttttgagatggagtcttgctgtgtcaactaggctagagtgcagtggcacaatctcggctccacctcccaggctcaagcaattctcctgcctcagcctcctgagtagccgggattataggcacccgccactatgcccagctagttttttaattttcagtagagatggggtttcactatgttggccaggctggtctcgaacttctgacctcaagtgatcttcctgcctcagcctcccagagtgttgggattacaggcatgagccaccacccacggctgtaatttttttttttttttaagacagggtggtgctgtgttgcctgagctggagtgcattggtgtaatcacagctcactgcagcctctacctcctgggctcaagcgatcctcccacctctgtcccccaagtagctgggactacaggcgagcaccaccacggccagctaatttttaagtttttggtagagacagagtctccctgtgtcacccaggacggtctcaaactcttggtctgaagtgatcctcttgcctagacctcccagaatgcccaggattacagacatgaaatctggcctggccttagatacgtttagatacacatatacttactgttgtattacagttgcctacagtattcaataaagtaacagtacagtaacatgctatagagatttgtagcctaagagcaataggctataccatatagcctaggtgtgtagtaggctctactatctaggttttgtacactctatgatgttcacacagtgataaattgcctaatgatacatttctcagaacatatcttcttcattaagcaatgcatgactgtatgacagaaaagcaaagcaggtgttaaattgggtattttagaaagtctgaggcatgccaaattcttggtgtcttttggtcaaatagattgagaagatagccagggtgatagtatcttccattttgtctagataaatgctggtcctggcgtaattattaataggtccctctttcactctcatttgtcctagtttggacaacatatggtcattctaaattgcccccaaagggaagagcattgataaagttgtaattctcataattgtaaaatacatgtaaaataaagtgaaaaaccacaaagagataccaattctaggaaacttttgatttctatctattgatcgttctctggaataatgatttccaaagatgacggtgcattggcatcaactggtaagctttttataaatagagtttcatggatctcaccacagacctctgctgaatttatactagaatttgaatttgacattaccaaaaatgtagctatgcatgcaatgcaaatgtaccaggcagctttgttagcaagcttttaaaactagcatatagaagaatgtttcattctgtggtttggataatgtttggggtttttggtggtggctatcttgggcctttaagggtaagcctggcattgaaatgagttacctttttgtttcagatgtcatctgggtgattctcagtgtggaggtgggtggacttttaggagtaacgcagcagctgtcatcttttgaaacggagttcaacacacagccgcatcgtaaggtagaaggaaacttcaacccttttgcctctccccaaaagaaccgacaatcagatgaaaacaacttaaaagaccctgggggctccgagttcgactcgatcagcaaaaacacatgggctcctgctcctgacacatgggctcctgctcctgaccaaactgagcaagaccagaatagactgtcacagaactctgtaaatctgtctcccagcagtcacgcaaacaacttatcagtagtgacttacagtaaggtaggtgcccttggagaagagaaggggtaggtggtgggccttgggacttgtgataccccttcatggcaaacctagaatcctagactgccgctccccagaggaggttctttaagactgctcagctctcctgccaatagcaacaatgcaaaagcttaccccttctcccgtttccccagccccatcttcatgtcctgtggatgttgcttcatccacatttataatttactcctgtctctctgctatggtttgggtgttgaaagagtgaagttctttacctttagtattttaaaaaaagaaacaatgttgctcaattatttattctaaatattgttgttgggctttgctttatttaccctgtttgcatgtcttgttgatgtcttttcagtccttatggcccatcgacttccttatccatgacccagagaggccccagtgatattttgacttttcaaatgtggtgaataagtgagagttgtttgttgagttaactgtgattttaaatattctgattgttgtgaggcacttttctaggtgtttgatttcttgatctgttttcttctatgccaattgattaaacagtgtcttccacagtttgctaaggtgatgatggtgcctggttgttggttttggttggttgaataaagccctgatgctgggagttcattgttgtaggtggttcaagtggtggagtcctgtaagcattcctgtgtattcttctctgaataataatgctgcatattaagcctagcatcctacccatattaccacataaactgttaggtctgtcctggcttcaattcatgttggcgttcaccttaaattttaaaaataaagtttatgtttatttgaggggcaagtgactatgttgtaagaatgatatttttctgaccagtagttttattttatttttactttttatttgttccaagatggagtcttgctctgtcacccaggctggagtgtagtgacacaatctcggctgactgcaacctccacctcccgggctcaagaaattctcctacctcagcctcctgagtagctgggattacaggtgcccaccaccatgcctggctaatgttttgtatttttagtagagacagggtttcactatgttggctgggctggtctcgaactcctgatctcaagtgatcctcctgccttggcctcccgaagtgctgggattacaggtgtgaaccaccacgcccagccctcctttttttttttttttttttttttgtttttgttttggagacggagtttcgctcttcttgcccaggctggagtgcagtggcgcaatctcggctcactgcaacctctgcctcccgggttcaagtgattctcctgcctcagcctccggagtagctgggattacagacatgtgccaccacgcccagctaattttgtattgttagtagagatggggtttcaccacgttggtcatgctggtctgtaactcttgacctcaggtgatccacccgcctcggcctcccaaagtgttgggattacaggcgtgagccaccgtgcccagcctgaccagtagtttaaatgtggtctagatcaagagacaaattaagaaacctggtgatgtgagtcctctttcacatggtctagtaggaaagacttcattcagtagtaatagcataaatgaaggattagagtcctctttcacatggtctagtaggaaagacttcagtagtaatagcataaatgaaggattaatttattggttgattagatgttcattacaaaggattttgtggattagtgttaattgtataggatagaagtaaattggcaagagagtaaattgcctgtatttgaggaaagacgtttcacatcttaacactctaataaataaaatattttcttctaagctcctatttctctagtattttttcttgaatttaaccctccagagtctgtgactgttcagggtggtaaatgggccagccctgggctaagcatgctttgttagaatgagaacttcagtctgttgggtttaatgggaagatgaacattaaggcaaaacaaccaattgctcctgtgctttctctaatggaagctgcctcacccacctatgagctttctggcttggccatcgctgcagttttaggagagggctgctgttcttggccagggcactgtacttgtcttcctgaattgagagcccattaattgttttcctctcctttagggactgatgctttttaaccacctctgtgatggttgcacacagtcatcacagacggttgggaatggtgggctggtattttctgccagctttaattaaggtcctaccagggtttgcttcttttggaagggctggactatggtgaggttattgacttatttattggagttgatgaactagtattaatatgttatctaatttttttcctggactttgtaggatcatttagaagtagcatttgcaagaactgtagagaaaagcttcccattagagatagactgttgactataatgcgttgaaaatgtgaaacttagatgccaaagagaaattggggtctcctttttttcttaatctaagcagaatcttagaaagcaatttatatgaagcatcgagcaggttccctgaaggcatttctggctaaagttgagtcagctccactctagctcttagggctccttagaatagggtgtaggaagtagtcatcagtaaatattcatacatctgtgcactgttcagagcagtgtacatcgtacattaggagacttgaggaataaaaggatccctacccactaggagcccgcagtacagtaggggaaatgaaacatgcacaaagcaattagagagcagttcagtcaaaatgaagtatgaatttgctcaatagagagcaatacagtcctaatatataatttgtgttttgggttttgtgtttgtgtgtatgtattgtttttttgagatagagtctcactctgccacccagactggagtgcagtggcacaatcacagctcactgcagccttgacttcctgggctcaagcaatcctctatctcagcctcccgggtagctgggaccacaggcgcccgccactacgcccggccaattttctgcattttttagtagagacggggtttcaccgttttagccgggatggtctcgatctcctgaccccgtgatccgcccgcctcggcctcccaaagtgctgggattacaggcgtgagtaaatttttgtatttttagtacagatagggtttcaccatgttggccaggctggtctcgaactcctgacctcaagtggtctgcccacctcggcctcccaaagtgctgggattacagatgtgagccaccgtgcccggctcagttgccatctttattggctagggaggaggggtgcctaaggtgctagtgtcagggatcactgagttggcaatagatctgattaactccagagagatctctgcttgccatcaaggctgggaaagaacgtgatgctctggaagcctatgaccacagttttagtaggcaggtagtttcctgctgcctccatagttacagtttaacttgctaaggttggtaggatgaaggtaatagattgcttcaggcacctgcactatgagagctgggtggatatgtcaacagaatggcacatctgtcagtgccaggaaacagacaccctggagtccttcccagctgttcttgaatcgtaagctccctgaactcagtgctccgtccctggggggaacgcctgccctagctgcatcccacaacgcaaaggggcttctccctgtgggagagctgtcagaaggagtcagaaaagtaaatatatgctgactcgcctcaaagattcataaatctggctccctgcttttgttagaaattggcttgcctcattgtcagctcagttgtggctgaactgtctgtcccaggtgaacagtgagatcaagtactggtgaaggctagaaagtgttttaatgatccctttttatgtgattagctgaagagcatctgacgatcaagttagggtagcataggtgctcactccgttgactcaaggctaaccttgctgtgaattctagcactctgactcatctctggggggccagagtagcttctgtttggacagtgcgaaactgatgaaaaacaattcacagagatgtggaaagagaaaaaaaagtcctgttaaagttacgtatgcctttttcttatatgccagtaatttttaaaatttcactgttttctaagaaggcctttacagagcaataagaccccaagtggtctgattcaggacagctggggataagagtgtggctggcagaatcgaggggctgttctttaggacagctacctgctttgctttctttcactaaaggagtaatgatttacactgggagctgaagaggaccccaaattcacttattttgttacttgaaatatggctcttatattgtgtttgttctttctttaaaaaaaaaagtgttcgaggctggtatatgccatatattcccactttaaactggattacagtctgagccactgttattacttccatcaaatgctggttcagaaggagaaacttattattatctttgtggggaggttcatcccgctcctccagagccatccctgccaagtgccatctgctcgcgcactcgtgcttgctggcttgcttttgtgcttattctcttcccccacccccacccctttcctctcttgacagtcatcctgtagagcattttgtatctggagctagcaggagtcagtctgcttctgttacatcagaaatcagctctttttctcacctgctgctatctatgttgactaaggcatagaagagttcttttctctccatccaggtgagggtttagaaacagtagttgggggggcgggtactggaggaggtttggaaaaggcagatcttttgttctatgggcctggcgatgtaatggcttgtggatctattatctactttgaaatggccaaaaagtttaacataataataagggaagagtttggggtgactttgtggaattgggaccaacatttgcccaggcagtttgaccagaaggcaggtagttggtgtcctcaactgggctagtgcttatgtgaggcattaagagggcaccagtgtaaccttcccactgccatgaaaccctagagttgtcttcattctcacatgcagatcctctccatgaaaggtttaaagatggttcaaagagaagctagatggaaaatcggtgtaacttggccctctggcaaggaacaggtagtgagaacacactattctcatgccaatgaaagaacattaatcagagctgtaaaactatcattgattgagcagttatgcgccaggcactgtgctgaggacttttttaaatttaatttttgttattaaaatttatcagtgtacgtagtttaaggaaccaaatagttctaccaagcttatgacaaaaaactccagtcacctccctgcttcccagcctccagtttttattccgcagagacaataggctcagtgcttgacatgcattacttcatgtagtccacaaacagtaccatgataaaagtattgttattatcactcctttacagttactgagactggttcagtgatttgcccaaggtcatgtaccggggtgataagaccaggataccaacaaaagcagttatttttgacttctaagcatgctgtgttctcttaacattgcactgcattgcttcccaattgcagtgttcaagtacacatttttgttagctgggctgacatctgtgggctttctgtaatgtacagctacgttttaaatgaggatcaaggcaattgttgaccaaatattatgtgacttttctactattaaacctcttccccccaccagctattgctttctctctagcctccaagaagggaaaagattacctagaaaccttcatagtcacttgggtttaggtttttgttggcattgacattttcattaactcactcttgttatagcagcatctgtactttttgatgtcacacacacaaaaaccaaacctgtctatattccttgatagtggccacaagatacagtctctggggtcttatttttctgggacaaattaaaaatctccctttgaatatactgagtattttagaattagaacatacgtaggggctgtcctacagttcctttaaaatcgagttttgtttctgtaaagcctatctggagaaagaatattttaggcagaggacaaccagtacaagccctgaagtggaagtttgcctgttgtgttcaagggataacaaggaggccagtgcctggagcagagccacgagagagagtagaagaagatgaagtcaggggacagagaccagattgtggagcgttttgcgggcccttataaagctttgggcttttgctctgaggaaaaaggggagccttaaaaggttttcaatagaggggtgatatatgtgacttaatgctataaaaggagcactctagctcttgggtggtaaatacagggcaagggtaggaacaggagaccaacagggaagttaatgccgtcatccaggcaaagagtaagagtggttcagatcaggttggtggcagcagaggtaagagaagtggtccatgtccggatctatattgtgtagctagagctaacaggatttgctaataggttggaaggggatgtaaaagagaagaaaggataacaccaggattcttggcctgagccattagagggatggagctaccatcaatggataggggaaaggatgcagtagaagtggggagagaacagggttccattttggatatgttggatatttatataaacatctaaatggaggtgtcaagtgggctgttgcatatccaagttggatatagagtgtaggagagaagtctaggtggagatataaatttgagagttatgtcacatggatggcatctaatgctgtaagactgaatgtgattccctaaatgatgagaggaggtcagggtttcttagctgactgattaagactgttgacattttgggccagttaagtctttttttttaaacaaggcaagggtatatgtgtcttaggcattgtacagtggttagcagcatgcctggccttttacccactagatgccaatagtactgccctccctccccacagtgtaacaaccagaaatgtttcttgacatgccagatgtctcttggggggcaaaattcccccactggtgaacctctggcatagttagaggtccaagggctgagtttaacactatctgtctaacatgtaaaccatttcatactatccacagtacctttactgcttttattcttattcttcattcacaacacacttgtgatttcgtagttataatcctcatttgaaaaaataatagggaagtattataagtaacttactcacattcacacagcaaattgaaggtgggctgcaggctggaacccagggatccagtttgagtctaatgttctagaccacactacagtgaggttgctggcaagtgaagtttgttggctattctctgaaggtagtttatgcacttagtgtcaggtcgtagagacctcttcattcatttgtgggaactgcaaaagaatgtgtggccggtaagaagcaacacagagcaaccaagggacctgtcccagttggctggcagattagcacactgtgtaccagaagggacttgccaggatactctgggcttaatattttgatgattctcttttgaaaacccagaagagccagtaaagtcctcgcagccttgctggtgtttacattggcatgaatgttgtgtgcattttttaaataaattaagcaaacataactatgggccttagaaaatgtcttttgttgtttgtaacattactatctgactgagaataaaaagtatctccaggaactttcctttttgtacctcagtagcttcaaagctgtccagctccattttatttgctttgggctctgagcattgtttgaggttgttctgatgctgtgcactcttgtggctgaagcagagctaatgttcccaagattgccagcatgttttattttggttataagggcccattctcttccccatactctgaattcagcattttaatttctgatgaaagttctcaaagtaggactcgtgaaatttataggttcaaacagataaagtataattcaaaagtgtaagaatggctcctggtatagatgctcaggtttcaaatgacttgttctcagctaagtctgctttaattgtataccagcaggaccagaacaaaatgtaaggttaagaactgttgtatctcaggataaatgggagcttccttagagctgggatgttcccctgcaaaggtttgagggtcttgaactttttgctgtgatttcactgcctaagggccagttaaagctgtttgctttacacagtcaataatattgactgatagtatacagtcaataatactgactgatattattcagtcagtaagtgaggtctcctgggtgctcagccactaatccctatcttcaaagcatttactatctgataacgtagatgtgaccaatccataggaaagaataagagccagtaaagatgaagtatgttgaattctagttgacttttaagtgataataggaatttggggacggccaaagcagtaagacttggagtaatcaagaaattgatcccttgatggaggatggattcaaactgaattggagggaagaagaaccacatgcaggaaggctcagaggcaaccacaggcagggtgtgttcacaggacactggccagcttggctgcggtgagtgaggtgtgcttaaagagggtggggtgcattttggaggaagacctttaaaagccaagcaaaggagagttcacatttaatatgaaaggagagagtgccagcaatgcttttgagtaggggagtggcaagacaaaaccaaatatagctgaaaggaaccaagaaggagagagacaacttactgtcttcccttaatccactagccattatgcaagctgatgcctgtcaattaattgtaagacacacaggggagatgatggcttgtaaggaaagggtagttgacagaaagttacaggagctttaatcgaaattctgagagaaagctggaccagcagccttatcctgtgtcctagcagggtggctacctgactaggaacttgaataagcttctctcatgttgttgtcctccccagtgagactgttactgttcgttcttcctctttggaaatctcctctaccctaggagatgaccatgaaagagttctgtataacagcatcccacttggattctagcacacttgctgttacatcagatctttggagctagaattctgaataacaaatagcttttttctgaaatctttactaaaaggggaagtcagattcagctaggatcctctacctccacgtagaaactttgaataatgtgttttcattcacagttatgtttgagttttattcttcatggtttttaaaaaatatgtaaggggagtagggggtgagtgaaggctgtgggagttgccttttggaatgggggactttggatggacaggaggatggttgacagggaggatgtatggagggaggagggatggaagtatggatgatagaggaaggatggagggatgaatgatgaagggttggatgaatgggtgaagggaggataaatgggtagatgagaagttcctcaacaggactgtagaggttagttaagagcaacagaaaaactattacagaggcagatacaacaagttgtttttacagagctttaaaaatacattcagcacactaataactgagttaaatgttttggcacaatcagaaggcctggttgaactgagcttgccctgtcatcagcccttgagtgtagaagtagggttttttcctattctttggctggttctcacgctcattctcagccagtgcatcaaatacatctttgaattttgggaaactgtcacatgaaagagacttgaacaggccaagtgcggtggctcacacctgtaatcccagcacttttgggaggctgaggtgggtggatcacctgaggtcaggagttctagaccagcctggccaacgtggtgaaatcccatctctactaaaaatacaaaaactacctgggcatgatggtgcctgtagtcctggctacttgggaggctgaggcaggagaattgcttgaacccaggaggtagaggttacagtgagtcaagatcacgcctctgcaggagaatcgcttgaacccaggaggtggaggttgcaatgagtcgagatcgcacctgtgcactccagcctgggcgacagagtgagaccaatgttaaatcatcttacagaagtccttctctcatgctgacgggtcctgctgtgccaccagcaagcctcccggagtagtcagaaggcattaaggaaagggcgctggtttgcacattactgagagagtgcccattgccctgctcattactccagtacagacttaattttatttctagttaatgagagactaatgggtttgatcaggtcctagtcagtttctggcccctgccagccaggccaggcctgtgagcagggcctcaccacacaatgtttgcagtataaatcaggacaggacttagtactaaaccctgtattcttctgtgtttgcattcagtgtacataagtgatacaaaaggagcactaggcggaagaagcactgaccaggactgacccaggaaatgaggaagaggagggtcctcatggtgttatccgataatgccatcagtatacaccaagagagcatattatttctcagccatacaacaaacttgcttgtctttttattaacctgtgtgaaccttcttatttatttaaatcaaatcacaaataaaagcaaaataaagacaggtatgtgaaagtcctgtgttgtggtaatttatctaaacaacaagctttcgtatacagaaagagtaatgcaaaaatctctcaatgagacatccttttttcattaggaatttcagccttcttttttttcctggaatgttaaaaaacgtctgactcaccagtcagtgtatttcataattcattcattcattttactgatacctgagtctactatgtgcaaggcagaactaagtatcaggaacagcttctgtcgtcatagaagggcagcctactcttctgatagcactgccctgcctactgatgaaaataggtgaatacaactgaaatggaatgattgcctgttttttagtactttggcatacagttgatgttttctatcagtgacagttttttagtactcctttttggaaaggttattttgacttctgtataattttagaaaggactctaagatattgcaggtttaccctcacataagataagtgataaccacatcactggctaggaatgattcttgctatttgacagacacaactataaatgattctgtaaaacaaatcagagagacagttatttttaggtttgctttgaggacaggattataagtactagatcttaaattttccttttaggagattgataaggatgagactgagctcatctttatgtctgtaaatgttctctaacaatattttagggctgagcacagtggctcatgcctgtaattacagcacttagccaaagtgggaagatgacttgaggccaggagttcaagaccagcctgggcaacatagtgaggaccacccctcccttaccacacccaacaacaaaatttttttttaattttaggaaattagccagataatggcttgcttgcagtagttattattgcattgtggaaatgcagttcaggacttggcccaactactgtaatcaatcagctggcctaaggcaaaagtctcttccccaacactggtgagcaggaggcgttgctgccttagctaatgactgtggagcctctgcgctttaagaaggcttgcctgctctctagccaggttgaacttaggtccccacgctcatacctatgatagctggtcagtgaaagcttagggaaagctgaggcaaaacaagcaacacctcagcccctatggacctgaacagtttcatatcccctagcagatgtggggctgttcaatgtagcctttggaaacccatttctgtgtaagtggtgtatgccctgggcaactggcctttagacctggagtcagataccagagtttttttctgggtttgagtatttataccctccgttagcatggataaatcagtcttgctgctagtccctatgtgataggacatgattattcctagagaggagtggctttctgcatcaagctcactgggttttataatcaggatgatggcttcaatttttgcttgggtccgagttgaattcagggttctgtggtaccatctaatgcatatgcccctttatctgttttccttattagtagtggtacaagtgtaagagaagatatttcattgattccaggttagctaaaatatttggcatctgtttttactacagataaaagttgaagagttgctaggccccagaagagagtgaatgttatctgtattgccaaatcctacttttaggctgggattgtcgttggctaccagaacctgttacaccaggtcttagaactccagtggaatctgaaatgtggatgggcctcccggtttgaaagtacctccatccagaaggtaccgcgatggtcttcctgcttggcctactgccataggactccccagacaagctgttcttggaatctctgccaggcttttcctctacaactggtgttatgttgcctgtgttctgtgatccacatgagacacctatgatactgtgtgtgggggagtctagatcgtaaaatagcttccaaatagagttggtgccctctctcttccttgaagtgatggtaattaatttgggggtaagaaaaatagagcttgttcatcaaactatttttctgttccaattaaacaacaacaactctaatatatagttcactgggtgaaagagaattaggtagctatttttcttcataaaaggcatggaacatcagtaaatagaggatcaacaataaccataatctaaactagttaaatgccacactgaatggtctgaaggccagggcactcaaaggaaatctgaaaatgcacacgtctttattcctgtttcttccaattgaatagaacctgctttatttatccgttaagtgggaatatacaacagctttttgacaaagtcataaacttccttcttcaagtattctagacaaatcataaagccagtggttgctttataaaggcccacatgaagtgtgtagagctttggactggaaagcagttaaatttagggtaaaggggtaaatatttcataggaagcaaatgctgtttgttttttgagttttcttttttctttattaaatttattattttttccctaaccctcagaacctgtgactttgttttaagagagaaggtcttactctgtctcgcaggctgaagtacagtggcacaatcatagctcactgcagcctcgacctcctgggctcaagtgatcctctggcctcagcctcctgagtatctgggactacagccatgcgtcgccatgtccaactaattaaaaaaaaatttgcgcgtggagatggagtcacactgtgttacccatactgatctcctaactcctcacctcaagcagttctcccgcctgggcctcccaaagtgctgggattatagacataagcgaccgtacctagcaaggttttctttttgctgtgcatttttttttcctgcacagagacctttgagcattgtattggttctaaaccttaagggaattaaagtttttgttgctttccttgggtagttctagatgaatgattgttgttgggaactgctgagtcagggcagcttgttttaagctgctttacgttctattaggttggtgtaaaagttaactgcattttttgccattaaaagtaatggcaaaggccaggcgcagtggctcatgcctgtaatcccagcacttgactctgtcttgaaaaaaataaaaataaaaaataaaaataaaaataatggcaaaaactgcaattacttttgcgtgaacttgatacctctgatgtatgggaccccccctaccaggacttgcaaaatggaatctgagagccctttgctgccccagtgcacacttgcttgagtgggtggatgctgtggctgctgagatggttcatagctcgtctgctagaggcgtggttggctcgggctgacagccatgtggcattttggcaaatgccagttgcttccctcaccagtgctgctcccttaatcaggttgcctcacctgtctgagcttggagaccatgcttgtctccttggatctttgtgagggctaaagagaacatgttaggtgctactgcagcacctggcacgtagtggatgccccattggtattggcctgtccattccccaaatcatctcctgaggattttttgtttagtttagtgatacgaccaagcagctagagatgtccttctggttttgggaggctttatatggaaaaacaaaaagcagggattggggaggaagcacacgtcatggtccagcgtgttcgtggtttgtgtagctgcttttgatgttggcacatcttggtgtgtctttcttataaggggaagcaagactgtgaagcttcttccactcagccaagcagcatagaaagtgcctttggcaagttggaataaaccttatcatgtggcaagggagagctagcgtgggaagaaggaatactgcagtccatcaaatttggatttgaatcttggctctgcctcttaccacgtgatttttttaaaaagcttgagacaggattggccaggcgcggtggctcacacctgtaatcccagcactttgggaagccgagacaggcggatcacgaggtcaggagatcgagaccatcctggctaacatgatgaaaccccgtctctactaaaattagccaggcgtgttggcgggcgcctgtagtgccagctacttgggaggctgaggcaggagaatggcgtgaacctggtaggcggagctcgcagtgaactgagattgtgccactgcactgcagcctgggcgacagagggaaactccatctccaaaaaaaaaaaaaaaaattgagacaggatttcgctctgttgcccagcctggagtggtgcagtggcgtaatcaggacttattgcagcttcgaccttccaggttcaagtgatcgtcccacttcagcctcccaagtagctgggatcatagacgtgtgccaccatgcctggctaattttttaaaaaaatttttataggggtgggttctgactatgttgtccaggctagtctcgagctcctggggtcaagtgatcctccttccttggccttatggggtcctgggattacaggcgtgagccaccacacttggcctaaccaggtgaccttgaacaagtcttattctctgcagtaaaatgggtgtcagtgaaataggtgttataatactcacctggcttttagggaagaggtgagaattaaaggcaatgtaggataagcccctagtactgtgcctgggacctaggtgctaagtaaatagttgctatttctgtgtttttgctgatatatgtgttgttagctagcagtagccttacatctgaagttaaggtgcatagaatggcatataaggatctttagcagagtggttgagacatttttgtcaagaaggaaataggaaagctttgtgacctgggtggaggaaggttggcattgactgatctaccatctgaaagatgggggagttatctctaccctcccctctctttggatgatgtgagaaatctttggattcagtgagaaacttagcaacttgaaatgtactgatctttggcctgccgaggttttgtatggcaaagaccctcaggccttgtctgtggattggggcttccttgtgactcactgggaaccatagatcttgcacttggtttggttgtcaagttgcactgctatgtgtaccatcactgactatcttcactctcttccaggggctccatgggccttaccccttcggccagtcttaaacgggtgtcagcaagaagaaaaattaacaaaagacagaaggcctgactttggggggttagggcaaggggttcctctggattgcagaccacatcgcacagacccctggctctgaccccctctcatcccggaagaagaggaagaagcagaacagactagttttgagtaaactcagtatgcatgtgtgaatgctgaatcacaggaatggtgttgaggctaccaagaagaaatccatgcagccactttgggttttgttataggcatcagtctaacaagtcattaggtcactcgggaagggggaaaaagtttaaaatgggggaaaaaaagccatctttttaaacaaaaattattttgcctacagaaaggttgtagttttgagcacatgttaatttttttccctctttccccacttttatttttttaaataagggataacatattctttatagaatagtgcttgttctggaagagattcaggtgaaaagttggcgtggcatgtttgaggactctgcggatcagtgctacaggagtacatctgccctgccacatgactccagaagtctctgaccccatttgtttttaatggcatcagccaatgagttatcacccttttcctcctcttttctctttaatcttctgttgatttacacctttgacatttgtattcgtcaaccctgtggcttgttagcatcagaacctctctgaagaccaaacttccctgtgtggccagcagaggaagccttgaggatagatctcgggtgacgtgggattttctaagcctgagaggtgtccttctgcacacccttgtaacaattaaaattgcttttcttccatgtttctcttggcagagagaaatgccatcatgcttactgctcttttggattcttcatgcagtggcttcccatttgctctgggaacagtgcctctgtgctggttatatgtatgcaccacatgtgcacacacgggtgttggtgcaactcaccagcaggtgtgcagtaggcaagcttgaaggtggcccatgcttctctgttgtcacacaacacctttccctgtttctcttcagttgtcctctgatattttcacagcctgttagtggcggctgatctgtagaggtatgaaaatacagccccaaagggggaatttgtcatggggaagggccagccactgactacttgatcttggagaccacatttagatggaaatgagaggacctccacagccccgcctccctgccaggatgctagattattggctgggaggtgggcaagtggcagcccagctgaagcaagaggctgattgactggctgctcactcaggcaggtggcctgccctggcatcctgtagattctgagcaggttgagatgtggatatctccatgggaagcttgaaccaggctagaacagctgtctgccaaagatacaagaatatgcaaagtccctcttacccccctccttccctcaagtcttagttggtttgagagccagggatatggatccagggtgctgttgcagggtcacctgcctgttaccacacccccatccagctgggtggtgggtgagggtgtgagacaggcagggagaccaggtaatgagtggctgcaaggagtcatatagcctgggtgtgggtgagggtctgcctgcctgtttctgtctgggtgtctgagttccaaaaaatgtgtgttgtttgttcctcctcatcctcttctgagactgttgtttttttagagcttgattgtgggagaaaagcttgtgtgaaattccctcttcacctccccaccccccaaaaaataaaagggggcataaactttattccactggagaagccctgggggtggctggagccagcctgctgagaagcgtggtgcagctgggtctgggacttcactagagcttactctggagcacctattttctgtgcacatgggagtgctccactccctagcagagcagagggaagtctctgccaggtacccacgccacaggcctcaggatggctttttgtctgagggcctcattaggcccagactgctgctgctggtaccagtctcctgagacactgcctccctggagcccatgcatgcccagctgttcttactgcttagtagccttgaagcagcacatctccactgtccctggcaggattgtgggaggcttcacaacccctgctttcctgacttcctcttctgcccaacactgggtgccccttcccagtttcccagcaggggcttcatgggccaccgtcagtgggtctgggcctgccagagtcgtcttgctcttcctcttgcttctaggcaaccacacttggcaagttaaatgtcccaagcaccttgtctcccttcccaagaacaaaccatttctgtgcacatccttggaggcgagatgagctccttgcagagggccagagtaagtgcaagtcatggagtgcaggcagaggggtccatggcttccccagcccagggagggtatcagtatcattcattctctctcccctcactggtatgggttcagagcaatgcctagggcccctctctgctcccctgcctagtggggtggtagtggctacctctcagccccaatagtccctgctcctcttagaatcttcaccaagtggcaggccacctctgggcaggaccacctgcgtctggcacccaggaggtgaggcagacaccatggttaggtgatagggtctgaacccagttggggagacagaggggttcagacttgggaagaatctgtcagtgtgcatggagtgaggtgtgtgtgtgtggatggatgtgcacgtgtgcatgctttttttctttttgccgtgaggacagttgaatttggggcatttttctacaagaagcagtcagccttctctcccccataaggactggctgtaaccttaagcccatcaaagttacttccagcctggagagaacctcaccaaacagctggtgtggcctgagggtggccatggtgggaaatgggcatgagaataaatacctccccaaattcaatctgagcccagcaggagaggatggtagggttgccagggctcagaagtgcaagctgattactcaccccaccctgcctcgccgcacctttcctttgtttccttgggtgaatgcaggagcagcagtggctgcccttcccacctggacagtggtgtgtgtagaaagccagctggatgtttgtggtggggcctcatggtgcctaggaggagataaagatgaggaggtttttccttattgtataaatgaatatttgtatgattaaattaacacacacacc

SEQ ID NO: 38248 - DNA, 2057 bp, Homo sapiens
ccatcgctctcccgggcttagaaggcccggctactgacgcgcagtgccagaccttacccctcacggtccttaagtctcggtcgccctcgcctcgcagcctgccacccgcgctcagctgcccgcctcctcagccagccatgctggagcatctgagctcgctgcccacgcagatggtgagggcgcaacccggggacctctgcacgccgttcttgtgcctggcagcttcgaagcccatgttggagcaccgacccggtgctgcgctgttccgggcccggatggttaccgtccaccctctttcccgaattgcctcctgggtccccttctcttctactccgcgagaatctcctgtccattctccgtgagggtgtttcagttcctcccgggaagcccagaatttaatatcttgcccaggcccttaggagagcgggagaccctgatgttggggttaccctgtgccagagttgtgaggtcagggcaggaattgtatgttctcggcggtggaaccaattctttttttcctctgcttcaccccaggattacaagggccagaagctagctgaacagatgtttcagggaattattcttttttctgcagtaagtattggttttacatttaatctccgcccccgcctccctcccaaccctcagtttgagtgtgtttaatatacttcatttgtctctagatagttggatttatctacgggtacgtggctgaacagttcgggtggactgtctatatagttatggccggatttgctttttcatgtttggtaagaaatttgtgggtattagtggcagcttgggttttgtgagtcgggttggtttggttagacctactcagtagtgagacccaaagccaacgtttccctcatccttccaaacagcgtttccctttgctatcattggaaaagtagaatgccaaaatagtgtcagatggtgcgaactatataaaaggacacagcttatttcctttggcggctactctggctaataatcttaaggtcaaagccagcaggagttttcatggtgctcacgttgtcccttcaccttttatttatttatttatttaaattttttgagacggagtttcactcttgttgcccaggctgcagtgcactggggcgatttcggctcactgcaccttctgcctcccgggtttaatagattttcctgcctcagcctcccgagtagctgtgactacaggagcccaccaccacacccagctaatttttgtatttttagtaaagacagggcttcactgtgttggccaggctggtctcaagcaatccgcccaccttggcctcccagagtgcttggattacaggcgagagccaccacgcctggcccccacctttcttttaggtcttaaagccatttgtataggcagtgagcctgttcccatcatcatacagtattttgcatggatggtggcacagagcctttataggaatatggatttttttttttgtttttttgttccctcagcataggagtcatttgggaacctggcattatacgtaatgattttttaaacttttaatagctataatttatgcatttcctcttttctggcccagctgacacttcctccatggcccatctatcgccggcatcctctcaagtggttacctgttcaagaatcaagcacagacgacaagaaaccaggggaaagaaaaattaagaggcatgctaaaaataattgaggttttcatgattcagcacctgcttttgtttctgtgagatgagctaaattgctttcataccccagataagagctaaaaccacctaatgctcttatggcacagctgtgtatagatttagttctctttatacttcatttctagcccagttgggttttgatttatataagtagtttagaccttctcttcataatcttgctctgagatggggaacagaacacacaagtatgaagtttctttcaggtgtaaataatgaaaaataaatgcctcataaatgatagtacaatgtaactatcaaagttttataattcattatgagttaaccattttaatgtttccaattaaacctcatagtgc

SEQ ID NO: 38249 - DNA, 35249 bp, Homo sapiens
gactgtggcggcggcggcctcgaggtgacaactgtctccgtcgcaggctccggcgggggcgcaggaggtcgcccggcgcgtcactgtcgggtcggcgagccacgggggccgccgcagcaccatggcgaccaccgtcagcactcagcgcgggccggtgaggcagccgggcgagggtcgggcgggggcggtgacctgcggttgcgggcggggccttgggtcagggctactgctcagctgcggctggcgggccgactccgcggctctcccggggcacgcggggcgcctggccggccggaggggagcggcggcgtccacacctcggggcggggcgggccggacggacgcgcccacgctgcaggaggcttgagctcaccgccgtgccggggcagagctttggggaggcagccccgggggagggggcctgcgcccgttgtgagccccagatggaggcgggccccgtgccccatggtgccccagagggaggcaggccccgctccccaatggtctccagatggaggagggcccggtgcccagatggaggcggccccgagctctgactcccgaatggaggagggccccgcaccctaatggtcccccaggtggaggcgggccctgaaccctaatggtcccctagatggatgcgggccctgctccctgatggccccccaggtggaggcgggtcccgcaccctgatggcaccctagatggaggcgggccccgcaccctgatggcccccccaggtggaggcgggtcccgcaccctgatggccccccaggtggaggcgggcctgcactctagttggtcccatagatgatggctgtttcctctttctcatttacacagagtgagggcagtggtgaccacttcttgggcccaattgtgtccccggttagtggccaccgtgcaaaacctcagtttcttcatttgcaaatgagaggataggcgccaggaacttcagagaacctttcctgctctgaattctctcctgagagttgcctggcagtttcttctatagcattaatattgcaggagagctggtgtagactgactcagagatgatgggctcctggcgtgagtggcctcctggctcactgttagggccttcttgcattgctgtaaaggaataccgagactgggtaatttgtaagaaaagagatttaattggctcccggttctgcaggctgtacaggtagcatggtgccggcatctgctcctggggaggcctctggaagctcccagtcatggcggaaggccaagtgggagcttacacgtcacatggcgaaagcagcaagagagttgggggtggggaggtgccacacactgtaatgaccagatcttgtgagaactcactatcaccgggacagcaccaagccacgagggatctgtccctgtgacccacacacccaccctgccaggccccacctccaacattggggatcataattcagcgtgagatttggcggggacacagattcaaaccgtgtcactcactgaggctgggctggggcaggctgtcgtgagcggtacagtttttatcaacagtggctctgaacatgccgtgggtggaaaaagtcctttttcacgatgctccaaggtccctgccctcgcgcagcccagtactggacgtggtggaggggtcaccagggctccccacccttaacactgtatccacaagtcctggtgtttctcccgaggagataattcttcaggtagaacattttttctgagtttagaatgaagccccaggttttgggcatagctgctttttctgaggactttgaaggaaacctcctgacacttatgagactcaggtgtggagcctacgggtcggcagaggtcctggacggcctctgatggcagcgtctctacctcttcatctttactccaccacagtgagtccccgcaagttgccgtggcagccaagtgctcctttctgcctaacaggagactcagagcaacaagggaaccagcaccctgctgttgtgtcctcctggagagcaggggggcatggtggccaggcaggatggccccttccttgctgtgtggtctgggagacatcctctgcctcctgggaacttgttcctcatctggaaccccactggggtgtaggactgattttgaatgcatcaggtgctgagcaggcagggagcagtgggaggcaggcccttcctgttctgaggggcaccggcgtgcagcgctgttacacccgcgatgaggaagtgggagcggcaggagatgttctcacacgcagggcctgtgctggcaagtgctgaggtgtcgttagaatctcctcttgcccagtgcctcctgggctgtttccatcatgtagacgagcaggtatttcaggggcacccccgttgaccggtaaacgcatagtaacatgaggtctggctcggagctgccagggtctcttaagaaggtgttgtcagcgacgggggtctcaggtgttgcttggagtacatgtgacttaatcaaccagcgctaccaactgtggcgttcaggatggccatgatgcaggggacaaccaggtggttcctgccactggggtcttccagggcagcacggtagacatggcagcacataaggacagctgagctgtgtggtgacggcccggtgggtctgtgatcttaagcgtcaggtgctgggagagtttgtaaatgggcctcaccagggctgggtgttggggtgaggacgtgacatctctcggaggaggaatgggagtaggggttgggctgggagggcagggcacggaaagagaggtgtggggtctggaggtggagaggagggagccccaggggccgaggatggagggaggcaggagctggaggccgccggagggtcctgggcacaggaggactggacttgccctggagtttaccggctcagcgcagcactctgtaaagtgttgcctggcacacgcaaggcagggcccgccttggcaccagcctgcttcgctgagcatgacccaccccagcccctctgaattaacccatagtgggcctttacccagttactagcacctagaggagccctgcttttgcaggatgtcttgacacagtatttatcatgtcctctttctgttacacctgtggtgccagagaggcaggaggttaagcagggcgctcgctcagctttccagcagaaagagatgctccccagggtccgggggcaggactctggctcgggagaccctgactgtggtctagccgttgcctccccctagtgataaggggagacggcaagatcccatgggccgtgaaggagcagaggggccgctaatggggtcctgggagggttcttttgtccttgggtagagggagcttcaggggcccgggtgggtaggtgtggagaggacgtgtgaagctagccagcccgacatcgttctgagagaatcataccgtgtttagatcttcaggataatggttccctgaatagccactaagggatgcttcagccctgtgcagtgcttccctcacgtttcaaaaaggccagtattttggaaagataaccttttttcaatatagtctgcatattatcagaaagcatgggtgagtacctgcaaggagtaccatgtggacccctgcgaggggtaccgtgggggcccctgcgaggggtactgtgtggacccctgtgaggagtatcatgggggcccctgcgaggggtaccgtgcgggcccccgcgaggagtatcgaggagtaccgtgtggacccctgccttctgcagtgagatctcgggacgtttgcgggagactccgctgcagccaccgcggtgccgtcagagaggcctccttggtagaggtgggtgcgctgtgccgtgtccaggctgctctgactccttgtcctgcttctggaggtgctggttggccatggagtccagctggaggcggcctggcccctcccttcctccctgagaggcctgttcctgtccaggtcccctcactcttcacatcgttgataattcctgccgaatcggtgacttcattagggatggcagagggtagtttctgaactttatcacttcttcggtgtttattaactgggattgtttgtaaagattagctttccccatcaaccggtgtcggctggctgtcctgaaacacaattcgtgaaagaaaggcaagtgagatgcttttccctcatcttcccgtacctcaaggagagagttgcttttctttgtagatgtgtgtgggctttctctcccctgagtgttgtgaagagcccgtggattttcctgcatcctgtgtgtctgagccagtggcacttacccgtctccgctggctctggtgggctgctcctgggagggcgtccgttcctgctgactgcacctgagccagcggggaacgcactcaccgcctcctcacgagtcctttctctctgggttcctgtgaacctttgcgctggattttttaggccgggttgtgagtctgtacaggtgtggaattgctgtgcttgcctggaaatcacatcttttcactgtgtggggacccacgggcctcttggaagataaaggcctcttgcctttgattattttgtctgatactggcatggccaccccagctgtcttttagagagtattcacctagtactttttccttctatgattttacatttttctgaaaacttttgtttaagacacgtgcaccatcgatagcacgtagctggatttttaaaaagtcaaatctaagaagactaagtcttttgatgggaatgcgctagtttcatctttctagttaagagatgcctagatggatacacagatttacagattttttacatgttttctttggtgcttttatttgtcctacattttcttattttttttctctcattgccttttgaatttattaaatggagttttaaaaaattcagttgttttatctcaagtacatacacactgtgctgggaaagtacaggggctcccctggaaatggtaacatgcacttatcagcttctgccatgagggagtctctgagtgaactctggctccggaggctgcccggctaaagaataaataaagaagaagttaatcattgtctgtgccacctccggatccacgcggagacctcggccgccccgtcctggcgcgggtgctgctgtgccttgtgtgggtgctacctccccttggggctcccgcaggaatgtgttacttctctcgagtcagcgcttgtttagatttccttctgtgtttctcttttcttatcccttctggtgtctcgggccttccatttggggtcactttcctttagcttcaggttcatctagaattttccttgctggcaaacttgatttttgcttgtacatgccttttctctgtgtcctgacagctatttttgtgtgtgtggaactccaggtgggcggtactccaggtggacagtactcccggtggacggtcacttgtcctcagtgcctcgaaggtgggaccccgccctctcctggctcctggagtggctgctgagcagcccgggagtggatgtcccttcctccggctttccttcgtttttggccctctgtttgctgccttctgaatacgctgcttctggcctgcctcccagttcacttgaggtctttttttttttttttttttttacatggaggctcgctctgtagcccaggctggagtgcagtggcacaatctcaactcactgcaacctcttcctcccaggttcaagcgattttcctgcctcagactcccgagtagctgggattacaggcgtccaccaccacgcccagctaatttttgtatttttagtagagatggggtttcaccatgttggccaggctgttctcgaactcctggtctcaagtgatccgcccacctcagcctcccaaagttttgggattacaggcgtgagccactgcacccggccctaacctctgttcatctgggcctctaacactgtcccttgacctgcccgacaggcccctggttaggcctgctgtgcaagtgtttcctgtccctgagtcactgtctccagatcctgcgggccctgccctggcaccgtgctggtgaggcctgccttgctgccctgtgggaagtgcagcgtgcccctgccacccggccttgccctgtttctttgcacagcgcctcctgccgttagcatacagcataactcatgatgcttcccgtttgtcttcttccactcacgtgtaagcatcccaggagcaggggtgccccagcacctcaccatggaagcctcaggcacacagtgacacgcagaggctgccgcagcgcgcgccctgtgcccggcgcccagggcctgccacgtcacatgccgtccctctctggatctctgtccgcccttggcctgctgcttgactggcttttgtttcatctgaatgagaaggggttttccgcctctgccttgcttgaccgtcccagcacttaggatgcaaggctgcctgcagtggagttcctggcagagaccccatttaaagtcgcttgttctgtagtcagcttttataatctatgcttattctcattctgtcctgtactcttccctttcaccgctcttcagcttacacgggttcgtttcaatactgtcatctcccagcttcccttacacaaattctagtgtttgctttgagactttagcagagccagggaacctcccggcatgttggctttgaagcgcctgttgtgttttgtataattaaaggaagaggggagggggtgataggaagagggaaggaaagccctgtctgaggaaggccccggaaggggagacaaggcacggcgaatgagtgctcagcgagggctcctgggagggggctgctgagcggccgtgggaggaggatgtgggaactggggacaaagtcaccactgcccgtccacactggcgtgggagctgccttgccaagagcagttgcatgaaatgccacttatttgctcaagggttgtttattgaacatgccagtgccaggagactggcgtggagcatgaggccgaggctggctggagtgggttttggggagtgtcaggaggctggtgtggagcgtgaggccgaggctggctggagtgccaggggctgcagggtcaggtactggtccagcttttggatgctggtgctgtgaagggtggtgggtgagggagccagcagctgagtgggcatggggaattgcagttttccttctagccttattttggaaaatgctaaacttacagggcaatggcagtggccaccagtgagtgtcggtgagtccttcacctccacggggctcccctcttggccgtgagtgtgcaggcctggggcatgtgcaggctggcacttcagtctctgaaaccctgcgcactgaggggtcagtcagctgggcagagggaccgccagggccacccagggtctgtcctgactgcccacggccctgtgtctcagccctggtgcgcgttcccgccctcttgcacgcccggatctggatgtgaatcacacaggtgtgcgggcatcgggtggatgggccatttctcctgggccagactgagctctgacctgggtgtgaacctagcagcagacatcccctgtaggacagtggcctggagcaggccccttgcagggccttcaaggcagggccagcccctcagacacagcagggaggctggtgatgacctgggctccaggttctcagcttcatctggaccaactgtgctgttctatgtgagtcctggggccctgaccgagtctggggctcccttcctagcagacactcagacctcgcccaagaggctttgagactgacttccgcccatatccctagatgttcctactacgggggatttatttctctctgtttcattagcttcctctgtccctttagccacgagcccagcccaggtcttcctgctgtgggtcccagctctgaaagtcacgttgaatcatggccatgttaggaactggagaaacctagggctcagggtacagagtttcactagttgggcttctgtgttggggcctccgtgggctggctttgtggcttcaggagtccttgacgcttgttctcaatgtgggggtgatattgaccctgagagggcacaaggggttcttgggggaggaaacttctggggtttggcggccgtgtgtgcctccccagcacagctcctggatttcttgctccttagtatttcattgtccctgggttttctgggtgtcccagcacatggatacggagttctcggaagcccgcgacacatgtgcgatctcagacctgctgtgaggtgggtggggagggtgggcaggcgcctgcggatgccgtttgtgtgggatcctcagtgctggtgtgagactctggcttggagaattgaatgagaatcgtcgacattttgtgatttaattccacagaacgtatttagcccatcgctaatgatgtcagtttgctgaaagaataccagccagccagttaaaaggtactttctcacatcaagcaaaagcttcagttcactaaggatattttttattgtgtttatataagttgtttatttctacgtgtgatttgatacattacaatttatgtaaataaattacactcagcgctgctcagcgcatagtcatgaagtgctagaagcattttagtttttaattgaacttcgttcgacttagttatgctaacctggcgttagcgctgagactcgttgagccttgcttgcagtgtttacatgccaagtgcaggtgcatgcgtggcacacagacacaaacagcacctccacagcctcgcagcgtcatggggtgggaacggtgagaaggtttaaaaaggctccgcagggggccagtcatggaagtggccaggaaaccctggtctcctgccgcctgcgtgtggccagccgtgcttcaggggcgactgtggtgcggctccttggggtgatgtctcctggcaggcgtgaggccaggactgcatgtgttcaggactccacgtcctgggctgagctgggctcttccggggctctgtcaaggcagaaagtgtggcccaaggaagcagcggcactctcagtcggaaacgtattcctaacaggtgtcgggcagaaagtgtggcccaaggaagcagcggctctctccgttggagacgtgtcaccaacaggaatattcacagtgggtgtttaatttgtgtgcttaaaaagaaaaattagctttggattgactacacacattgcatgacaaaaaagaagaattaagactttatttctgtgccaaaactaaaacttagacttgaagagaaattgttttaaatagaagtgaatgttggagacctcttttctttcgtgtggaaaggtacgctgcagtggtttagagctctggcgtcagtgagggaggaatggtcgtcagtcacaggcttgcgtcgtgatcctctgagagcggcacatgggggaggagaatcagcaattccaagaaatttgaagttacattttaaaactatatttaaaacagactaatatttataaaagtagcttttattttcagagaagataaaatgctgtgagctctgtgggatgagagccctaccctgtcctttttattttaaaagtaattcacgaatgtttttaaaaagtttctaaaaataactagcaggatataaaagtataaataaattgaaatagaatcttccctgcctgtttccctcgagttccattcctgaatgctcctccagagttggtgtcgacagaggcctccttatggctccctgcagcaggtcgtgccgcacctccgcctccgcctccgtcccccgagtctccatgtgttcgcggcagggaccgccggctcctggtgaggccgcgtggcgatgcgctgggtggatgtgcctggctggtggacggggcgttttgacggcacaggtgacgcagcctcaggcatcctgtgctcacgtgcccgagtgagcattgacaggggactggctcctgaagtggaattgttggccttcacacgggcatttagacttgttagtgttgaactcagtatgtgcatcttgtacatggaagcaaaattctagaaaaatatccattatgtatcgggagtaatcatttttgttttcatatttccaagcctttgaaccagggtaaagcatatatttttatgtgaccattgaaatagttcctccatcatcatatggcaaaaataaattttaggattagcactgaatttaaaaaataaattcaaaatagacatttactgaaggaccgagtgtcgtcactgaaacgatagggtttacttcagcacctggactctctcccctgtgactcgtgaagcatgaactggtagcactccctcctcgtttgaagggctttgctctaagttgagaaacgagggcattgcagcagcaggcaagccgcctctccctggtaggcggggcagcaggttgcgtaaccagtatttgtacggggaggactgaagcctggtctccgtctcctctcttgctcttcctgtcttcaggttaaatggaatatttttctgaaaaaccttgaattttgtagtgttcagtcttatgacgaattgaaaagctggcacgaagaggtcctgtgtgtctcacccatgtcccctggccgacgctcccctccccgggaacagctctcacagctgtggcgctgagctgggggcatgactgttggctccaggttttatttggctgtcctggtttttcgatgactgtcccctgctgtcccagcaccctgccttgcgtttagccatcatgtctgccatctccaatctgggaccgtctctcaggctttccttgtgtttttgggaccttgacggtttgaggacgactgactggtcagggattttgtcagatgtctcttaattggggtgtgggtttttgggaagaaaacccagatgtgaggcgtgtgtcatctcggggagctggacgcgcacctgccccgccacatggcgctggctgcggtccccgggctgcgtggggctgatgagctccatccgcagggagctgcttctccccttttcgtgttctatccacacggtttatgtttaaaaaccctcttttcctatttgccattttatggttaaatccttgttgaaaaatgacacttgatcattaggcctttggatataattttattttctcccagtaatgagcagtcccactgtctttaacggacacctaaagagtgcagagcaaggagatggagcgctggacgccttcaaataccgggacaaccaggatccagagcagcgagggacccacagtgctccctcagaggcctctggaccccacgcccacacgtccctgtgaccacccacaccctcccccgactggcttctccatgctgctgtctccgggacatgagtcgcctgtctgtcccccacgtgtggccaggagggcatgagccacctgtctgtcccctacgtgtgcccaggagggcacgagccgcctgtctgtctgccatgtgtgcccaggagatacggtgcttttcctgccatgtcctcagagctgtgcatgtggcacacaggaagcagttgtcacaaataaacaggaatttggcctgtgtatgttagtcctgagaacttggttagcacgagtctgtttctgcaagataacccgttcctggtgagcagacagagctagtcatagagcctgctggcatgggctgtgccagggccctgtggggttggcagggaagcacgtcctgtgtggccaggtgtcccccggggagagagctctgggctgtgaatccttctgggaggcaggcgaagggccctggccttctgtaccccagtgtttcctgtgtgccaacaggaacaggtgcttagcatctcgtgccatggggcctctcagcgccctcctgagccagagcttgctgttgagctgtacagcgcctcgagagaggctgcctgggggaggctggcctgggactcctggcatgggcccactccgctcaggcacctctgcaccctcctcgattgtccgtaagggcagggggtccctccgggccctggcctatgccacaccctccggaggtgaagccggggtgctctgcttgttctcgcagtacggcttctctcacagggcaaaggtcactcgtgacgtgtcccagtcaaaaacggggtaaagtgtggggaaacgcacaaagtgtgttttgctttttagagaagagcggttgagcacacgccatgctggctgctcaggttggggtgcagcctgcagagagcttcccgaacttgggggtcctgagtccgtaactgctcgaagcggtgcctggatcgtccgggtcccttctgtttactcacattggttgtggagcgctgactggcttgtgcgctccaggccttagatggggacacaggtgaggagctagaccctctcggggtcctttgaagtgccaggcgcccagagcacagcaggtgcagggcttaactcagaacctcctggagccctgcctggcaccgtgtcattgggagtccatggcacaggcaggtacgggtttctggtgtgcatggcagaggcgttctggcggcctcagcacgtgcactttgcctaagctcacgtccgacacaccgagggttccaggttccactcggtatttcctgaaaacaactgcccagggcactggcgctgaccggggcccctgcagacggctgggtctccaccccactccaccagcaaccaggcctccaccccactccaccagcaaccaggcctccaccccactccaccagcaaccaggcctccaccccactccaccagcaaccaggcctccaccccactccaccagcaaccaggcctccaccccactccaccagcaaccaggcctccaccccactccaccagcaaccaggcctccaccccactccaccagcaaccaggcctccaccccactcctccatcaaccaggcctccaccccactccaccagcaaccaggcctccaccccactccaccagcaaccaggcctccaccccactcctccagcaaccaggcctccaccccactccaccagcaaccaggcctccaccccactccaccagcaaccaggcctccatcccactcctccagcaaccaggcctccaccagcaaccaggcctccaccccactccaccagcaaccaggcctccaccccactcctccagcaaccaggcctccaccccactccaccagcagccagacccatgctcagggcctcatcagcgacctttcacctgtggagcatggtttaccccaggccccttcggccgctgcaggtgtgcgggtggtttcgggatggcattgtcctgcctgggcccatcctctctcttcccctcagaagtggcagtggtggacagagggtcgaggagacataggatgcagagtggggaggtctttcgtggttgtttggaatcgatttacttcctgcgttcttctgggatacttttgaatttcagctgtttcatgtggaaacatttgaagtatatcagcagagggttttccaaatcactttagacctgaggctcagcttttgtctcattcgtttgaccaagtgacctgcagttcagtggccctgcctttagctgtggacaaggagaaagaagccgtgggcacacatggtgcaagggagaccctttaaaatgacctgaaaacccacctgagcaggctttgaggacaggaacccatttttagcggcagaaacctgcatttggggatctcctgagtgagggctgcacctgtaccgctgggggccaggccccaggctggacacccttgacccctccgtttagagatgaggaaactgaggctgagcacagtccaggacttgataaggacatgggtgggggcggggccgcgggaatgccgggggcagctgctgtcgggctgctttgtgcccccaccctgactcactggcctctctggtccccggccccgcaggtgtacatcggtgagctcccgcaggacttcctccgcatcacgcccacacagcagcagcggcaggtccagctggacgcccaggcggcccagcagctgcagtacggaggcgcagtgggcaccgtgggccgactgaacatcacggtggtacaggtgggccttggggcaccctcctgcctgcctggggctggtgcgctcggtgggggtgggatttcggatttcggcgtttatactgcatttcctaagcgggcaaacagaacttctgattcccgcttttcctgaaacctgtgtgatgttgaaaacgatctgtgtgaaagatattggcattgaccccgggttctaccaaacataactcaagtgatgagtagtgggtgtaggtgggcgtctgctctgtgtagggcctggctcttccaccaggcttgagtacgcccaaggacacctcccggacccccgccggcagctggaggaggcgcggccggcacccccgccacctggtgtgtgctgcgtgagtggcttcctgttggcctcagtgccggtgcctgcaccctccctccccacagagcagccctcggtcagcctcggggccggcccgtggttgcttagtggtctttcaagtgaaagccaaaatcggcagattgaacgccgattttgatcacacgaaaaccgtctgtaagactgcaggaaaaggaaacacactgtgagccacgcaggctttcgtagaaatgcagggaaaggagacacactgtgagccacgcaggctttcgtagaaatgcagggaaaggagacacaccgtgagccacgcgggctttcgtagaaatgcagggaaaggagacacaccgtgagccacgcgggctttcgtagaaatgcagggaaaggagacacaccgtgagccacccgggctttcgtagaaatgcagggaaaggagacacaccgtgagccacgcgggctttcgtagaaatgcaggaaaaggagacacaccgtgagccacgcgggctttcgtagaaatgcaggaaaaggagacacaccgtgagccacgcgggctttcgtagaaatgcagggaaaggagacacaccgtgagccacgcgggctttcgtagaaatgcagggaaaggagacacaccgtgagccacgcgggctttcgtagaaatgcagggaaaggagacacaccgtgagccacgcgggctttcgtagaaatgcagggaaaggagacacaccgtgagccacgcgggctttcgtagaaatgcagggaaaggagacacaccgtgagccacgcgggctttcgtagaaatgcagggaaaggagacacactgtgagccacgcgggctttcgtagaaatgcagggaaaggagacacactgtgagccacgcggctttcgtagaaatgcagggaaaggagacacactgagccatgcgggctttcgtagaaatgcagggaaaggagacacaccgtgagccacgcgggctttcgtagaaatgcagggaaaggagacacactgtgagccacgcgggctttcgtagaaatgcagggaaaggagacacactgtgagccacgcgggctttcgtagaaatgcagggaaaggagacacactgtgagccacacggctttcatagaaatgcagggaaaggagacacactgagccatgcgggcttttgtagaaatgcagggaaaggagacacactgtgagccacgcgggctttcgtagaaatgcagggaaaggagacacactgtgagccacgcggctttcatagaaatgcacaaatacagcaggcagaagaatcgccgtggacctcacaaataagacttgctttcaggggcttcatggtgtggtgagcacagctacaccgtcaccccttcctcgcggcgtgtctcagacccttgcttgtgcagctgttactgtgctggtgtggccgatccctctgcccacccagtgaactcccgtaagcccatgcattcctgtgccagctgccaccaggccagccagtgccatcacccgtcctcagccgccacctcctggcagggcctggtgaccgcagggcactccacctcacacagttcaagctccagagctggctgggccttggaggtggccctggcgttgcccacgcctctggccccccttggtcctctcccgcaccctggagcccaccacaggcagcctgtttcctccacgtgagctcacccagccttctgtggcgcagctccagtggtgggaaacattcctgcctcctcactgggccaggtagctcagcccctgtttcctgcttctcttggcttctgggcggccacacaggtggttccctgcttgcgtcccctcgctgcttccccttgttgtctcctggggccccagtgggatgccaaggggtctggtcctcagccctcctcccctctctgcccacacatcccggtgacttctgcatccctgtgggtctaaacacccatgtgctggccccagcctgagccgaccactcagctccaccccagatccctaggtacggaccatggccacatggcctccccaggtgttccgtgggcactccggactccgtgtgcccaaggtggagctctcgggccaccctcccggcttctcccccgtgtccgcaggtggctgccccacactctggaagctgaggcccaaagccctcgtgctgctggtgctccaggttcatgtccacctcttgcccttcaggcctgaccctcagcacaggcgccaccttcagcccgtccaggcctggagccccccgcacccacccactgcccccgctcagcccctgcagcgtggccagagtaggtccgttcccgcgtgggcctttctcgtgggcactgtcctgccgagcctgctccagctgggcccatgttttcctcaccctagtcactcctgaccttcctcttccctggccgttctcctcccgcttcctgcagctcttcctccagatcctgcagcccgcatacccggtcctcctagctggtcactccctgcagtggtaacgccgtctgctgcgctgtgtgtctgccgcgcatctcttgcccattgtggggaaagcagcggtgcccgtgtgtccccacggtgtctgctgtctgacgtgcgtctcttgcccgttgtgggggaggcagcggtgcccgtgtgtccccacggtgtccacagtgtctcctgcaccagaacagcatgtggttgtgtgcagtcatagtgaatgggcagatgcttccataaacatcgaggaggtcacttcagcagagcagttgatgtcacaggacgctcatcctagagttttctagccacagtgcagagggcagtgggaggagatgggaatgagaggatgacgctgagtgtggcagaagcaggcaggatccaatgtgagcaggcatcggtgacaggcacgggcatgctggcaggggagtcccatgtgccacccagaaagctggctttgctcaaagcctttaaagttattaataaaaataagtcatagcagctaggcagagacagcacagttacctgaaagctttggaaaatcatgctggtctcagactttcctgctacatactctccagaaaatagggcagttgctaaggagtttacaggggcagagtttggagtgtaagagctgatctagcagatgtgtgggtgtgcagcagaagggaattggaagctgctagaggctgagcatgcctgtcgcccaggagcttccggaaaactgtcactccatagcattccggagtacgctgtggccacccaagaaacacgctaaaattaaggacccaagaatggggcagttttgacctaaaaggaccggccacagctttgattagaagtgaaaggagggaacttgtatgtggacaagaatagaaaacagaggacctggcagtccagagatgtgggcacaggaggggagagttcagctgtgcggcgagggttggcgtggacgggacagccgtgccctcgggggtcggtgaggacggggcggccgtgccctcagaggtgggtcggtgaggacggggcggccgtgccctcagaggtgggtcggtgaggacggggcggccgtgccctcagaggtgggtcggtgaggacggggcggccgtgccctcagaggggggtcagcgaggacggggcggccgtgccctcagcggggggtcagcgaggacggggcggccgtgccctcagaggggtgcggtgagaacagggcggcggtgccctcagagagggttcagtgaggacagggtggccgtgccctcagaggggcgtcagtgaggatggggtggccgtgccttcggggggtgggtggtgaggacagggtggcagtactctcagaggggggttggtgtggacaggttggccgttccctcagagggggtcggggggcagtgtctggactctgttccactgggaaggaggaactggcgggctccatgtgggtgggagggccgggatggctcccggggtctctatcaccagctcctgggggtgagccgggttggctgcaggagagcgggtggcagtggtacagggaggccgtctgcattccaggcaggacgctttacaggcagccggagctgcagggctgaacccaacccagcttacgagggcttttctcctggttttttcttgtaaaggttttacagttttaggttttatatttgaacctgccatccatgttgagtttgtttgctgaacaatcatcttacttgccacggtcttctgtcttattctgaacacacgttcactcccaccccgaggacctcaaatgtccctgcccagctgagcacctggcctgaagtcgaatctcatggtctacatgtgatgtggctccttgtgattgggagacacaagaaagacaagttccagtccccaaaaccccacgtactccgatagcacaggcagggctgctgccttcacgagggaggaaagcagccacgtggcgtctgaattatgtgcagcaggtgtcctcactctcacctagagcgaggatgcacctctcccgggtcatcatgctccgggggcaggttcacactccatgtcatgctctggctctcagctctgtcccgggacctcctcctctttccctcctcagccacttctgaggagggcattagagagtgcgcccttcatggtgggtgagtggcggcctcagctgtgtctgtgagcgtcgtaggtttctgctgtcaaggacgagccacgtgctttgtctcagaactgcacgatccatctgtggctcactcttcttgctcctggcctcctgggaagcaggtcacagccgtgttcaggcgactctgagtggctgtagtctatgtgttaggaaaaggcctcgtggaagggttcagggaggcagacggcctagagaacccaccctctcctgatggttggcacctccttttcctgacattggcttcattccaggcaaagttggccaagaattacggcatgacccgcatggacccctactgccgactgcgcctgggctacgcggtgtacgagacgcccacggcacacaatggcgccaagaatccccgctggaataaggtcatccactgcacggtgcccccaggcgtggactctttctatctcgagatcttcgatgaggtgagagggacgtgccagctattatggaggctgcacgtggctgagcgtggctgccgtggggacacacctgccaacacagccacgttcctggctggcttcgaggcgtggctccccacctggtgtttcattgggtgcatgacagggtcctgctctccccaaggaatgtgaaaaagggattgtttccagctccttgaacatacttacatttggaaacatccccagtgacaagcatgacccagggatacagcgtgcacgtgtcccctccgctgggcgcacagggtctggccgctcaccagcaggtgggatttccagggacagagcgtgcacgtgtcccctccgctgggcactgatctggccgctcaccagcaggtgggatttccagggacagagcatgcatgtgtcccccgccactgggcactcgtctggccgctcaccagcaggtgggatttccagggacagagcatgcatgtgtccgccccgctgggcgcacagggtcttgccgcacaccagcaggtgggatttccagggacagagtgtgcacgtgtccactgggcactcgtctggccgctcaccagcaggtgggatttccagggacagagcgtgcatgtgtccgccccgctgggcgcacagggtccggccgctcaccagcaggtgggatttccagagagtgcggctgcctactgggtgggaaagctgttcttggtggtgcgaatggtcgtgacccttgagggtcctgagtcccgtccgtggctgcacctgcagcgcttctgaggcagagtcagaaggtcagaggggatgtggcgaggctgctgctcagtgtggtcctggcacctcgcacctgtggcattgtgaggctagagactgggtgggggccggggagcagtgtggggcagccaggccagcagacggccagccctccctgcctgggccctgccttttcctcccggcttttctctccccgtccctacctgctttcccctccctggccctcagaagagtagagagcgcatgggaagtgcagagtcagctgtgggaggcagaccccgtgtcctttccagtctgcaccccggctgctctggggcttgacaggtggcagccggtggagcaaggatggggccccgagggctggggaggagcagccagtgtccctgaagtggaactgaaggaggacagcagcccagggccctcgctttccccagccccagacctggccctggccctggccctggcccatcctggtggagagagggaagaagtcccctacggaggctgatatacgatcgtgaagcctgcgctgcccgaggggtctcatcgatggggtgttggtgcaggtgggagccctgttccacagataagacggggactcgaggcgggcccacgatggtgcggctgcaggggcagggtggccccttccctgatgcctggggcctctccctcttgtctcccgcagagagccttctccatggacgaccgcattgcctggacccacatcaccatcccggagtccctgaggcagggcaaggtggaggacaagtggtacagcctgagcgggaggcagggggacgacaaggagggcatgatcaacctcgtcatgtcctacgcggtgagctgcacgcctgggcggggtggggcgcattggggtatgttggagcacgtcggggctatgccgccccacagacacccttgtctctttcctggaggcactgagcccataaaacagcagggctcacgttctgaggacagagggcaggggccctgggtggtttggtggcagagaggggctgccctgcccactgctcctgcccatgttctctgtctggggaaacagcataggggttgtttgtgttcctaagatgagccaaccctttgtggtggtctccactgcaggcccctgtgtcctcggaggacccccacagcccttccaagctctgcccttagggtccagctgagcagccctccagggtctgagatacagccctgggccctgcaggacaccaggctcctccccacagggcaggcattggccgtggtgtggcagggcatctctggagatgtcggggaagcctgggggctgctgtgctcagggtcaggaagtcgaggcctggctgtggggccagcacgtcagcgccctggctcccagccatctccattctcagggcacctgcagctcctgggggcatcaggagggccagttagaggctccaagacgcagagctcctgccgtctcgtctgtatcatcaaccagaggattttcaggctgttactgaaaaatggtgctgtgggaaatgccaggcagatgtgacagcagagagggtgcagcagagagggtgcagcagggagggtgcagcagggaggctgcagcagagagggtgcggcagggaggctgcggcggggagggtgcggcggggaggctgcggcggggaggctgcggcagggagggtgcggcggggaggctgcggcggggagggtgcggcggggaggctgcggcggggaggctgcggcagagagggtgcagcggggaggctgcggcggggaggctgcggcggggagggtgcggcggggaggctgcggcggggagggtgcggcggggaggctgcggcggggaggctgcggcggggagggtgcggcggggaggctgcggcggggagggtgcggcggggaggctgcggcggggaggctgcggcggtgaggctgcggcggggaggctgcggcggggaggctgcggcggggagggtgcggcggggagggtgcggcggggaggctgcggcggggagggtgcggcggggaggctgcggcggggagggtgcggcggggaggctgcggcggggaggcagcagcagggagctgcttttctgggccatcttggctcctcccaccccctttttgttaaagctgggatattttaaatcatgtcccggccgtgagtgacgatgtgtaaatgtctcatgacacgtctttaacagacgctttcatacaaacacagaaccatcatgacgctccagtgattttacctgcagttgacagtttcgaactcagagacgacagtggtgcagtgacttatccgcagttgacagtttcgaactcagaagacagcggtgcagtgacttatccacagctgacagttttgaactcagagacggcagcggtgcagtgacttatccgcagctgacagttttgaactcagaggcgacagtggtgcagtgacttatccgcagctgacagtttcgaactcagagacaaccgcggtgcagtgacttatccacagttgacagttttgaactcagagacaacagcagtgcagtgacttatccgcagtggacagttttgaactcaggagacagcagtgcagtgacttatctgcagtggacagttttgaactaaactcagagacgacagcagtgcagtgacttatccacggttgacagttttgaactcagagacaacagcagtgcaatgacttatccgcagtggacagttttgaactcaggagacagcagtgcagtgacttatccacagtggacagttttgaactaaacttagagatgacagcggtgcagtgacttatccacagttgacagttttgaactcaggagacagcagtgcagtgacttatccgcagtggacagttttgaactaaactcagagacgacagcggtgcagtgacttatccgcagttgacagttttgaactcagaggtgacagtggtgcagtgacttatccacagtggacagttttgaactcagagttgacagcagtgcagtgacttatgtgaagttgacactttcaaactcagacaccacagcagtgcagtgtggttccccccaggccgactcgacacctacactgggatgtccctcctgtcaccatcctctctcagtcacatcccagttagaagggggtctgtaagcccgagccatgtcacctcctggatttgaggaggtggtgcaggggtgggagcagggcccagcgtcccctgtgcactcagggctcgtgtagcgagggtgattctgggctggcatggggagggcgattctgggctggcgtggggagggcaattgtggggagggcgattcccgaggttctgatgggtggatgttcctccttgaccccgggaccatctccgctgtgtttcagctgcttccagctgccatggtgatgccaccccagcccgtggtcctgatgccaacagtgtaccagcagggcgttggctatgtgcccatcacaggtgcgtgtgctccctccctgggtgcctctcccctggtagaaaccccagggcctagggcaggtgcgggaggagggaacggggcttagagcgccggggtggggacgtcatccattctagaatcctgtagacgtgctgaccgcacacagatcctttcaggccaggaagccaaggcttacgtttgaattttgtttgcatatctagaaaatagaattgttttttttttttttttctaattgttggcagaaatgaggtgagttgaaattttcagagatgtggaaatgtggctttgaaaccccgttgtgcccagctctgtgcaggagaacctcacgcccctgtcaggtgacacgtgctctgcactgtgccgtcgtgtccgaacctcacgcccattgggtgacgcgtgccctgcgctgcgccgttgtgtctgaacctcacgctcctgttgggtgatgcgtgctctctactgcgctgttgcgtctgttgtcgtgtgtcactgttaggagtgagcagcctgtggctgcagcaacaccaagctgggatgtcgcttttcatgctgttgcattttcggtccagctgtgactgtggtagctgctggtgcaagaccggcccccaccatggatgggcccagccgtctttagcaggcggggagaccgcagcccctgagaggaggtgctaggggggagcctgtggtcaccctggttctcctgctgaggtggcctctctcgttctggggagctggtgtccaggcagagcactggtccctctgcacggagggtggaggccagaggcccaggccatggaagtggccaagttgcgggcagggcgctagggatgcgtggtggtgttgggggaggtggtgttaggggagggtctcggggctgcatgaggccccggctgcttgtgctcaggggctgctttggggttggggcgggacagagctgctggcaggcgagagtgctgtgaggccagtgctggtgtccagcccagctggagtggagaggcctggtcagcaccccagtcctgccagcatcctgcacagatgcagaaaggccaccttgggagtcgggacctcgccctagacccacctgatgtggcctgaaacccagccctgacgatgggaaggaggagacggcactgggagactctgggctgtccactggtgttcaggacattctcggacaaaactgcctgtgagaacagcatggcctcgccctcacttgctcacattatagactctgtttccatgtgaagccgcccgcgcaggtgccagggctgcctttctccagaggaaagagcagagcgtgtgtctgagagggcctctgtggtgtccagtgtcttagaaaaccaccagcctgggggtgggtgtgggggctcatgcctctaatcccggcaccttgggaggccaaggcgggcagatcgtgaggtcaggagatcaagaccatcctggccaacacggtgaaaccccgtctctactaaaaatacaaacaaattagccgggcgcggtggtgggcgcctgtagtcccagctgctcgggaggctgaggcaggagaatggtgtgaacccaggaggtggagcttgcagtgagccgagattgcgccactgcactccagcctgggtgacagagcaagactccatctcaaaaaaaaaaagaaaaccaccagcccagcagaggtagcacctgcaccccgtcaccgaggaaagaatgcttcctaggaggtgaccacaggtgagccagaaacgcagaagcagccttgaggcgttcagagttagaggagggtgggcatctgggtaagtggaagagccagcaccttggcagagaaacgggggcgagcatgggagccccacagctgttcctgagcctggagcctggccaggggagctctgctgccctgggggccctgatgcgccctggctgccccccagagtggctcctggaggttctgatttgtaactgggacagcccagagccgccgtcgtggggtcaaagtgccttctgtgatgtgcagttcatggggctagtgaagttctgtctggttgtcctgagttggaggccaatggccaacctgaaagaacagagacccaggccctccagcttcctgaggctggaagtcgaagccccgtaggcagggccactcactcgtcaaggctgtgaggaggatcctccccgtctcctccaacttctgggccgggcgctctgtggctgtctttttggggggtgcagttccatcaactggatacagcgccagggtgtatctggctgaaagagcattcagatgacagataacattgattggcttacctctttctggttcctatccctaattctctttgtagatgcctttcaagtttgctctaaaacgtttattttaggaaaggctagacaaactttgaaattttcttttgatagacattgtaaattttggaacagccccgcacttcatagaaaagttcccaaggagatgcaggaacatctgccagagcctgtgaggactcgtccacctgacgccccaccggagcccccagcccccatgcccaggcatgcgtttccaataagcaggggcgtccctggcacagtacggccatctagatgaagctgacactgacgcgttggggctgtaccctgcttggagcccgtctgagtccgcagcatccaggccggggtcactggccctccatggccttgcctcccttggcctggaggggtccccatcttgctcctagggtatgttctggtcagggacctggtggggctgctgacgtggccttgcagggtagggctgagtttccccggggctgctggcagggcccccgcattttacccaggcagatgccaccaccgcagattccacccagcgcaggtttacccagtgcagggctagtggtgtgacttgctcgtccctcacggcgggctctgcctggctgttccccgggaactaaaatatgtcctgtgtgggaggcaccccaggaccacgtgaagatcccgcccttgtcagcccctgagtttatccgacttccccagcaatgtggatttacaatttcctattttatttatttatttatttattttaattatattttaagttttagggtacatgtgcacaacgtgcaggtttgttacatatgtatccatgtgccatgttggtgtgctgcacccattaactcatttagcattaggtatatctcctaaacaatttcctattttatttatttatttatttattttaattatactttaagttttagggtacatgtgcacaacgtgcaggtttgttacatatgtatccgtgtgccatgttggtgtgctgcacccattgactcgtcatttaacattaggtatttctcctaaacaatttcctattttatttatttatttatcttaattatattttaagttttagggtacatgtgcacaacgtgcaggtttgttacatatgtatccgtgtgccatgttggtgtgccggacccattgactcatcatttaacattaggtatttctcctaaacaatttcctattttatttatttatttattttaattatactttaagttttagggtacatgtgcgcaatgtgcaggtttgttacatatgtatccgtgtgccatgttggtgtgctgcacccattgactcgtcatttaacattaggtatttctcctaaacaatttcctatttttttccttgggtcagaatcccttatgaatgttattttttcactcaaattattccagatttggccagagggagccccctcaggcgggatctttgttctttggcctcctctgatccttctctgggcccctccctgcttcctggcactgcaggaagccccaggctctctgcatttccggccttagccctggcgttagctgtttctcccaggagccctggttcccattaggagaacactgcttttaggagcctttgaagtattttttaattatcctagcagtactgtagagtgtgaataaggcacccttcttcactggaagctgatgccctaattttcttctgagtacctgtgatcacagcccatcctcccggcagccactgccagctgaagggcgaagtctgcggagaccttggagaggctggcggctgcgtgctcagggcgtctcgggccgactaggcaagcatggtggagtcacaccagggttttcttctcagaagtggaatctcaaagtgcatcttggccagagcatgtgtgtcgcccacagtttcaagtgtttatgactcacatggtggagaagcctgtgccgcgtgctctgcctggctacgcggtgctggctgcgtggcttcgggcctgtgtgcacgcagggcggcctggccaagccctctggtgagacggggctgccggagtgggccaggaaaggagagcccggcttcttagggccctgcttctcgccagccccttcagccgctcgttcattcagctgtcgcctgctgatcgctgcccagagacccccgcacagggtgcaggtctcgggggctcactgtgcacattaggtgggctcaggccccgagagcctcccgtggtgtctgagcccagctgccacctctatggagagtgcaagctggagactgagggctgaatgctggctgagccctcacgaggaccgtccactttcctcagtgaaaaaccagagtcccccacaaagcaactcagaagccggggcgctgaggtcagaccatctccttcacaaaaataaagtgtgaccgcatcagtgaggaagggaggctggaacacgaagcacagcttgattattaaagcttttacgccatgatcatggcccgaagagaacagttttaagttttgatttttttaaacaaagtattattttgattaccaaattagatactttacagatttcaaataattcgtggtaggcatcatgtggttatagggggttttttagcctcaattttaaggaaacatctaggcgtgaagcatctggagaccgcgtggcctcatgaagcatgttctcttccacggagctgcagagtggacagagactctccgccaggctggcaacagcagccaactgctcaatttcccgtgcgttcttcgtgcgtgagagaccagcgcgggtgccactgggcctcagccctgcctgcactgtcccttcagctgtccctggcacagaggggcactcgggctgcagccactgccaggggtctgccctgagggtccccacgagactgacaggcgctgaggtggaaggtggtgccggccgcgctgtcctctggggccctcctcactttccctcctcctgttgctttccacctccttctgcttggtggtgggaggagaatcggcctggaaagtggggcgtccggcgcctccccagcctggcccgcataggcagcaccagggtgtgcatgagctcattctgtgctcaccgtggctgcagctgcccgttgacgctgtttccatctgttccctcgtgcacctccatttcacacgggcctggagtgcttctctcttttctctgctgcccccacgtcctcaccggcgcagtccctcccgtcatcctggcctgcgtctctgtgggcacaacccccactggtttctgtggagccaaccagaccaggacatgaatgcccgtccacaaagtatgaaagcaaaacacgcaggtggacgccgctgctgggatggacaagggggaggcccatagagaacgtgcacgcggtggcaccatgcacgggagcagccggcgttcgcagcgcctgtgagttccagagagggccagccaagggctcacccagcggcccaggcatgcttcccctcgcacgtggaattccagcgaatagggagtttgcagctgagcagcacatgccatttaaaatacgaaatggttccattcaaaatgagaattggatgcttaaaagtttccgagacaaactatcacatggaactctctgctgttgtgtttattaacccgctaacttggtcgctttgaaacaaagaatcacgtaggttttcttctttgtgataacgctctgtggagtgagaagcagcaacaagccttgggagttccggaacagtctctgagctggacggtcgtccccacctgctctttggatgtctttccactgtggtgcgagacgtctggagcccagggccacatgccttcagcctgagcagggctgatgctcccctgcccaccggcggccgggacttaccatgctgcgtggtctgagatcagggccttctcggagcaatttttcctgaatggaaaagggacaagttttggttttcctgggtatccttgtgtttgtcagtagagaatttgattttgccaagatatgacagcagattcacacagcgtgaagaacgtgaggtggggcctgtcctgtgctgcacatccgtccgcgtgcgtgcaggtggctggtggggctgagcgcggcagatggcagggacacagcaaagccgcccatcactcctcccagggccgctacaggtgggctctgggctgccccgggctcccatggcgtcctctctgcccacattttggggactttgctctccgccaggccccagagctcctggtctgtcctcctgaagtccccaggcagccttgacacatacgctcaccgttcccggagggcttgatggacacatccgtgcttggtaaccaggatgggccggctcaggccaggcacatggcctctgccctgcaggaaggaggggagtgagccaggccactgcccctcagcccacaccgtggaagcacccacctcttcccccgggggtgcctgctccccaagtgagtgtgttggggccgtgctgttgggattcacttgagggccagtcggcgccacatcccctcattgtcagcagagcaggtttctcgggacaccccaggccgtgacgtcgcagcgtcacagccaccgtcatcgattttgcagcagttcccctcctcctgtcccttccccatcagactggtaaaggctggagagagtgggagcacggtgcctccgttcctcatgttgccacgctgtggggagacgtgtgggcagggacaggcgatggccgagccccattcctcttgttgccatgctgtggggagctgtatgggcagggacaggtgatggccaagttcctgcccgcctgccagccggggcgcccaaaaagccacggggatcccaggggtccctccaggacagacagcgcccaagcctttgtcttgtttgaggaagaagaaagggtggtgagggtggccacgtccccacctggccatggttcggttcgttttccgtcattgccgaaaggctgatgagcatggggatgatgcttccccagtgaggtgaggtgtccagtggccaggacaagaggcaggtgtgggtgtggaggaaaggtgggcctggccctgagagagccgagaagcagaggaggcaggggtgggtgtggaggaagagtcggcctggcctagaaggagccgggaagcggtggccttccttgctgaggagtcctggcctttgcagcaggtgcaggaggcttggtggcaagccctgtctgctccgtttacacccctgcaggtcttgttgctggtgttggttcaggccaggattgaagtggcttctgctgcctttaggatcctccaagtgtagaaaggaacaaaagtcctatcctaagattggggctctagcgctccagtgatcctagctgggagatggttcgtgcttttaaaggtgaatgaacgggtgagcagtgaacccttgcactgctgcagctgctgctgcaggaggagctctgtgcctcgctggtcgccgagccccgcgcacgctgcctgtgctctgtgcctcactggtcgctgagccccgcgcacgctgcctgtgctcagggctgctcgtggttttagggagcggccaccaggctgggaggcgagtcttaagtccggccacacggtgccttcaggggtgtgtgtgctgcagtggctgaaccgccgtgcgtctcctgctcgatagattgcatctcagtgtgtcctcccgcatcagacatggggcgaggggcctgcgtagctgtggggtggagatgccaggaaccctggacggtggccccagtgcactgagggtccactgtacaccgcacctgctgccccacttgtttgagttttgtgagcattttcttggtgtagtttgtatgtgtgtgtggggttgtcattctgggcatcggctgcagctttgctgaggtcttcagtgcctgtggtgattgttccccaccggcacacagtttagtgacacacttgccaagctgcaaaagcatcttctagaatgcctgataaaggaagaggctcagaccgtgcagtgtttggatcagcgggcgtgacattccgtgtagtccgtccccagatgcagaggactctgtgagcccactggtcagtgaagacgagcgtgtgcagtgcaaattcacgagttctgaagggatcaaaacaccacccccagcctgctagttataaaacagactcgggtgagatttgaaagatcaaactttgatttttatatggaaggaagatgagttagtgaaggaggcgtcacagagggccctgcccaccttccccgtggctgtgcctggggttgctgtttgggggtttgcctttccagggtgtcttgcgggactggtgtttgctgagacccgaggtggccccttcctcagggaggccggtgggatgcgttgttttcttccttcagcaggagctagtgtggcacttctggaactttccgacgtttttaccaaacttgatctttgcttccagggatgcccgctgtctgtagccccggcatggtgcccgtggccctgcccccggccgccgtgaacgcccagccccgctgtagcgaggaggacctgaaagccatccaggacatgttccccaacatggaccaggaggtgatccgctccgtgctggaagcccagcgagggaacaaggatgccgccatcaactccctgctgcagatgggggaggagccatagagcctctgcctcgatgccgttttgcccccgctctttggacacgccgacccggcgctccccaaggaatgctgtcccaacaagattcccgtgaaagagcacccgtgtcgccccctcccgtggacttctgtgccgccccgtccacacctgttcttgggtgcatgtgggttttcggttcctggcggtccaggacggggcgggggctcccctcccatctcgtgctgggaggtctcagcgcgctctcctgtccctgggacgtgcgtctctccttctcatgccgttctggaaaatgctcttgctgtagagagcagctgcttctgccagggtgttggaggtggtggagcgccttccgattccattcatggcattttgtgatgtgatgtaattggaatagagctgttgatttaaggcacacacaatccctcacactgtgggttttttttagaacttcccagacgaaaactcacgcccttgccctaacgcgctttgctgtgagcctggcccctgcccagggcttgggtctggtgagctgagcagcttcctgtggatggtgtggggccggcctctggcctggctcacctggccactgtccagccagccttgtgacagactccggcctgaaggcagaatgaacccacacctggagtgaggaagggggcctggcacggttggccaggctctgcctgattgccagccagcgggcatctgaagccgggtccttcgcccgccggaggctgccgtccgtctctcctgctgcgctcgtgccagctccgtgggtgtcctcccagggagcttctcttctcaacaggccttgcgaggctggggtgagaggtgatagaggcagcactgtgcatgattccgagagggtgtggtggcactgccagccgactgctgacagcttgggagctgctgtgcccaggacgtgggttcagcgtgggcgaggaaagcctggcgagcgtggccctgtaaaagctttctgaggcgggaggcgctcacttacctctgactgcctgggcgctgcgtgtagcatcttggcctacaggacagattttaggtgacacctggttatgacagtcagaaatttgagaagcttctcacaagtgatgcactttaaataatctgcatgccattgagacacctgcatgtctggtgtttgtggttcaagtgtcttgccgccggccttcggatgtaaacccactgataacggacagaaagagaatgcccacaagtgggtcttctgtggaagatgcagaaggaggaagttagtgcttacattttagtctttttctccctcaaaaaaataggttaagtttcagtgccagctagaaaatactgctttctgccatcgattgggggtggtttttgtcaaatatactgttgataaatatttatttttgtaaacttgaagtgtgtggtggccgtgggggagggacatgctggcagcaggcgccttcttcagctgtgggtcctaaaggcctttgatcctttgaagaagaaagacatggtatttgttcagcagacgccgaccactcagacggaggggcccctgggattccctgtctcagatggcctggtcttacgcctgtgtagatttcttctccattgggaatgaaggtgtcaggcgggactggaacgttctagatggtatgttccgtgatattaacaactctaacccaggacagaccacaagccacactcagaggcctcactgtgctgggggcttcggtgtccaggcgcccaggtgtggccaccagcaccggtttctgccttcgcgttgctggggtgcagtgagactgccacacgcgtgcacatgtggctctgtgggtgtctcctagagaggacgtggcccctgctgccagcccttgagcagcccgtgtgggggcccgagggacccacacagtgggggccagcctcgctggagggagagcaaccctttgccgatgaccacgcttgccgccatctcttagttttctttttcacaagcgctttatttttttaatagacaaatcacattttgcaaggcctttaattaaataagattcttctttccttcattttatgctttatttcctgtttgaaggcttactgtagaagtggcttactgtagaagcagcttgctgagcccctccgagcggtccccagaattagctggttcacaacccccaccctcccccgcccccgcctgtgtcaggtgtggatgaggtcgtcacactcagaaggacaggcttgtctgccagctcacaaggggaggctgcagtgggtttgggagctgggtttaggcccctggtgtctgagggcccaggccttgccagcctctgctgctcctgctcctgggtttgaagatgcaggccgatcgccagctccgtggcagcggtcactaaggacagcctgactgtgccatcttggagcctcaggcggggctccggagatagaagacaggtcgccggaggctccccctcctctcctctcccctctgcagatgctccctgggcgctaccctgcagggtgccaggcaggagtggtctcagaacgtgcgcttctgattattttactggggtccattgtccagatttttctttgattgtaaaatatatttttactttttagtcttctaatttaataaatgatccatataaaaatagagaaataaagtcctttaagggaaggttta

SEQ ID NO: 38250 - DNA, 24417 bp, Homo sapiens
agctgggaatccggaatgctgcccgatggccctgggtcctcgctgtggggcaatccgggcttgcagacgaggtaaggtcgattccatttggcccggggatggtcacacgcgcgggggccggaactgccgtcgccggcgcggtcgttgtcgcattgctctcggccgcactcgcgctgtacgggccgccactggacgcaggtacccgaccgctgaccgcctctgctggctcgcgggggggaagcgccgccgaggggcagcccgcgcgcggggccggggcgccgtgtggcctgcggggcggagtagggagaggacggaggcctcctggaacggcgcggcgacggctgggcgcggcttgggtgatgggagcctccgtgcggggtgacagaggggcagagggtggcgccgggccggagccagtgcgcgtcccaggagcggcggagcccgcgcggtggccggggaacggggggccgagggccgaggacggtaggagggccctggggcgccgtggtgcgctggtcggatccgtctgctctgctctgtccccgctcccggtctgggaaagatgctcgccaactgcgggcttgctgtttggtcggagctggatacgggggccctcctggggcccagggacgcggcgggcgtgcaggcgagctggccggctgagcgggcttcgcgcacaccaggagcagggccgtgtctgcatccccaatttgaagtcccagtgcgactgggcaagtacagaccctgcacgtccttggacgagagggactggatattgcgacgcctgggccgcagaaaaggactccaccagccaggcctccttcgcccgcccccggttcggggtgtgtgtgtgcgtgtaggaggtcccttggggagggaggctcacctgagtcatccccagaacctgaagtgctggccagatgtccccgagggccctgccctggccttggctggtccttgcacgctgagatgccttttcaaatagaacggataaggtagaaagaatttaaacaggagctgagcaagtgcttggagccccatctcttcatagggtttttttgtctttctgtttgccttgttggtattggtgtatctaacatattttatacaggaagtagttcgtgtatatctcatttctcataaggagagattgctgttatccaccttggtatagaagataaatagaagctcagagaaagtgacttagccaggattctccagccagtgagtggccgaaatggttaaacgcaccatttgttgctgtagtcattagatagattttaccttgtgtgtatgttgggcatcgtcagagagtttggctttttgttttcatcagcacacactgagaatgcactgggtggcgctgagagggtactctacactgcacctcactcacaccagcagggaggcttcttaacactttatttagagatttatttgtagctctttaccttaaattcacacaccgtgattagtagcaagatttttcattgcgcttggttgaggatttattatcagactgcctaaacttttacgaaaagccaggtagagttgtatattactgaggctttaggaaatatttcagttaacttagggattgtggttaaatgctctaaattagttataactcacattaacttaaagtatttttgtttttttaagtagaattttccagtactaaaagcacttttagcacaaagcagcagtgatagtcttccccagacacgcttccttaaaacaaaagccaaacaaatttaacctgttcttccagactcagaattgtctgaagagttaccgaatgggatacatcttaagtcgcctattgtcaaggcctttttatccttcagaactttgatctttatatgtaaatgtttctgtgttaacatttgaaatgttaagttcaaatggtgacgtcagtaagccagctggaacttgcttcactgccaagtgctgggaagtttagttgacctgctttggcccttttgctaacagaagctgtttatcttaggtgaatgctggtgagcagcctggattttactttgtgttaatacaattctattcaagtgaaaatgctatacttcttattttgccttaaaatggcagcattttacacctactgtgtgcccacaaaaataaaaacaaaaacatggcagcactttggtaaaatagtgtcttgtggcctggcttgtccattactaaccacagcatctgcacaggtttctctctgggccccagtttccttatctgtaaaagaaagataaagtgctagtgaggagagtgaatcacgatgtcttgacttcatcgaacatgtatcaagtgtcttgttctgtgccaggctgtgttcgaggtgattgagtcccacatggaagcagtcagtgctgcagcttgcggatggtgccacattcctcgtgggcaggcagtagtagggtgctgattctctgccagtccagacataagaacttccttcttatgtccaggtcagcccctaccatgtaggttgtctgtgtgctcgaaaggtttcagaaccccacatgtaataatagttacttttggtatcactttgaatttttaaaattatgtagcaaaaaagttactattaattatattatgagtttaacataattttaagctagcttccatttgagagccgttgttctcatgtgtaaatcttgaaatattcagtttctggatggcgcttcttgttctccagggttcttagacccagcccttacggtagcatcatggccagggaactgggaatctcacaaagtcttaagatttcacaacggaacaggagcaggaggaggcgactcccgctggtgggttgatcaagttgctgtgaaggtggtttgcacattttgggcttcaaaacactaccttctgtataagataaaggaatagctcagaacaggattccccccgtgttttcttcctagctatgataaagattgccgtgtgaatgcagtgggttttacacactcagaattgatatttttggcttgtggtaaatgggactttaatgcttaacctgctgtagaaaaatccgccttagaaagtggcccttattcgtatattgtattcgatgtttgagccccctgatatcttatcattttaacaaagcttaccttgaagtgcaggaaaaattgtatgtgttcttgtcattatttgaataacaacaaaaatcagtattagctttaaagcctgtaggttttaagcgtatccttgcctggactagcatatctcctctttctcaaccaaaaagatcagaaaggtgctatcccagtaccaaaagtactgggaggactttcagcagagtgtgacgcagaagggaagcttttccgctctggggagcagatgcggagaggacaagcacttggaacacagcatccctgggagctctggtgctgcagttgtgaccccgaggcggccctgctgtgccctcctgggagtgctgggcgacactggttgcagaggggcattggtgctcccctccacctgacaggtgctccacctggactcgtggctgcagcttaattttgtgtcagatcctttccggtaatgtataggttatttcaactatgaggcaaagtgcaaatgggtagttcagtgtgggtttatggtatttgccctttttgatataaacattaaatatttcatacctcacctatagtactttttttaagacttaaatctgaaatttaagatacagatgtttgtaagatatgaatcttggatattgggagaaagaagcctcctggaaaatatacagtattatctggtggaaccattttattccttttcttattgtgagaaatacacatttatgaagtattaccatttaggagttgttttcatcaggcagggtacattgatataaatgttgatttttaacatccgtaagttgaagtctgactaaattgtttttctctgtgatttcataagtcacaatttatattttatatgaccttaaatatttaatttgaagtactggtatatttaaaggtgctaaaactacacgcatgcatctctactagtggttcttaacccaggctcattttgccccatccagaagacatttgggagtgttgagatattgctggttgtcaccactgggtgcgtgtacatgcactgctgactgggtagaagccggggatgctgctcagcatccttcagtgcatagaacagctccccacgacaaagacaggatgctgatcgatacccataaatgtctttttttttgagacaagagtctcgctgtgtcacccaggctggagtgcagtggcataatcttggctcactgcagcctccaccttctgggttcaaacagttcttctgcctcagcctcccgagtagctggaattacaggcatgcaccaccgtgcccaactaatttttgtatttttagtagagatggggtttcactatgttggccaggctggtctcgaactcctgacctcaagtgatccacccaccttggcctcccaaagtgctgagattacagcggggagccactgcgcctggccccataaatgtctcttctagacaagtgtattgttttaaaaccataatttagccctcctggagggatttcaaggatgggtgcattggtcccctgcaggtagctcagcaagcttcattgtgtctctccttggcccacagtttatagtgattctgtgccgggtcttgtgtgttggtctggaagaaggtgaaaagatttggggttgggctgagcgcggtggctcacacctgtaatcctagcactttgggaggccgaggtgggcagatcacaaggtcaggagatcgagaccaccctggccaacatggtgaaaccccgtctctgctaaaaatacaaaaattagctgggcgtggtggcatgcgcctgtagtcccagctactcaggaggctgacgcaggagaattgcttggaccagggggtcgtaggttgcagtgagccgagattgtaccactgcactccagcctggcgacagagtgagactctgtctcaaaaaaaaaaaaaaaaaagaatttgggttgatggggattcataggatctttttatcttggggaatcccagcatctgctctatcagctaaggcagttacatctactcataaagaaaattccttcaaaagttttgttgagtaaaaagtaaaactgtaagagttaaaagacaaagctcttttgctgtgaaacgctcagtgagctttggactgcagtcagtggaacttgtgacactggtttttctctgctgctgagataattggaaggataaaaatattgagtgccttgtttgaaaaaatactgtttatatttgcaaagatcctttcattctagggagaatgtatgctttattcattgagctctatagaacataccagcatttctctcatagccgagctgttttaaatattaaggtaaaatatataacacaggaagctcttcaagaaaggccaattgaagtgtagctgtttagagacaactcaagatgatgaaaatacattaaatgccactttgaacccaatttaagaggtgtgccatatttagaatgccatttctaggttatttaattaatacccagttgagtgttggaatacagttgggagtaatatgatgaatctgtcagacttctgagcaccccagcggattacaggtgggagcttgctttccagtttgtgaggagagaaaagacctaataatcctaaagggaaattgaaatgaagtgatagtttattaagtaataatgcatttttttacttgataaaactttctggaaaattaaatggtcttccaaaatttcagatacatttcaaaaataaacctgatagaaatagcatatgttgtcctggtggggtggctcatgcctgtaatcccagcactttgggaggctgaggcgggcagatcacttgaggtaaggagttggagaccagcctggccaacatggtgaaaccctgtctctactaagaatacaaaaattagcagggcagggtggcaggtgcctgtaatcccagatactccggaggctgaggcaggagaatcgcttgaacccaggaggtggaggttgcagtgagcaggatcgtgccactgcactccagcttgggtgacagagctagactctgtctcaaataaataaataaatagcatgtgttactatatgtgttaattacatgtgttcaggctgggcatggtggttcacgcctgtaatcccagcactttgagaggctgcagctggcagatcacttgaggtcaggagttctagaccagcatggccaacatgatgaaaccctatctctactgaaaatacaaaaattagccaggtgtggtagtagacacctataatcccagctgctcaggaggctgaggcaggagaattgcttgaacctgggaggcagaggttgcagtgagctgagatcacgccactgcactccagcctgggtgacagagtcagagttcgtctcaaaaaagaaaaaaaaaattgcatgtgttaatgtaattttgaacatcatatttgcttacagaaatccattgggtaaaaatctatagcattcgtaataactttggagagggttttggttaatgggctattatgtgtactaacaatatctgtttacctttctgaattattcatttttcttgtctttcagttttagaaagagcgttttcgctacgtaaagcacattcgataaaggatatggaaaatactttgcagctggtgagaaatatcatacctcctctgtcttccacaaagcacaaagggcaagatggaagaataggcgtagttggaggctgtcaggagtaagtagctgatgtgcagtgttggtgtttaaaaagtcagttgctggctggctgcttacctgactgtcattcacgctgtctagtttgacctcagtaatcatttccaaatgcagcctgataggacactcagtatttttcagtgatccactttttgattaactaggaaataactctgaggagccctgactgaattactccctcatgtgtgtcagtgttaagttttgtcgtagtggggaaatgagcctgttttttccactttctgcttttctgtatttaactggacttcataccacaagcatgttttttgtatttaggatagaaacactcagcaacctcttggtttactttgtcaatttaaagatgttactgaaagtcatttatgaaatttgacaaatccctagcttgcttctgttctgttttgctgctgtgtttggtacgtagctgtttgtaagttgtccttgggtgtgaaggataccttctgcctctgacggaaagcctgccgtggctcctctgtttctgcttgctttctgtttgcatggatgtggtatctctctttgcccatccctccatttgcagctgttgatcgtgccatagggtgtgttagagttgttactggatcaggtatgtgtgcattttacatgctggtgacgctgccgaattgtccccccattgcgttagtgtgtgttgcctcccaagagcacctgttccctgcagcccttggaggacaacctttgctagtgaagtcgacaagctttcttgttgttttaatgcatttctcttattagtgaggcttgttttcacatgatggaagagtgtgtgcatgtatgttgcctgttctgtactgtcttttgcatttacaacgctattgacaccgctttgcaggagaaggccatgtaaggtgatgggtatcagcatttgcccaggtctctctttcttgggttagcaaaacatttcactgctcggaatggacataaaggttgcatttgcccatctgacggagggcagggctcttcctttctgtgcctgaagtgcccttagacctggagagccagggattccagaacagccaggcggaagcagctgggtggtgggtgccgtttcttgtttgtcccaggtggcccccatctggcctctgctgactgtgactcttggaggacggggtctgcccactctgggaccctgtccatgcccgactgctccgaacatgtggttgtcactttcttctctccaggcagaagcctgcggtcagctccttaccttgaacattcacattgcagggagactgcaggcattactgccagagattcactctcctgaaatgcatgaaggttttatgtaaaagatcgacatttctggctgggcgcggtggctcatgcccgtcatcttagcattttgagaggccgaggcgggcggatcacctgaggttgggagtttgagaccagcctgaccaacatgcagaaaccctgtccctactaaaactacaaaattagccgggtgtggtggcgcatgcctgtaatcccagctactcaggaggctgaggcaggagaatcgcttgaacccaggaggcggaggttgcaatgagccaagatcgtgccattgcactccagcctgggcaacaagagtgaaactctgtctcaaaaaaaaaaaaaaaaaagacatttctagtcgaacctggttcatgttcattgaacatttgctgagcatcttttaggtgttgggtttgtgctgtgtgcttcatgtctctgttatttattgataaaccatgtctatattatttatgtctattttttattgataacctatttattgatcaaggtatgcttaccttattctcagaagtttttgactctaaataccttctttttaggtacactggagccccatattttgcagcaatctcagctctcaaagtggtatgtttacttaaaatttctttattgggatttttctggtagagagtttgattatttaaatatgattaaagcaaatgttttctgatagaaatctaaataatatcttagggtaatcatagctaatagaaacaccgttaagtctatcctgacatctgtgcataaacaagatcacttcagttgaagctcatttttttttgagacagagtttcgctctttttgcccaggctggagtgcaatggcgggatctcggctcacagcaacctccgccgcctgggttcaagcgattctcctgcctcagcctcccgagtagctgggattacaggcacctgccaccacgcctggctaattttgtttgtatttttagtagagtcaggttttctctctgttggtcaggctggtctcgaactcctgacctcacgtgatccatgcgcctcggcctcccgaagtgctgggattacaggcgtgagccactgcacctggcctcaattgaagcccatttttaaaacctaaagcgtgatttgtattgtactccaccaaagtgcacctgggatgcctttgtaggtcgcagctgaagccgctgatcctgcagtttcccatgagctgagcaagtgctaacggccggcctcttcctgtgacccttcctcctggagggtgaccagaccgagctgggccgtgctggtgtgtgtggctctgaccctgcctctgcagtggcggcaaaagtctttctttttaggtattgtgctctgcgccctggccctttgctaagccacctggctgggtgtaatccgagctagtacgtttctcatgcacgtcaccagggctgagtaatgagcgctggacgcctgtgtctggcgggtgggcagcgatgccggagcgatccctgagtcggcctcttgtgctccttcatcagggcgcagacttgtcccacgtgttctgtgccagtgcggccgcacctgtgattaaggcctacagcccggagctgatcgtccacccagttctgtgagtcgctctgcgccggcttctcgtaggttctctttccctcctgcatcatttggggttttggcactgacaccgaaagcgtcctgatggattttccatcctcagagtttctcagcaggtgctgtagaggaagtagggaaatgaaggagcccgttcttctggggtcagaataagacagagacggcggggtggagaggtgggtgggggagcttgggcctgttggaaatggccggggcccagctccagaggcagggaggccctgtgggctgtgtgtgacaggtttgcagaaggtggaaacgaagggcctctgagcaataacaagacccttcctgcactcggcacatatgtctggtgccaggccctagcctgtgttccatgggtcagcgtggaactgggcaggcaaaaacctgcccccgtggggctcccccagaccgcctatgctatagagcttgctgtgtggaggtgttctctctgccgtccaggattgtggccactgagggcttgaaatgtggctgggaggtgcgggagcagagcgtttgctcttgtttacttttcattgtgtgtgtttgcaccgactggattgggctgtgctgctctggagacaagggagaggaggatgtcaggtggtgaaggaaccgtagagagcggcagcagggagggggctgtgagagtgggcagaggggcagttggggcggcagcacagtgtgatgacgcctgggtcgagcccggcctctccacaccagagaggagccggcgcggagctccaggtgcggtgctgtgatgtgtcgggtgaccaagaggtgcagggctgggccccacagggtgtggggctgctgtcagggctgtggctctggccctgagtaagcagggcagggccagtgtgggtcataaaggctcctacgcggctgtggggctgggccggaggctgtggtaaggacctgtgggagggaagggtgcagtcagatggtgagaggggccggattctgggtatgtttggaaagtttgggggtggaatttgccgacagattggattggaaaaggcaaggggcacagactccaccaagggttttggtctgagcgagtggtcactccatgtggtggaaacgggcttgggtgggatgaagatgaggcgttgggtgtagggcgcagtttggctgccagttagacatccaagggacgtggctagagggcattggacagtggggacacgggcttgggagtcatgcacatgtggacggtgcttaaagctggaagacgagggagtaagaggcggaggggggctggggttgggggcaggggggacttggcactcagatgctgggagcacgggctggggaggaggcagcaggggcctccaggagtcagtgaagccgctgtttccagacagctccagaagggcctgtgtgtgcgactctgggtcagttggagatgaggcctgagaacagttggtgcatctcacagtgcggggtgaccctgacaagggagcttgtcggggaggaaaggggacagaagccttaacagtgggctctaggagaggtcacaccgaacaggaaggagttctgaaaaagcaaacccctgccctgttctgaatgagaaactgcagcagggtcagtgcgttgtgtggggcctggtctataagcacacaaagtaggctttacagccacacatgtatgtgatggaaacaaacgggctaactttagagggcaaagatgattttgaaaatagccatcgttctttttctaacttgtcgtaactgttgaaagctaggcatgtaaatctgggcattaaaagagagatcagggagaggcaatggccacatgcagtgtggggcctggtttgggtcctgacatgggaagaggacatcaagaggaaatgggaaatttggaaaatgctgtggtttaatgaatagtattaaccaatgtgaacttggtcatgctgatccggaatgtgggtgtgtgaggcgttaacctcggggaggctaggcgaagggtacatgggagccttctgtactgattaaataataaatctaaattacagaaattatttaaaagtcattactatttataagttattttttcaaaataaaatgtaaacaaatacatgacagtaagtaaatgaggaattgtgggtaaccatcctggccttcctttccttctttagtgacagccccaatgctgttcatgaggtggagaagtggctgccccggctgcatgctcttgtcgtaggacctggcttgggtagagatgatgcgcttctcagaaatgtccaggtaatgtgtatactcactcacttccctcatgacaggcttagccttaggcgtgaagttggaacagaggcatttctcttgcattttgtgtagtgttccgtgtgcctctttgtggcatgattgagataagatttgagggacggaggagaaactgagtgcaaaggtggggaggaactgtgctgagatgtgcttctctccgggcccgactgttttctcatggagcagctgcaggaggtgtgtgtgtggagttgctcagttgttttatgtctgatgtgaggagagggtgagcaggactgaggaggtgacagaggtttggggtcaggcctgggtgtatctcccaggccacccccttcttgctgggggatcctggggttccctcagcctcctgggccgttgttcccacacagccctggcgccatgctctgctgacatcaggctgtgaggtgacacgggcctgcttgtccgtgcccacatgcatatgcgcatggactctcatttatgctggtatttctttcttaaagttcatcttatgcccacctaaatccaaaagatgaaagttattctgatcactttgtgcctgctgtaaataaataccacctgggatcaggggcgataaaaagatggggatggctgccagctctgtgttccctgcgtcctctgacgctccctgggctggtgtgtctctgctgggggttgtgctcctgtggggctgccctctgagaccctttctcaagttccgggggacccctgttagagctcctgggggaagacacagtgtgccagatggcttggtgccacagggtgctcacatgtgcaaggcgtggtgactgcatggggatcagaggccgggcattagtgagggactacgcttgaagcccttagaaggtgcctggccattttgtgttccccagatcagcagtcaccctgaaaatgccagccatctgcatggcactctgttgggtgcttagttaatggaggggtctctgaggctgcggggcttgaaggcggcgagtgatggagccagcagtgcaggatgagtcatctgaggggcaggcagacgcaggctgacactgcacagaccaggaaaagcggcgtggagtcagcacgggagcccgtctttgagctttaaggtcttacccgctcaccgggaaggaggaggtggccatgtttaggagcagtagaaccctctgtcatccccggggagaggctctcaatggggagtcccatctgcaggctgcgggtctgcggtgcacggctgctgcttcctgtccagctctgcatcctgggggtgcggatgaattagaggtgaacgagccagagtgctctgcttcaggttattttctttgtgaatttaagttcacaatttaaaaactggtatcttaaaaaaccactgtactgcgtggaagtgtgaaaggtgggaagtgagggtgtgcgtcgctgcccctgcagcccagactctggaccttgcattctggttcctgtacactgttgccgtggtcttgagagccctcaggtcatctagcgtgggctgccgcctcctcgtcagcttccagctcgtgtctggtgcggagcagaggcttcctacttcgtcgacgttcctgaatgaggtcatcatctggtgtaggcctgaaaacaacccgattaggtagattcctattcatagccccattcttctgatgacagattgagtcctggcaaggattcaagacgcccgtgggatctggtagcaaagaaactgcagagatggttttttaaaaacgactttatttagatgatttacctaccatacccctcacccatttaaagtgaactatgcggtggcttcaagtatattcatagttgtgcaaccatcaccatgatcaaccttagaatatgtttattgcctccagaagcagcccatccccgttagcatctgctccctgttccccagtctccccagttcctggcagccactcagctagtatgctttctgtctctctggattcgcctgttcaggacatttcatatgaatggaattatgcaacgtgtgctatttagtgattagttatgtcactctgcataattttatatttagagttacctgtgttgtagcatgtatcagtattccattcctttttatatctaatatttcactgtatgcatacaccacctttggtttatctgttgattaatttatggaaaattggtttccactttttgtgtggatgtgttttcactctcctgggtgttaagtgtttcacattttgaggccctgccactgtttcccatagcggctgcactattttccattccctctagcagtgtgcgagggctctgattctccacatcgttcccagcacttgttactgttgttgtctacttagcagccactctagtgggcgtggagcgacctcactgtggtttggtttgcgttttcctggcagctgatgctgttgagcatctttgcatgtgctcattggctgtttgggtatctttttttttgtttttgttttgttttgtttttgagacatattctcactctgtcacccaggctggagtataatggcgtgatcttggctcactgcaatctccacctcctgggtttaagtgattcctttgccttggcctccaagtagcttggactacaggcgcccaccatcacacccagctaatttttgtatttttagtagagatggggtttcaccatgttggccaggctggtctcgaactcctgaccttaggtatccgcccgcctcagcctcccaaagtgctggggttacaggcgtgagctaccatgcctggcctctttgggtatcttctttggagaagtgtctattcataccctttccccactttgaaaactgttttttgccttttttttattgacttttaggagttcttcatatacgttctagacacaggttccttatcagagagacgatttgccgatatcctctcattctgtaggttgtcttttcacttcgatggttttgtttacagcacagtttttaattttgaagtccaatttagctgttttttcttttgtcccttgtgctgttggtgtcttatctcagaagcttctgcctaacccaaggtttactcctacatgttaagagccttattgttttggttgttactttagctctgcggtgcatgtcgagctgatgctggtgtggtaggaggaggctccagcgtcagtcttttgcttgtgggtgtccagctgttgcagcaccatgtgctggagagactcctttttcctcccaacttgtcatcctccctgacaatccgttgaccctaaatgtgaaggcttatttctggactgttgtttctgttttgttgatctgtacagctgtcctgcaactgcccggtcttgactgctgtggctgtgtaggaagccttgacgtcgaaagcccgagtcctccaaattcgctctttttaaggttgttttggctctcctgggtcccatgcattccagttttggatcagcttgctgatttgtggaataggcagccgcaactttggtagggatgatgttgaaactgaagatcagttgggggaatgtctaacaacattaagtcttctggttcctgggctggctttgaacccacgttgtctgaatctggagcgcaggctcttgaccaatgcacctgtcctcacactgtgctctttgcacactcgttaacagtgtgtcctggagactttttcatggaaggatatgtggatactcattatttttaacagccacatcagaatttatggatctactacagtgtatttagttcatttacactgttttcagctttttcttcatgttaacatcagtggtgtcctgaatctatgtgttttgtgcactcttttgggtgaagttccattgctgaatcagagtaaggacgtttaaatttttgagagatgcccccagatttctccctagtgtaccaaggtttgctttcccatgggtggggacacccttctgcgctgggtgctctgatgctgcaaacctttctaggagacccatgtaacattgcattttccagggtttgaatattcacttttgagtactatttgcaaatacattaaaagaaaacacagaaacagatgaaaatgtcagattgttgccaaatactgcaacatgaaatcagaaactgatctaaaatctgaattagcaaaagcctgccagttttaacagtaaagccaaactcagggcaagcagacaaagaatttttattgttaataaagggaataataaacttccatgaagtctcaggtacctgcctccctggaaggggcttcaggacacactgctaatgctcggaccagtgtcagagccaaatacacactttcctatggctggaatgtgcgtcataaacaggctgaaatgagcactttgttaggcgagcagctaatgctttgtcagctttcaaatttcatttaatatacacggctttagttttcaatactttaaattattcttagcatgtatttttatgtccagaattggtgggttcttggtctcactgacttcaagaatgaagccgtggaccctcgcggtgagtgttacagctcttaaggtggcgcgtctggagtctgttccttctgatgttcagatgtgttcggagtttcttccttctggtgggttcgtggtctctgtctcaggagtgaggctacagaccttcgcggtgagtgttacagctcttaaggcagcgcgtctggagttgttcgttcctcccggtgggctcgtggtctcgctggcttcaggagtgaagctgcagatcttcgcggtgactgttacagctcataaaagcagtgtggacccaaagagtgagcagtagcaagatttattgcaaagagcgaaagaacaaagtttccacagcgtggaaggggacccgagcgggttaccaatgctggctcgggcagcctgcttttattctcttatccggccccgcccacatcctgctgattggtagagccgagtggcctgttttgtcagggcactgattggtgtgtttacaatccctgagctagacacaaaggttctccacgtccccatcagattagttagatacagagtttcgacacacaggttctccaaggccccaccagagcatctagatacagagtgtcgataggtgcactcacaaaccctgagttagacacagagtgctgattggtgtatttacaaaccttgagctagatacagagtgccgattggtgtatttacaatccctgacctagacataaaggttctccaaggccccaccagagcagctagatacagagtgtcgattggtgcattcacaaaccctgagctaaacacagggtgctgattggtgcactcacaaaccctgagctagacacagggtgctgattggtgtgtttacaatccctgagctagatataaagactctccacatccccaccagactcaggagcccagctggcttcacccagtggatcccgcaccagggctgcaggtggagctgcctgccagtcctgcgccgtgcgttcgcattcctcagcccttgggtggtcgatgggactgggtgccgtggagcagggggtggtgctcgtcggggaggctcgggccgcacaggagcccatggagggggtgggaggctcaggcatggcgggctgcaggtcccgagccctgcccggcgggaaggcagctaaggcccggtgagaaattgagcacagtgccggtgggctggcactgctgcaggacccagtacaccctctgcagccgctggcccgggtgctaagtccctcattgccccgggccagcagggctggccggctgctccgagtgcggggcccgccaagcccacgcccacccggaactccagctggcccgcaagcgctgcaggcagccccagttcccgctcgcgcctctccctccacacctccctgcaagctgagggagtgggctccagccttggccagcccagaaaggggctcccacagtgcagtggtgggctgaagggctcctcaaatgccgccaaagtgggagcccaggcagaggaggtgctgagagcaagcgagggctctgaggactgccagcatgctgtcacctctcattttgtttaatgttttctattttaatgttttgtattatcaggtgtctgtcaagtcaggatcactttacatgctactgcagtgtataatcttgtcacaatgtattggctcataataataaaaaccaccaaatattacatatatgtgtgtgtatctatacatgtagttttttttttttaatagaaaacctttgaaaccttcactgtaatcctatcagggaaaaatgattccctgtttattattgttgttattttaaaacgtgtaagtaaagtgatatgaaaaatacataatgactaatgatttggggaattctcaggaattcagatttcctgcctccgaatgctgcgtattagtatctgttggagaactggatgcccttgctggggcgggggctgtcttcatgggttagcctaggagcccagctgttgttcatagcgtttccagtgggcttcgcctttcagagttcccagtgtcctgccttgtttacgggctctgcgagttcattgggtctttctgcttctctattttattcatttacttgattattttccatttattgtttgatggcctgatgttgcattttattaagagtctgctcaattttctgtcactcttgggaaaagtgtcttagtcggttttgcgctgctgtagccgtaccacagactgggtaattgataatgaacaggcgtttactggctcacagttctgaaggtggatgtccaacatcaaggtgccggcatctggcgagggcagaagggcaggagagagacccttatgcctcttttaaaggtcattaaaccaacccatgaggacactgccacatcaccttttaaaggccccacctcccaggacccttcccttggcaattaagtttcaccatgagttttgagaagacacatacccacaccatagcagcaggcatggtgctcagtctggttttctcttctggcagggcattttggaagtgtcaaaggccagggacatccctgttgtcatcgacgcggtgagttgacttctctcctcctggctcggactcccggaaggcctgtgcagtgagcacggctccttgttctgtgcaggatggcctgtggctggtcgctcagcagccggccctcatccatggctaccggaaggctgtgctcactcccaaccacgtggagttcagcagactgtatgacgctgtggtgagtcagtggaccccctggagggtagatgcaagccctgttcgtcctgaagagggtgaaggacgagctccatgcttctgcccagcctgtccctgtggacacacctgcaagtaatcgctgtgcctctcccagcggatggcgcgtcttcccattaatgcgcttggattggatgaacgatggtgtagtgggcttgggacaggcagggactcgggtcagtcagcccctcctgcagtgcactctggacaggtcactttgtctgtgtcctgagtgcctcatctgtaatgtgatgatggcatcagcttcacggggttgtgaggatgagatgaggaaacctatgtaaagccgtgagtccccacatggtaagtgtcccatcaatgttagtgcccagtacgactggaatttgtattactcctgcaaagctctcagaacccagtcttgggtggtcctccttcagcctgctctgatgaggtagaggatgggcactggagcaggcaccgtgtcagcacctgctcggaggactcactgcaggtgatatcctgggcatcctcccacctacatggcctttaacaggtgcctgggtgatccctttagacacgagagcatgagtctcatggcggatgggacagggctatctgtcgtcgtgtgtctgaggaagactttgctttttctctgtcttcctgtgttgtcatagctcagaggccctatggacagcgatgacagccatggatctgtgctaagactcagccaagccctgggcaacgtgacggtggtccagaaaggagagcgcgacatcctctccaacggccagcagggtgagtggcggctgccctctgtgcatgggccagtgccaggtcagtcagcatggccacaccgagcatgagccctggaagacctctcccgtgcacacccgtgttcacacacattcacacagggattcctgatgagctcgtcaaccacactttcttcagagtccatgttttgacttttcactgttttgccaggggaggtgacagtggtgagggcaggctttcgagccgtgggccttacccgttggttgaattcccttgcctcagttatgagaagcagtctggcgggagggtgcctgcaacagcagggcacagtgcagggtcccgcgtctccagctgccaccttcatctcacctgtggcatccaccatccatgcagttatttgggtattttattgcatttcattctcttttatcaaaatgactggaaagtgcagaaagccccgaagctgatgctggtagtggaatctcaggcactgagtgtggcgagtctcaactggccactcccacggagcctggggaggcttcagcaagagccaagtgagagcagggcagaggccgggcccagcgccagcgaggcatctggggagccgtgcccttgttagcgctgaaaatggaagcccctccattcaggcctggacagatgatgggcagcgaatgtgctcacctgctgagctgtggggctggactaggtaccaaaatcagggtagaacactgaggcgtctgtgggcgggtgtgtgcacatccacacttgtacactcacattcacatgcacatatgtgcacacgcatgcaattcatacacatgcacagttgtgctcacagcctcgcacgcccttgcacactcgcacttatacacatgcatggtcatgctcacagcctcgcacacgccctcgcacactcatccacacacagctgtgcacaaggaacacagagcagatgttctcagagggactctgacacctttgagatgagggttttttaatcactggaaggctctcttgggtctaacaggttcagagaatgtaacacctggttttcaaaacatttttcaaagaaatagagaattcccatacacaggcatacgtgacgttatgaggccggtggaggcctcgctcggtgttgccctgtatggttgagctgtggtttaaggtgaactctggagtgtgggctgcaggtgagggctccgtccctgggagctggtgggaggagctggaggctggcgccgccctgctcagagctgcctgcttgggctcgtctgaggcggttccgagctgcaggtgtctccaccaacctgctgtgctacacagcggggtctggggcagcctcaccactgcgtgtcttggtttcctcttctgtaaaacagaggctgcctccaacccttggaacaaacagggaagagccgtagcaggcaggatgtgagtggagcctcaggctgctcctggagggtgtggctctgcctgccgtgcggccttccacacccgtggctactgtcacattcacacacatggccatgctgacacctgctctcacttctgccctgtgcagtgcttgtgtgcagccaggaaggcagcagccgcaggtgtggagggcaaggggacctcctgtcgggctccctgggcgtcctggtacactgggcgctccttgctggaccacagaaaacaaatgggtaaggccacgtcttcatttattctactttgaaaccgtctgatttttctaagctgtttcagtagctcatgcgttgaataagtagccctggaaacactgacaatgaactctaggcttcactggagagatctcggcacagacgaaccctcttggcagaagcttccaccccacacttgggcctgggcctgtccatcattcactgtggatggggcctggggcaggggtggtcttcagagctctccagagagttccgaggtgcaaccaaggcccagcagcacgctgttctgggaagttgagtggtttattctgtgtaacacagaatactaagatagaaaacagacagggtcaaggcttacttagacacttgttcttaaagatgtgaattttctttaagagacagcagaattctaggaccagggcccttggcccagttctgtagtcagagaactttatgaatgcaagcagttcccatacctctaagcatctccatttctcttctgtgagcccatcaaggtggtggctgcaggtgctaggtgtggcagacccgggcttctggagggtgggcagggctgtcatccagtggcctcatgtgtcctcattgccgggatggcagagtctgggaccatcccccaaactaggtgtgtccacatgaatttgagagccgaggaggtaggggtgtgggcaggagtcttactgttcattctgctgtgttcactcgagttgcctccacccctcccccaggagatggagccctggtagcaggaatccccattctcagacctcagatgccctctgcacctgggcactgagagcacagtcaaacagggctaagcagcttgtgccgcctggctttccccgggaacacctggcccactgtgtgccctagccctggacctgtctccgagtacatagacgtttcctgtgtgcctcctgccagggagtagtggagggttaatggtggttttcgctgtgataaacctgctttctcctcaggggcatatcagacttgaaattgacaatttggggtcctgagattgaaacaggagtcaaaaccagagcccagggtagctgcggcccccggaccacgacgcccacttccccacacctcctgctgtccccctctccgcaggtccagccctctcctggtggccgcgtttggcgcctgctctctcaccaggcagtgcaaccaccaagccttccagaagcacggtcgctccaccaccacctccgacatgatcgccgaggtgggggccgccttcagcaagctctttgaaacctgagcccgcgcagaccagaagtaaacaggcaccttggacgggggagagcgtgtgtgtgatgggaaaatccggacccacgcgtgtgctgaaggcgtacggtgcttgccagattttcaacttgagcataaattggttgccattgagaatttaagaatctggaatattgcagcttttggttaaacttaatgcatggttggagatgttatggcgacactaaacaaagtattcctgaactttccttagctccttggtagtaactgggaagacagaaatgaagaaaatcacatgagaatgaagaattctttagcagctcaacagagtttctcggcctgctcccagatcggcgaagtttctacttgttactctctctgccggcgcccttcgttcctcctctgcttcccttccctagtctttcctccggcagggagctgggcaggggtccccgggtgtctccctgagtcccgactgcactgactgggtccatcagagggctgcttcgttctccagctcatcttcttttaaagtggtgactagcttggtggtatctggctgctggtgtttggcttattgacatactccagggtaatcaatgatgactttgtttggaaacccttttggaggcaccatgggaacagaaggaaacatgagtgacgctgacccttgagtgtgtgggtggggagctctgagacgcctcctgtcccacgctctccggtgtccgtgtctacacaggggtccccatgatacccaccggccccagcagggcagaccggaccggggacgggcacggtgaagggctgcagcctggggtctgacgtggcccctagtgctgtctcaggagaaggctctggaggacttgaggcatgctgggcctggtgcagtgatggcgctaaggagacccggggaaagacagtatcgtggtcacgtatgcttaggaagcagcacagccgtgtccttagggatgttcgcgtccagtaaagacactggtaactgcggtttcagccaacactcttcatggcagtgtcgacctcgggttagcttctgttgtctttgtggatggttttcctggagcggcctgacgttgacgtgttctctggtcccatgtcttagcggggcatggtacggtttcgtgcctgacgcgtgcattagggtgttctcttatactttcagtagcatctttccacagcaagggccaaaccctcctggttcccttcagagtctttttggcctgatgatgactcttgagtgataccctgtgatgcagacatgccccagatggattctactttctttaaaactagggactttcaagattaaaaaaaagattgtcactactaatttgacgcctaacttcagaagcttcactgtctacatgtgaacttttccagaaaaactgtgccatggacatttttcctctggggaattaacatctaaattctggtaactattaaaagacagatctggttaattt

SEQ ID NO: 38251 - DNA, 45499 bp, Homo sapiens
ctgacactgaacgccgcttgtcccctccggcttgccgtcctcgcagccatggcggccgccgcgctcccagcatggctgtctctgcagtcgagggcaaggactctgcgtgcattctccactgccgtctactcggccactccggtcccgacacctagcctgcgtgagtgtctgtctcgtcttctctgggctttgggggaggtgcaagagcggaataccggcctcatgaagggtgccgcggtggctgagccagcgccgcccgggggaggccagtgcgtccgctgccaggcccgtctggtaggaaaaccatggacgtgggtctgtgctctgcacccgcgttgcccggcttctagccgcctgtttctgccctgggtgctctgggagtttgctcagaaagcttacatcccccttccccgtgacctgctcctgtgttgcccccgtccacagcccctggcacaggttactggtgctgtgttgtttatcgggcatcggcgctgttgaaccatggatttccccaaacattaagagagtcatacggctgtgctaggacaaattgctgctctgaattccaggccaccaaatgggcggccttcattcaacaggcgttgatgacctccatttaacagagattgtagggatgcttgatagcgtgcttaccccggaggactctagtggaaaatacagatttattagcggagaagtgctatgtagggtgagaggcgctgtgatagaagtgtggctagaatgacgggagcgttgaggaggagctggcgtgagtctaatcaataggcggatcctacctgtgctacttcctgttatatctctaatttactctcctcatactaccaactatctagttcaggtgaccatctcatttctacaagttttttttccgtttcctgtttcccctcttgctctcctacattgaattctcaaaacagccaaatgaggttttcaaaatttagatcttgtcttgctgctctcatgttcaagatctacaaatggtttcccattgttttcagataaactataaatacattaatccttcatactggctcttcataggtctaataattgtctatttttaaattttcattcttaaattcttggaatacttaactcctattgtataccatgcagtgttctagacactcaccggagatacggcaaggtggggaagtcaatagtataaacaaccaaacaactaaataagatgtcagatagggtttaatgctttgaagaaaaataaagtagagtattgagaatgatggatttggggggagtagtggccacaggatggtcaggaaagatctttctgaggaagtgacatttgaacagggccccaagccatgcagagatatggggaaagagcctttggggtatggggaactataagtgcaaaggccaaaagttgagaacaatctgaggggtgtgatcaaggaacgggaagaaggacaatgtggcaggagctaagtgtgagtagaggagagagtggtagtataagacgtcagagagttagttaagtaataatctgatctctcaagagtttgtagacatttcatttggatttttggcttgggttttatattgaaaggcttggaacagggaactgatataatgtgatttacgtttttaaaagatcactggctgctttactggggtaagagtggaagccaaagatctgtttggaggctgttgcagtaatccaaatgaggtgatggtgacttggattaaagtaatagtggagaaggaggtgtggttgtatttgcgatatattttgaaggtaaagttcataggatttactgatggatttgatgtggggcttgaggacaagtctcaaaaaaatcctgttacatttttgttctgagcaattggatgaatgatgattccatgtacacgaattgggaagactggaagaagaaaatcaaaagccctgccaaggggctgagtgtgggggctcattcctgtaatcccagcactgtgggaggtcgaggcctgcggatcccttgagcccaggagtttgagaccagcctgggcaacatggcggaacctcgtctctattgaaaatacaagaaattagccagacgtggtggcccatgcctgtagttccagctactccagaggctgaagtgggagaatcacctgagcctgggaagtcgattacagtgagccgtaatcgcaccactgccctccggcctgggtgacgggagtgagaccctatctcaaaagaaaaaaagttctgctaaggatgcattatagttaagacgcctgttaagtgccttcagcctcttttctctctgtctctctctgttctgttcttaaatttcagccatattgaatttgttcactttgattttccatgtgctctcactctgtcaaaacactttttctcacctgcttgtcttcatggctacgtcctgctcatctttcaggttttagcttaaagttcactttctcagggagattttccccaactgattagagttttccagagagacagaacgtagatgtaggataggatagatgtagatgtagatatatagacatatgatgggattttttaggggaattgactcaccccacaataggctgtctgcaagctggaagcccatgtcagtccaagttcagaaacctcagaaccacagaagccatgtaattttcaggccaaggctgaaggcctaagaactcagggggctgcgtgtacaagttcctggagtccaaaggctggagcacctggagttctgatgtccaagggcaggggaagagtgtcccaggtccagaagagagagagagagaatatattcttctttcatctgcctttttgttctttctgtgccctcagctgattggatgatgcccacccacattgagagcaggtattcctcactcagtccactgactcaaatgcctgtctctcctggaaacatccccacagacatgcccagaaataatgctttaccacatgtctatgtattcctcaatccagtcaaattgacacaaagttaactatcatggctgggcacagtgactcacccctgtaatcccagcactttgggaggctgaggtgggtggatcgctggagctcaagagcttgagaccagcctggcaacatggcgaaacaccgtctctacaagaattagccgggtgtgctcatgtctttagtcctagctacttggggtgctgaggtagaaggattggcttgaacctggtagttcgaggctgcagtaagccgagattgcaccactgcaatccagcctgggcgagagtgagatgaccttgtctcaaaaaaaaaaaaaaaaaaagaaagaaagagaaaaaagaaaaaattcaccgtcatacaaactaattgactaggtttcgttccctgctatatgtgttcataatatttatcactgtttattgaaattatttgttaaaaagttgtcttacttgacagactctgtaagagtcattttttagataatgaattcactgtatctgcaattcaaataactgtagaattttccttactggggctaggcacagtggctcacacctgcccaccgcactttgggagactgaggcaggcggatcacttcaggtcagcagtttgagaccagcctggccaacatggtgaaactctatctctactaaaaatacaaaaattagccaggtgtggtggggtgtactggtagtcgcagctacttgggaggctgaggcaggagaatcacttgaactccggaggtagaggttgcagtgagccgagatcacaccactgcaatccaatctgggtgatacgccgagactccctctgtttccagtttttagtcttcattaagatgattttggtccctgagcttaccaaaaaaaaaaaaaaaaagattgtttcattgttatgttactaaataccttaaattgtgttagaataatgggatcatgattgatgttgaacaactaacttgacatgataaaattctctttaactactgtgttatcttttacgtacagcggaaagaacacccggaaatgaaaggccaccaagaagaaaggtaaaaagttcgtatactctactatcttaatggtttctggagttctaaaatgaggcagatattcattataaggcagaagggtgttaccagagaagacttcacaaggtcatgtttactgggtgattgccatagccctggcagaggttagtctttgttttttgtcagtacccagagaatagatgatctttgagaggttgacttactgaggaactcccaggaaacaggtgtataaaccagaatatggaacaatttctaatgctatcttaagtcctgcagcctgggacttatgcattaatataactagtttgtttatttatttattattatttatttgagatagagtttcccacttgttgcccagctggagtgcagtggtgcagtcttggctcactggtacctctgcctcccgggttcaagtggttctcctgcctcagcctcccaagtagctgggactacaggcacacacctccatgcctggctaattttttgtgtttttagtagagagaggttttcaccatgttggtcaggctggtcttgaattcctgacctcaggtgatccacccgcctcagtgctgggattacaggcgtgagctactgcacctggcctcccaaagtgctgggattacaggcatgagccacggcacctggccgtattctaactagttgagtctcaccctgtggacatttggattccttacttctatggaggaatctaaacgataaggtcagttggtgagcaatagtgtcagaacaaagacacattagttggaagttaaatggtatcaaattacaatcattaagagcagtcatttcctcaggactattacctgcttctaggatattgactacactggttttgatattgcgtaggcggggcatggctgaattttgccactataaaccctacttttgtatgtgggccatcccctcgtatttgatgccattaaaaataaatgttaatgtgattgactaagctatcaagtactagtttttctctgggcctaggagacatataatttttcattatatatttattcaatcagtttaaccctaattattttttccttttctttttacttccaagtacttaacgccccctcatgtactactgacttccatcaaagaagttcgaaaaattatttcaaaatgtattgttaattcaccctttcataagcaaaatgtaaaaattttgctaaaagtccagttaaagaaatttttagtgaagaaaatgtgatattaaaggggatccttgccagagggtttgaagaaacagtgcagagatatttaggtagatttagtgttgtttttaaaatttggacagcagcagcattgtgggaggtcagattttacatatgttgcaattttgcttctatttcttgtaattgtagctttttgctttaaaattaaaattctttaagaattaaagaatgtgtttatatttaaaatactaaacgattttatatttcttaggcactacctcctaggacagagaaaatggctgttgaccaggactggcctagtgtttacccagttgcagcaccatttaaaccctctgcagtacctcttcctgttcgaatgggttatccagtaaaaaagggcgtgcccatggcaaaggagggaaatctagaacttttaaaggtaagacaaattgctgattcattggctcagacttacatagaaataaatgctgatcttcccccctatttctgctctcttatgcttcaccgttcagtgtatagcagcttagtgtattttaatttaaatgttaaaaataatataataggtttattattatacaacaccagataataataggtgttgtattttgattatcaatggtaaagaatactcaaagaatcctaggcatttaataatgtaattagttggctgggcgcagtggctcacgcctgtaatcctggcactttgggaggccgaggtgggcagatcacttgaggtcaggagttcaagaccaatctggccaacatggtgaaaccccatctctactaaaaacacacaaaaaattagccagacgtggtggtgggcacctgtaatcccagctacttgggaggctgagaaaggagaattgcttgaacccaggaggcggaggttgcagtgagccgagatggcgccactgcactccagcctgggcgatagagtgagactctgtctcaggaaaaaaaaaaagagtaattagtcaatcttgtggcttcccttgtgacctttttctgttgtatctcttctttttggagatgggggtcagtatgttgcccaagctggtcttgaactcctgggctcaagagacatgcctgcctcagcatcccaaagtgctgggattacaggtgtgagccaccacacccagcctatcatatcttttctatattgcatctttccagtggaattaagaaaaatgaaataacctaatttgagattaagaattgggaggtgaaacttccagtttaaaaagaggaatttaaattttttctgtccataaaggtagaatattatttagtattattattatagtctaccaaatttaactttattgcttgaagcaaaataggttaaggcaaatgctttgtttgatagcatgtataattatttatcatgggtgttttaaagaaaatataaatgcttagtctgggaatgcatatcttagatggtttcttaaatacaatgaaagttatacaaaggacaatgaactgttttccattagatgagagtctttgaaaaacaaaagtttgctaaaaggtgatgagaacagggagaatgggtactctgttgctggagacaggggtaaatgaaatttggaaatgggaatgtgaagacacaagaaagcatacatcaaggaaaacaaatgttttctttgaatgaaagaagataattttgtttaaagaggtctttggagaatcactgggtgagagagtagcggtatatttgcaataatgctaatggttgtaaatgacattttaataaacataaaaatccaaacatttaatgcatgccatttatttgtagtaatggtgtcattgaataagcttattaactgagctaatgtatgcaaagtgcatagaactgtgcctatgtaagtccatgcaaattgtctattgttttttcctttcatgatatttgagttttatatgttcatgtttcaaaaataaaagtctatcactctgatctgttaaaagtagcccctcaacactagggtttataatttttaaaatgtataaaaaggaaaaaaccaaaaagtacagcaaatgaagctgcccatccccaaatcccagttttcagtgcctattttctcttgattaaaacaatattttctggccaggtgtggtggctcacacccgtaatcccagcactttgggaagccaaggcaggcagatcacttgaagtcaggagttggagaccagcctggccaacatagcaaaaccccatctctactaaaactacaaaaaaattagccaagtgtagtggcgcatgcctgtaatcccagctacttgggagactgaggcaggagaatcacttgaacccagggggcagaggttgcagtgagccggggtcgtgccactgcgacagagcaagactccatctcaaaaacaaaaaacattattttctgatcagccctcaagatacttggcataattcgtggagtaactttcggcttgtttaaattttctttccaaatgagcctttaagctctttcagatgtttaacattattcaagaaatgacctaataaatgctaattatttatttgaagaaatcaaatctctgacctttcctgcattttcattcacactatgaatgattcagtagccttttaatgtgtcatcataaatatattcctaacttcattaaactatccagttaagatttgctaccttcacttattagttcataaaatgtttattatgtacaaagttgaaatactgtcatgctatgcagcccaggggaattgggatgattaaacaatgatccatatcctggccgggcacagcggctcacacctataatcccagcactttgggataccaaggcgggcaggtcacctgaggccaggagtttgagaccagcctaggcaacatggtgaaaccccgtctctactaaaaatacaaaaattagccgggcatagtggcacatgcctgtaatcccagctacttgggaggctgagggaggagaattgcttgagcctgggagacagaggttgcagtgagctgagattgtgccactgcactccagcctgggtgacagagcgagaccctgtctcagaaaaaagaaaaaaacaaaacaaaaatccacgtgcttaagtcctttcagttttataaaggaaatatacatgtatacctgtagatttgtggcaggaagaatactgtaaaaatgatgtttagtttttttcatcatgattgtcattataagatgcttggtaaaagacaaaagatttatatgatctgaagacaaatccaggtatcactgtaaattacttggtgctgaatctatattttaagaagtgtatttcttgaattgacaacatccgtgacagaaaatcaatattgtaaaaaaacagattttgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgtggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactctgtctcaaaaaaaaaaaaaaacaaacagattttatttactacatgttttattgggcctgtgatttagttttatgagaagattatctttttcatgtttttaagacatttagctaatttatcttttaaatttctctatttaagattcccaattttctgcatttgactcctgtagcaattaaaaagcactgtgaagcccttaaaggtaagtggttattttcttatatgaattttatattgactttgaacataaatttaagaatctctgttctgatatactgtatagccttatattcaagttgttttcagtgaattgttacatgtcaagtctgcaaattgtttttgctaaccactacaaggtattaggaataataattagaaaccatgatccttgttcacaggtaagttagggacttactgttgagttttagaaaacatgcacataaggctgagtgtggtggctcatacttgtaatcccagcactttggaaggccgaggcgggcagaccacctgaggttaggattttgagaccagcctggccaacatagtgaaaccctgtctctactaaaaatacaaaaaaattagtcctgcatggtggcaggcacctataatcccagctactctggaggctgaggcaggagaatcgcttgaactcaggaggtggaggttgtggtgagtttaaatcgcgccattgcactccagcctgggcaacaagagggaaacgccatctcaaaaaaaaaaaaaaagaaaacaaacatgttccatataagaagactaaagtaaatgttgcagatacttcacagagaagaattatcttgaagaaattatttaaaattttaaaaaattagtgacacatgcatgtggtaaatcaaatagtaaaagagcttatgatgaaaaagcactagccttatgtgctttctttaccatccccagcccctcatttatttatgtatatatgcttatatttataatactctgtagtatatatatttatatatacttgtatactctctgtagtgtgtatgtgtatttataaaataacagaagtaatcactggaatatgattacaccttcagttctggatttattgattttgaaaacctattgatttctaggtataaacatagatttcatgtacttacactactacttctccttctccttctttctacatgcatggaggtaaaggcaaataacattttttaactcatggttctgtgtatgcttttataattatgtatatattccaatttaagttctgattgatagttatgattgattagatttatttaggagttggtacctttggataaagtcttaatatactcatgctgatttaaaggtgttgtatattacatgctcagtatacttactaaggcttttcaggaaagaatatgaaacctagaaacacttcacaagtatcctgattatgttgggaaggagatgtggaatagtaaacataattatgattaaatttgagcttttgaaagggccttccgtttaaaaatgtaaggaagactatataaagaggtcctaaaacataggaataataaccttactcttgaaatgagggaggaaaaatctgttgcctcttaataggtcttctactttaggacattgggatgcttttctatccctttagagtgtgtgtttctctatgcatttgtgcctggaattagattaaaactgatcacttccaaatttgtgtcccaggctgggcatggtgcctcacacctgtaatgctcgcactttgggagtctgaggtgggtggattgcttgagctcaggagttcaagaccagcctgagcaatgtggtgaaaccccatctctacaaaaaacacaaaaaattagccgggtgtggtggcatgtgcctgtagtcccggctactcgggggcctgaggcaggaggattggaacccaggagattgaggcggcagtgagctcagatcacgccattgcactccagccggggtaacaaagtgagatcctgtctcaaacaataaaaaaaaataaaataaaataacaagtttttgtcccgtttgccacaaatcatgtattagtatttgatcatctgtaaagacagttaacaaatggcattgcactgtgaaaaattccatgtttcttctttttaaatgtgacagggcgtggtagctcatgcttttaattccacagtacagcactttgagaggccaaggaaaaaggattgcttgatcccaggagtttgagaccatcctgagcaacatagtgagatcatgtctctacaaaaatattaaaaaattagctggggtgtgatggcgcatgcctgtggtcccagctactctgtaggctgaggtggacgacagagtgagaccctgtcgcaaaaaaacataaaaataaaaaagtttaaaaaaattaaatgaaaggcttttatacagcacattcggaagagtggcattatattttatagtatttaaatgagtgtcttaatctttccttaattatccctttacacttgctgctggcctccggattcagattgcgtcttccgtataactcaaaggcttttcaagtacttcttctcagttttctttcaaagtaggtcagttcagattttatatctaacttgcaaatggaaaatctgaagcatgggaaagttaggtaatttaccaaaactttaataatcagtggcagaagttaaatacaaactaaggtcttccaaagtctcatctattgctctacctatcagatgagtaaaggctaataggagtctattatgtgttttccatttggctgtctttttttagacatataatttaggtaatttaattttaaaactgtaattatcatttgatgattgaaatgacttattcacatttttttttttaagtaaaagaaaaaagagtcagtgcaaacccaagagctcacaaaattccccaaactagtctctcttataaagtgcttggaagtgatgcatcttatagtgcaggatattggagtaagttcatgatgggaatgaaattcagcctcaacaatcttgctctgttcatattttttcaatgttacaatgatgttaattgcaaagatacttctttcccctcaaaacgaccgggtattgattttttaaacagtgttcaaggaatggagtgaactatgtttaatttgttaacatgtttagtcccagatatcagagagtctttgtaatccagagtgacattttgcagactctgattttaaagcctaaatgagagcaaaatattgttcctattataagaaaatcgttagcccaaggaaatgttattggcaaaatagttctcactgccccttagactgtcacctagaagagctcccacatctgcctgtgattatgaccagccttttctgcagttgtgcttttttggaggaagcatggatctgtgcagtctaatatgtttgacccaagaaaccagttacttttagctgttcttagagtgaggctgtttaagaaatgagatttccattgtggacagccttatagtgccagaagttttcatctcaagctgaaagttctctgccatgctaacttgattgaaacaggacaagatgaaatcagctctgatacctgggggaagctgggagctacctcttttcctttaagtttttttttttttcccattaggggcctgagtttatgcttctgtgttatgaagatagagaggcatgttcacagtgcttggagctcctgttgtggcctaggtctcagacccaatcccacttcctctctatgctctcttgcccaaatatgaggacaaggctttcttctttccatttaaccccattggcacatagaagtcacatagaaaaaatatcagttcttataagaatccatttaagggcttaggcatttgtacctgtttgagttgaggttctattcagccaaatttctagacgactgttgactccatctcagtttcttcttagggctttttgagagctttcaattcctttcagctgatctttagtaacctttagtaattaatactatctgttacttttttgaaaacagtaatgctgtgggcactatgaactgtttgcttttagttggtacagaggaagtaaactgtccagtaacagatatgtgcaaagcttataataagcttccatcaaggcacagttcccttttaactgaaaataccattaccaccaaacctgaaatatccaaagaattccctaattaaattgcctaatttaggatgtacctgataggaaaagggataagggatgatgctatatatgtaaagtgcagaagagaatctgttctttcatgtaacttggtgatgctctcagtaatttggtattgtctagtagtatgcattacaatgagaatttacttgcaaaagtgtaattgaaattatttcttttattctcagatttttgcactgagtggccagccgcactggacagtgacgagaaatgtgagaagcattttccaattgaaattgacagcactgattatgtttcatcaggaccatctgttcggaaccccagagcacgagtagtagtcttaagagtaagagtttttttcattttttttttttaaataagaatcattctaatacattatttaaagatgtctttggtggctggcacagtggctcatgcctgtaatcccagcactttgggaggccaaggtgggagaattgcttgagcccaggaatttgacgccagcctgggcaacatagcaagaacctatctctaaaaataaagaaagaaattgatatgtgtgattataaaactgtaatatttttcacagaaattttggaaaatacaagtttcaaattatacaccaggcatggtggctcctgcctgtaatcccagcactttgggaggccgagtcaggcggatcacctgaggtcaggagttcaagaccagcctggccaacatggtgaaaccccgtctctactaaaaatacaaaaattagctgggcgtggtggtgggcacctgtaatcccatctactccggaggctgaggcaggagaattgcttgaacccgggaggcagaggttgcagtgagctgagatcgctccactgcactccaacctgggtgacagagcgagattccatctcggaaaaaaaaaaaattacaaaattgcccgtaaatctactatttgtaaccactgttaactatagtagctcattttagtatatagtcacagcctgcctttgtgtatattaatgggatgatactgtatgtgttcagcagtctcttaacaagaattaaacatttcccaataatattaaacattctttaatttaatttgaatttttttgagatgagatctgacaggcagagagtagtggcactaacatagctcaatgtggcctccaatttctgggttcaattgattgtcctgcctcagcctccaaagtggctgggactacaggtgtgagacactgcccagcccattttcttaaattttttgtagatacaggatctcactttgttgcccagcttttcttgaactcctggctcaagtgatcttcccacttccgcctcccaaagcactggaattacaggtgtgagccactgcacccaatctaatttaattttaatggctgcatagaataacgtataaatgagagattgttatgtaccaagacagtgtttgaatctgggggtgtaatgttgatcacttcaaacttagccttttttctgagactgaagtgtgatatataaataatttcataatacagggctaccataatttatctgtattatggaacctttaggctttttaatggttttctttattagaaaaatattttaatgaatattcttaggtattaatatttgtatgtatttctaatgatgttcctaagataacttcctgaaaggagaactatgaggtcaaaggatatagctcttgaagtttgttgatatatattataaaattcctgcaggaaatgtaaaaaaatataatcccagcagaatgtgagaaggcctgctttcctgtgctctcaccaacctacatattacctgtcaacttgataggtaaaaaatttgtcttatatttaaaatttgtatgtctttgaatactagtgaggttgaggatttattcctttgcaaaacatgtattttttgtcatttgctcattttggtggtgtattgattccttgtatacctttttttttttttttttttttttttgagacagggtcttaccctgtcacccaggctgaagtgcagtggcgcgatcttggctcactgcagtctcttccatccgggctcaagtgattctcccatctcagcctcctgagcagtagctggaactgcaggagtgtgccaccatgcctggccaatttttttgaatttttgtagagacagggttttgccatgatgcccaggctggtctcaaattcctggactcaggcgatctgcctgccttgggctcccaaagtgctgggattacagatgtgagccaccactacagggccgttgtttctttttaataatggctttattgagacatagttcacttgctatagaattccccccttaaccatcctcaagccccttttagccactaatctactttttgtctctggatttacctattcttgatgtgttacagaaatggaaccatgcaatatgttttctttcacttagtgtaatgttttcaataggtttcatctgttgtagcatgtattattttatcatttctttttattgccaaatattttattttatgaatataccacattttatttatccattcattaattggtggacatttgggttgtgtctactttttggatgaataatgctgttgaacattcacatacaggtttttgtgtagatatgtgttttccattctcttgggtatatacctagcagtggaatgactgagttgcatggcacctccatatttaacattttgaggaactgccaaactgtttttgaaaaacaatttcaaagtggcttcactattttacaatttcaccagcaagtttgaggctttctatttctccacatcctcactaatggttattacctgtcctttagttttagccattctgataggtatgaaagtatcattgtagttttgatttgtgtctccctaataaccatcttttcatgtgcttgttgactatttgtatatgtttggagaaatgtctgttcatatcctttgcctgttttttaattgggttgtttatctttcgattgttgagttataagtgtattttatatattctggacaccagtcccagtcccttctcagatatatgatttgtaaacattttcttccattctttgggttgtcctcttactttcttgatgatgtccttttttttttttttttttgagacggagtctcactctgtcacccaggctggagtgcagtggctcgatctcagctcactgcaagctccgcctcctgggttcacagcattctcctgcctcagcctcccgagtagctagaactacaggcacccgccaccacgcctggctaattttttgtatttttagtagagatggggttttcaccgtgttagccaggatggtctcgatctcctgaccttgtgatctgcctgcctcagcctcccaaaatgctgggattagaggcgtgagccttttaagcacagaagttttaattttgatgaagtccaatttatgtaagtcatgtgctgcataatgatgttgtggtcagtgataaacacatacacaacagtggtcccaagagattataatactgtattttcactgcactttttctatgtttagatatgtttaaatacacaagtacaattttgttacagttgttacagtatttaacagtaacatgctacacaggtttgtagccaaggagcaattgactataccatgtagtctaggtgtgtagtaggctgtaccacctaggattgtgtaaatacataatgatgtttgtacatgacaaaatcacctagccatgtctttgtcaaaaaatattgttaagtggcgtatgacagtatttttccttttgtttcttgtgcttttggtgtcatatgtaagaaatcattgtcttattcaaggtcataaaagattcactcttgtgtttcctcctaaaagttttatagttttagctcttacatttagatctatgacctattgtttgttaattatcatacagttgttcctcagtatctgtttgggattggttccaggaacgcttgtaaattcatagatctgtggatgcctaagtccctgatataaaatggcatagtatttgaatattgaatataacctagtacatcctcctatatactttgtcatttctagattacttataatgcctaatacaacgtaaatagttgttatactgtattttaagaatatgcagtttaaaaattgttatattgttattttttctgaatattttcaatccacgttccaatccacggttagttgaatccacaaatgtggagcccgtggagacaaagggctaactggatatggtgtgaagctggggtccagcttcattcttttgcattccgtttgcatgttgatccaataccatttttgaaaagactattctttcccattgaatggtcttgacatccttgtcaaaagtcatatagttatcttttaacttttcatttggctactttaccaaattctcttttttaaattttttattatgaaaattttcaaatgtatggacaagtagaaagaggctaatataataaatacccatacacatggcatcttgatttagtaattaatattttgacaaatttgcttcatacacatacatacacatctaagtaccttaacatttctgacacctaatgtttcacactaaaatacttcagtgtgttatctctaagaattaaggagatgtttcctatttaattccaatactattaccacatgtaacaaaattgtcagtaattcccaaatatcatctaaaatatctactccacattatatttcccctattgccttacaaaatggtattttttaagctctgttattgaaaccagaatcccgccaaagaccattgtatttggtaatgatgtatcttatgttatctggaatggcaaacaaccccacctccctcccttcttcctgatgaatttgacttgttaaagagacagggtatttatcttgtaacatttcctatcttctgaatttgccccattgcatctggatgtcatttaccttatttctttatctcctgtatttcacataacctggaagttagatttaaagggctgataagattccagttaaatatgtttggcaagaatactttatagatattgctatgtattttatattgcatcaggggcacgtaaagtctggtggcctcattctcagtatgctgaaattgagcacttggctaagaagctgacaacctaatcattcctttgtgaagatttttgttttgcttttcccttgaacaagtaatctgtgggtggatatcaagtaaaatcattattctttttggtcctcgaagtatatctatcttacctttggccagtgggaactcttttaagttggttcctgtgtccttttgttacaatcctttagcatttgaaagtttccttgtattttgacacaagatggttcaggctcatttttataaatttcttatcccggacctggaatcagccatttttcaaggagccctaatacctgccagtggacagtggtgtttacagaccatgatctggatgctaggacttctcagctgattctttcggaaatttctcaagacataatagataaataatggtagttttaattccccttttcaagtaaccatagcttgttttttctttttgtcttttgcattagataaaatttctgaagtcatatttctgtagttccttatgctgttgcatactttaattgtctgtgcctctagtgtttaacctcaagtatgaggtaggatttcagtgagataatagtgtttattatgttaatggtgtatcctattcttagattactagcatttatgaaattacctcctttgaattattgaagtcataaattacatcaataggttttcaatatactgatgcatttctgaaccctggtcagttcatagtgtatcattcttttattctactgctgatttgctgtgctagaattttacttagggtcatttgtccggatgccatattgctttggagaaacatgagatccctactgttactcacctggaccacgccacgtgccattgcacttccaagtgtctgccctaggaacttctaatttagtatttgaagtcactgtttgtttcctttgtcaaagaaatcttggtacacatggcatatctttttcacacagcagtcatggagcagttacctgatatactttttaaaattaaactttttattttagaatagtttttagtttacagaaaggttccaagaatagtagagaatttcagacccaggttcccctgttgtaaacatcttaaaatatactatggtacgtttgtcacaactagtgaattaatattgatactgaatcaatattgaatttattgttattaaagtccctactttgttcagattatcttagtttttttctaataccctttttctgttccagaatcccatccagtttacaaatcacatttagtcatcataatttcttaggtttatcttgggtgtgatgtttctcagacttgacttgtttttgatgaccttaacagttttgagaagtactagttgtatatttggtagaatgtctttcaacttgttgtgtgtttggggagaaaaaccccagaaataaagtgccattctcatcacatcatatcgagagtataggctattaagatgatttgttttgtttgtttttttgagatagtgtctcattctgtcacttacgctggagtgcagtggcacaagcacggctcactgcagcctcgaccttcccaggctctggtgatcctcccacctttgtttccccagtagctgggactacaagcgcaagccaccacggctagctagttttcgtattttttgtagagatgaggttttgccatgttgccagggggttttgccatgttgccagggctggtctggaactcctgggctcaagtgatactctcacctcagcctcctaaagtgctgggattacaggcagtgagccactgtgccggccatgatttgtcagtgatgatgctaatcttcatcacctggctgaggtagtacttgtccattttcttcaccataaaattatacttcctcccctcttacccatactctactctttagaagaaagttactatgcagagcccacacttaaggatcaggaggtatgctccacttctttgagaaagaagtatcacataaattatgtacagtccttttatatggcaaatttgttcattctcccctatttattaatcatttatttatatcagtatggactcatggatatttattttacactatgtgtcataatccaataaaacattatttttttgctcaaattgttctgagtttaaccattgggaactctttccagtgactcttctgttcctttgccatgcccctgtcatttgtttttaagcaatttcttattttctggcactacaaaatgctctgggctctttccctgtcccattcctagaatcagcatttctccaaggagcccttactgatgtgcttttgatttgtctggagggtgactactacctctttgaggtgcctcctgggaccctcaaaatattaacttttatactctgtgtagcctgtactttaagccagaacattcaaagtacactgaagaaatgtgttgaaaatctatgcaaccattttcgcattatgtactagcaaataaacaatctttaatttctggaattttccattttcctcagtgatattgttgattgatttgtagttttctttctttgctaggtttcagtatcagggctgtaccaatttttttcttaatttaatataactttatttttttgagacagggtctcgctctgttgcccaggctggagtccagtggcgcgatcttggcttactgcaacctctgcctccatggttcaagcgattctcctgcttcagcctcccaagtagttggaattataggaatgctccaccacacccagctaatttttgtatttttagtagagatggggtttcaccatgttggccaggctggtcttgaacacctgacctcaagcgttcctccctccttggcctcccaaagtgctgggattacaggtgtgagccaccgcacctggcctgtgccatctttatgaagtgaattatgaagctttccaatcttttttattttgtagaacagtttaaatacacaacaatatactaagttcttagattgaagctgtttttaaatcacaaagacagtatatgtttactgtataaaatttcaaaaatcccaataaaagaaaaaaaagaattgaaagttcagccatgcttgtaccattccacaggttcatatttttaagaacatattaaatgttacctatttttcataataatggtaacaactacaaccaacagttgttgagctctgttgtgtgttgaaaaatctctgaactgagagtcagaaaacctagatcttaatttacgttattcacctcaagttttgtgggcctccgtcttcagtcctagaattgacatccaatgtccctactggttctaagtttgcttattttatttcacacaaaaataatctcattgctttatttgaaggatggcaccagatttcatttcttgtatcatgcttttcctcttgtcctctctgtgccttgtgctagcctgtgatgccttcattgctcccttgtaccccttctgctgacttcatgtctgccctgctagactctgcaccccacctgctggctgttgaggctcagtggtggtgtcctggatgtgccatgtagttcaagggtaaacgtaggtcaaacaggtggactaaagcacatgcagtccagcatgattaaagcaatatcgtgaaggtagtcaactgttagaaactactattggacatactcaaatgttttaatgcacagaaaaaaaaattttgatagtcataaaagtttaggattaaaaacaacttatatataactttacttcaaaagtgctttattctattaatctcatttatttctgacaaaaattctggaattaagtgttcttgaggaaactgagtctcagggaggtaacatgatttaaggtaacattaaatggcaaatctacaaatcaaaccaattcttgtcttttatgtaataccagcattctttaactaaccacatcatacttgcatatagagaaaatatttcacaagtttagacatttccgaatttatgtagctctttttgtgttaaaatgtagtcatttgaagatatatatatatatatatatatatatatatatatatatatatatatatatatatccagcacctcctgtgatttgaaatatcagtgttattttggggataatgttaacagtattatatcgattctttgaaatgtagcaactgagggcaaaatatctaagtactttgaattttgataaaagacagtgaatgccactcagcccaggttaaagtattagcccagattaaagactacaatgttgcagtgcctttgagtgctaccaggtggcgtgagtgcaccacacaactgttcctgaaatatttatgatttttggcataaactccatatagttattgaacattaaaatgttaatgttaatgtgagttttaaattaatgtgaatgtgatcttacattacacgttgcagtaatgatcagctttgctgcctttttttggaccacttcttatataaaaagctagaatactttaagcttttgaaacttttaaatttattgttagacattattatgatttcattgaagggaggtttaaaaaaggcaaaatcacaacattctcactatcctaatgtaaaaactatttatttttctctccctgttccctcttatacatgcatatgtgcatatatttgtgtattcataatcataataaaggtatattttattttttgtaaaaaattcttcatattggttttaatcagagtataaaatggcttattttatctgtcaagtcagtaacctggtagttgatacattctctttccagaaaactgtggtgattcacattgtctaattgagagttaatagtcagtattcatattacttgagttgtttttaagagtgcatttatatttatctattttctctacttcaaatacaaaatacaaaaattcacagtgctttaaaaaacaatatatcctcccttttaaaaatttatgtattcattcagcaaatatttgttgcatgcattttaagtgttaagccattgccaagaacgagatagcatcattcttaccctcaagggtttcaaatcagtggggaaaaaatgggaaaataaataggctactatactgtgatgtcttgagggaagtgtacagagttattgaagctacagaaaaccaaatagatttcaaaatcctatttagctttttttcttcttgatatagttacagctcttttttattcttaatgctctccatagaagattaacctatactttaccttatttaactgtattctggtgtgtaacctaacctatcttctttttttttttttttttgaggcagagttttgctcttgttgcccaggctggagtgcaatggcgcgatttcagctcaccaaaacctccgcctcctgggttcaagtgattctcttgcctcagcctcctgagtagctgggattacaggtatgcgccaccacacctggctaattttgtatttttagtagagatgggtatctccgtgttggtcaggctggtcttgaactcctgacctcaggtgatccgcccgcctcggcctcccaaagtaatggcattacaggcatgagccaccgtgcctggcctatcttcttgtatcaaatgtattcatctctagataatacctttagcccatgcccttattctctgcaaattaaaaattgtgttcatttgttctagcacttcccaaaatatgtctaaggaagactactgttgtgaaccgttccttgaaaagtggaatctgacgtcaaataaatttgagaatcattgcatattaaccctgcattttgaaatttcaagatgcttattagcatattatctgttctaaaaaatgctaccttaaaaaacccaatttacctcggcatttcctaaacattttcaacagaaagagccttttaaaaaaattcttcttagcctgtgggagtagtgttaacattttgagaaacgttgagctaaatgaatttttcaattgttttgatccttccctgatgctgtattccagcttccatgagatatctgtagcttttaaaaaaagcttgttgcagtgatacaagtctcataattgcatggtagaacttgtaatgatgcaagtctcataattgcatgatagaaatttcttaaagcccttatgttttatctatttatttctatattccaacttaactaacgctaattgagtttaattctattagtgctactcgtaagcaccataatttcatttatttaacagatatgtcgttagttctttcagggaaggcattaatgcccagaactttcaaagaacttcaaacagtatgttgccttccctttttctgtttccatgagtaagatcagggtttataatatgtcccaactgcttgctctgtatagaaaggagtttggaaagctttctttttagtggatttaatgttaataggaataacattgctacctttttttcactaaacaattatatgaaattattttttcaaataacttttcttatttttaaggtaaagctttccagtttgaatttagatgatcacgcaaagaagaaattaattaaacttgtaggagagcgatactgcaagaccacagatgtgcttaccatcaaaacagataggtaatggaaaaaatgttcagccgactggtcacgtgtgtttcctcattgtcctccaattccttggcagtcctttttaaagaaactatattgaagatgggggagggcgtagccttttcttattaagcagagttctctaattcatatttttaatatcctcacactggcctactattgctgtgatctttatgcagcggcatgcttagctaatttaatgttatttttaaccttgattttaatatttccatgtatataaaactcaagagagagattagaagaaaaaagtgtggtttgctagtgattaatgcttaagcaggcttttacacattcaaagcatataaaaatcttgtagttcaaaagtaaaattattaaatgatctatggatctatttggaaattgatgaaggcacattcgtaaataatcaaaatctcagagccaggacagatgtttataaaggcaatattaaatttatcatatatgaatttataaattgcgtcattttttatttgaagtaaagaaaggttattggtatgttttcactaaatggctattttatttttagaattatactttagctgtttccaaattatgtcaaaatataaaaagacccacttttagagataagttaagtgggccgatctgctgtcttcctgctcatccctgtttgaaagcatttggaggtgtcagtatcgattaggtctcatgatttgcagtggtgggaagaaggagcctgacacacatgcagagattgcaacagtgtggaggcagaaaaagctcaggaccatggtttgtgattattaccatatgggagaaagtagatttgaaatatattaggaatagtctttttactatcttcagataatgttggcttttctagttcatgcaactttaaaaaatgcctttaaaatgttattgtttgaaattctgtgagtatccaataatgttgctttttttttttttaggtagttttacaagtgttagtgtatggatatgttttatggtaactatttagagtagaggacttaaataaatataagtacagaataagcagtatagttgaagttatttgtcatatgatggttttatttgatatttaaagaaattggaagtaatcgtatctttctgtatattattttattatccttaaagctcaatgtgtcatctcatgtatgtagaagttttacctaattttaagttattagttccattttaaatacagcagcaacagcacagcattgtatagtgtaactcatttttaaaagaatcagctctaggaaaaccaagattaacatctatcatctttctatatctacttcttatttttatttttaaatttttttagagattgagtctcactctgtcacccaggctggaggtcagtggcacagtcatagctcactgaagccttgaactcctgggcttatgcagtctcctgcctcagtttcccaagtagctaggactacaggtgcgcatcaccatgcctggctaattttttaatttttgtagaaacagggtttttgctgtgttgaccaggctggcctcaaacttctagcctcaagcaaccctcccacctcaccctccgggattacaggcatgaggtacatgcctagctctatgtctactttttagatgaactcatcagatatgttcatgctatctggcagattcttagcactgagatggtgaagggaacttatattggacacaatcctagtaaaagtagcgtaagctattgttacatacagataactccattagtaatgaaaacaaagagatactcgaaattaagttaaaataacaccggtgtttagcttcctcaagtaatgaactacaaagactatttttattccaaaaacagttttcctaaagcagaaaaggaatacctgaaaacattatcttctgtatttagtatattgcatattttgcaaatttttctgtgtactgagtttttagaattttgacttctcccgctttctctttaataggtgccctttaaggaggcagaattacgattatgcagtgtatctactaacagtgttataccatgagtcttgggtaagtgtgtgtgaatatttaatgattttgtcattgtaatttagatgatgttaacctttcaaaatactctttgtggcaagtactcaactgagtattttgtgaactgctgaataatctaagtatgtatgaaatgtcataggtagcttctactgactttaaaagtaaaggtcttgaaataggattattcagttcatctcaggaccttgctaaaatcatattcctaaaatgccttgaaacttcagagtttttgactttgtttttctttttttgactttgggtgaaagttgtcagctatgaagagaataataattatctgtataatttgagaatttataattcatcctctttaaataaactgcagagcaaaactttatagaaaggtattttaaatgtttattgaaatttttagttaacacataacattttgtgtgaacatttgactgttatgcattaggtagaactaagggcaattaattatagcttgagtattctttttccaaaatgcttgggaccagaagtgtttcagactttagattttttcagattttggaatatttgcatattaatatataatgagatatcttggggaggggacccaagtctaaacaggagattcatttatgtttcatatacactttatacacatagcctaaaggtaattttacacaatactttcagtaattgtgtgcatgaaaattttgaccgtgctccatcacatgagatcaagtgtaaattttccatttgtgtgtcatatcagtgttcaaaaagttttggattttcaagcatttcagattttagattttcagattagtaatgctaaacctgtatttaaataatattaaaaatactcgagtctgaatttagagagttttcatgtaagtatgtacatttataaggaagattttgccatgcttgagcaacacctcatctgatttgaagttggtagccaatatgtttaggtaactcaaagtttgaaacagtaatttttaaaattaaaataattataggtatgcatttaaattaaattttttgtgccttacccaacacaggggactcaatagcatttcatactaggaacattcaaaggaataaagttagctggagaagggggtcatgttctttagaaaggacttcatatgtcagtgtctacagaaacagtgaaaaaaggaaaaagaagtaaagaaaaatagaaaaaataaaagttttcatatggaagagggcttacatttgtttttaatgactcttagagatacaacaaggtagcgacaatagtaagacagagacagactttggtttactgagaacttttttttttttttttttaaagtctcactctgttgcccaggctggagtgcagtggagcgatcttggctcactgcaacctccgcctcccaggctcaagttattcttcccgagtagccaggattacaggcatgcaccactaccgcctggctaatttttgtatatttagtagagacaaggttttgccatgttggccaggctggtctcgaactcctaacctcaggtgatccacccgcctcggcctcccgaagtgctgggattacagttgtgagccaccatgtccagccctcccaaggggaactttgtgagagagccatcataagatgcaatgagctacttcagtaggtagaaaacattccatccatcggccacttagtgaagataggcaaaaaaaatatactccttgaataggtagttaaattccatggcctttggaacctcctttcagcccaagttactgtgattctgtgaatacatgcagctgttctctaaactgctcacagcttttccttcatattatgataaaagagttttcacacaagaggatgaatggaaagtgaaagaaaaaaacttggttgtgagatgagtaaaagacaaaaagtagctggtaagctcttctcttctttacaattatttccattattataatttatctggattttctagttctggctttaagagcaacatcagaatagcagttaatctctttcctacacaattgattttagaaatgctgttggcttaagataattaagttttcttttgaaccagcaacatggctgaattagctacagctttatggctgttgctgcttaaagatttaataactaacaataaatacaacccgttttgactttcttattttgccagtatctattagaatgaatttgcccagaaggaaatgataggcataaattcagtggaagttgatttatgggattctttctgtggttccgtgacttagaatccaaacagggttgcattctggattcacacagaagcctttgatctttagtgctgattactttgatgccaggataagtagccacatacaactgtccaaacaagtatacttgaagaattctatattaccgttgtttcttggtgctttctaaacaagtaccatcagtgaagaagattttgaatacagatgagccgtgaaattttgcggagctgctagaaaagaatttttattgaattgaaattcattttccctcaccaacatggaattcatacttgaaattgatgttatcaccgttatttaatcaaatagagagcctctttttaatccattgcttgattttttttataggctagcttctgagcatttaatacccaaatatatgcttcctttggcttttttttttttttcttcgagtcagggtcttgctttgttgtccaggctggagtgcagtggtatgatcatggctcactgcagccttggcctcctgcgttcaagtgaccctcccacctcagcctcctgaatagctgggactacaggcgcatggcaccatgcccagctaatttttgcattttttttgtagagatgggatttcactgtgttgtccaggttggtcttgaactcctgggctcaggcaatccattcaccttggcctcccaaagtgttggattataggcatgagccactgtgccctgccttcccttggctttttaaccttcccctagaggttacctctaagtagcactgaggggaaagtagctgctaattttatgtagcttgtagtactgaaatccctctggagaagtgatcacctagactccagtagaaggatattactgttgtatactattcaaaacagtttaactatagaagtgtcaaagtagatttcagtaagcatagacatcgcaaagcctaagcttcaggcataaaggcttaatactgcctcaaagaataattatttcagtgctgggaaggtgataagagacacatattcactggaccattcatttatccttcagcagtttaaagaagcaaggaggctgggagcactttgggaggcaaaggcaggcggattgcccgagctcaggagttcgataccaccctgggcaacatgatgaaaccccgtctctactaaaaatacaaaaaattagccaggcatggtggtgggtgcctgtagtcccagctactcgggagactgaggcacaagaatcgcttgaacccgggagtcggaggttgcagtgagccaagatcgcaccactgcactccagtctgggcgacagagtgagactctgtctcaaaaaaaaaataataataataattaaaaaataagcaaggagagttgtagagatttggtgtcctattttagtattacgtattgttagcattggaatgaatttttaacctttggagccagacagacatggatttgaattccagggccattacttagtacctgtgtaatagcctcgactatttaacctctgaggttcagttttttcctaaggatttttggatggatcagggagaatttgtgtaaagtgtctggcaaatagtgggctctccataagcatctataaataatgttgatattaacaataataaaatgaggaaagatttttttcttagaattttaaattcatggtttcccaatttctattaatatatacagcttatatttaatttggcagagtttgtacaagtaaagtcagatctatactctttaggatgtgtatcctactcacaatttgacataattgatgataacacaacttccttaattttaactttttagtgattttttaataattgaaaccttccgtaaatgattaggttgagaaataatgagtcagtttgcaaagtgacttgcacaaaagatgagcacaaatactggggaagagaaaaaaaacagttgctttagaaaagttagagatctgaaatcaaatttcagagattcatgggtgattttgatattgaattactaatggttgcttttttacattttaaaatttcggctgtcttatttggatttcatgatagttttattgtcagaactatgtctagctttgtaataaaatggttctgaaaagtcatgtaacaaaaatttctaatttagccaagcagtgttgcattcctgtagtcccagtttctctggaggctggggcaggaggatctgttgagcccaggaattcgagtccagcttgggcaaatagcaagacccccaataaaaattaaaaatttctaagttggagaattttatacttactaagagttcgttttaaaggggacattattgcagatatttctgataaaaatgaatacttttgcagagccataatcaccatttaatctgtcggatttatgagttcattttgattgtgtatgcctacacacctgcatttccactggagaatgcttgagcaatgtttgctatgtttgttctcttttgcattcaacaactatttagttcttgtgtacaagatatgttgctaggtgccactatcaaaatgaatgaccccctgccttaggtaccttgatttctggagggaaaccgttggttataatataatctgttgagcttaatggaagtaggaacacagtgctgtgagagccacagacaagggttaactccccctgaaaacgtcacaggaatgatgatgggttttagaagatgaacaggagtatgtggtacagagtgggtgaagaactttctaggccttgtgggtttaaagagcaggcagaagtttggtgtagccagggtatagaactaacagggccaagaaaggaggtgaggctagcagtaagtcagagacaggctgtgaagctcgtcgtagtgcttatttgcaaaatgtagatttgtaaccagagggcaacattgagctgatacagtattttactagttatttgaaaaagtacttctcactatttttgtttcattttattttattttgggggcttgtgtgtgtgtgttttactagacaattttaaaagtttattttctctttgaagactgagttttgctttgtcacccaggctggagtgcagtagagcaatcatagctcactgcatgcagcctctacctcccaggctcagacgatcctctcacctcagcctcccaagtagctgggaccacaggcaagtgtcaccatgcggagctaatttttttattttttgtagaggtgaagtcttgctctgttcaccacactgttctcgaactcctgggctcaggtgatcctcctgcctctgcctcccaaagtgctggaattacaagtgtgagccaccacatccagccccctctcactgtttcactgttcgtgaaagagtaaaccatcctgtgtcaaatatcaagtgcactttcattaaaaatggcaaatgttggctgggcacggtggctcacacctgtaatcctagcactttgggaggccaaggcaggtggatcacctgaggtcaggagtttgagaccagcctggccaacatggtgaaaccccatctctactacaaatatataaattagccgggtgtggtggcgggcacctgtaatcccagctacttgggaggctgaggcaggagaatgccttgaacccgggaggcagaggttgcagtgagccgagatggcgccactgcactccagcctgggcaacaagagtgaaactccatctcaaaataaataaataaaataaaatggcaaatgtttattaattgtctatttgcttgggttgctggatatgaaagttaataaatcgtggggaaaccatcgtctccaactgaagaacactctagtgggagcaaggaggtgtaataataaatatcacaaaagtgttaaggttgtcttagtttgagctatcataacaaattaccatagattgagtggcttaaatgatagaaatttatttctcacagttctagaggctggggagttgatcagggcgccagcatggttgcattagggtaagggccctcctggtttgcagatggctgtcgtcttactgtgtcctcacttggagaacagagagagaggaaggaaattccctcctgtctctatcatattaagggttgggattccaatatctgaatttggtggggagacacaaacatttggtctgtagcacgggttctataatttaccatttcatttttaattcttctctacttcttcatttcttatgtatctttcaagacttcgacctgctttgaggctgttactctttgtctgacttctgctttgtatagatattaagttattatgtcttattttaatttctatgctggtcactagaacacctgactgcagttagttgtcttagtcatggattgttccatgtatgttttgtttttctaactttagggcctcattagcagggatctgacctattgtagtttgtacttcaaactatctaggtcagtgctaggtaagaatactaaatgtttcatagcagctattgaggctgggcgcggtggctcacacctgtaatcccagcagtttgggaggccgaggcaggcggatcacttgaggcctggagttggagaccagcctggccaacacagcaaaacctcatctctactaaaaatacaaaaaaaaaattaggaagtattttaaaaagtatttgaattttacattactttgtaagttctccacaaatacttgcttctgtgagttcagttcatgatgcaaatttacagttgacaatgttaatagaatctatattctaaaaaaaactggctcttcctggcaagacgcatctctttaacatgaagcgtatgtttttatttagcactttttgcataaacttactgatgttacagtgtttgttaaacaactaactacacacatgcattgaactcccatgagtccgagcattagtggttggccagtaatggtaaagtgtaactacgtgccacagttttacttgatttcagacaaatacatctggcctttgttctaaaaagtggacctgtgatgttgctctgagagttaactgggtctctgtctctgactttgttttttttaactctgtgctgcttcaatgatcaccttgcattaacataaaaaggacacgaaaaaaggggtaaattagttgttccatctctcccccacaacacacagtgaggcggggtctcactctttcgcccagactggagtgcagtggcgtgatctcggctcactgcagactctgcctcccaggctcaagtgatcctcccgcctcagcctcccaagtaggactacaggtgtgccaccacacccccagcatgttccatcttttaaaagtgcttcaaaatactttgtcttttttcttttttttaacacaaagcatttagtgcagccatcccttttaaattagggctaactttgaaggtgaagaatcaaacagcttatcttattatagccttttcattttatacactgagaaattaagatttagaggaaaggtcaggtactttgcccaaggttacagagctttttagtggaggaactcagacctgaactgcagcttcagtgtatcatattctttccatgctatcatattatttagttttattcaactttgactttcaaaatgttatgaaataagagatgaaatcaaatctgactttaactgctagtttactctcctttcaaaatgaacaactgactaattgaaaattcatctatctccataacctgttttcagctgggggttgtatcagtgccacctgggaagctttttttttttaaattatactttaagttttagggtacatgtgcacaacatgcaggttagttacatatttatacatgtgccatgttggtgtgctgcacccattaactcgtcatttaacattaggtatatctcctaatgctatcccttccccctgccccccacaacaggccccagtgtgtgatgttccctttcctgtgtccctgtgttctcattgttcaattcccacctatgagtgagaacatgcagtgtttggttttttgtccttgcaatagtttgctgagaatgatggtttccagcttcatccatgtccctacaaaggacatgaactcatcattttttatggctgcatagtattccgtggtgtatatgtgccacattttcttaatgcagtctatcattgttggacatttggcttggttccaagtctttgctattgtgaatagtgccacagtaaacatatgtgtgcatgtgtctttatagcagcatgatttatgtggaagcttttaaaactacagatgcttaggccctgcagaatcagaatctctagctgtgagacccaggttttgatagttttaaaagctccacaggtgattctggtgctgagctctgattgtgaataatttctccagtctttgagtgttgtaaataaggaaattgattaggttggcttgtcttttttaagacagtttttgtacatgtaagtttgagtatccctaatttgaaaatctggtatctgaaatgctccaaaatctgcaacttttgagcactgacatgatgctcaaaagagcgtttcacatttcagatttggaatgctcaaccagtcagtataatgcagatattctaaaatcctttaaaatatcgaaatctgaaacacttctgatcctaagcattttggataagggatactcaacctatatctaatatcagagcttgagggtaaggggtggtaattagaatgaaaggggcaggcaaggaaatggagggatttttctgttgtccataaataggaatttagacttgatgtgatagacaataggcagtgttctagatccctgagtgggatggtgctacacagaaggtgacaagctcatacctttttgccttcaggcaggacttcattttattatatacttaaaagacctttaagaaaaactcaggttctccttccccacccagtggctgaagtaataaatttgagagttacagttttcttccctctctcctgataccaaataagttaccaagtctttcggttttcgcttttaaatatcagttaaagctgtttccccctttttatccctaccgctacagtctagtataagttttcatcatcatttacctgaaaactacaataggcttctaattgatttccctgtctcatctaccttctatattactgttagagtaattgttcaaaaaaacaagtctcttgtaccatattcctttacaaaatccttcagtggtttcccattacttaggataaagtctgaactccttagcatgacattcacagcaatttgccacctcattaccagcactcaggaaatatacattatatagcctgtactttagccataatgaacataatatgttctttcataactttgcatatgttattctctttgcgtataattcttttttcaaattgatcagccttgcaaattcatatgaatcttttaatacacctcagttgtaacatctctgtttcctgcccatctgttttccctcctctagttaacattccttttattacatataattgcctgtatacgtgtctgctcaccccattagactgtgagatcactgaggacaaggagtatatattcattcatctttatattgcattcagtaaatttgcattcagtaaatgttttttaaaacttaattgaattctttgacatagttaaaaatttagctttggtagctgaaagaattgacagtaattcttttttcactttttatgaatatttgcctcttcgtattttttatgattttcaaattgcttgggattttaaaaaatggttaaactgttttctctcatacagcacaaggccttacttgtaatcatgagtagtggaatattactatgattcatgtcctaggcaaagagagttgtaaataagaaggtaggaggtgacaggcttgtgtgttcagtggagcagatatttctttgccttctgttacaacagaatacattgacccttgcatgaattagctattatgtttttctttgtattacattcatacaaggaaaaaaaaagaggttcaagttatgttattatattttttgttactccttttatcatgcctcgaggttccttagaacatgttgttctaacactaacgagcagtgtggttttgggcaaattattcagttgctctgggcttcagctgcctgatctgtaaaacaggtgataatagtactaactcactcctaggtttgttgtgagaattaaatgagttaatacctgtaaggcacttagaatagtgcctggcatgtagtgagtgttccaacagtttttcagcctcagcccatgccacttccttctcattggccttcattcatttcctcgattgtgttaagccctttccggcttcaaggcctttgtggatgcttctcctctacggggatcacaatattcatctgactggctcacagtcaacttcaagtctctcattagactgaatgttcccagagaacactatgcctggcagaatagttgtgcaataaatatttattgaatgaataagtaaatgaataatggagccaactggaaaagagaacaggatcacatggaatggaaaattgcttcttcaggggttgggggtcagggcagattctcattgcaggcaggaagaaaaagaaaagtggtgtgtgtgtgtgtgtgtgtgtgtgtgtgtgtgatccatatttataaattaaatggtgaaattgtaaatatttaatggtcaaagcattaaaataggagtcgacaaattaattgaattctttgcctaagtgatgatcagtttgagcttaaaatggtatttttaattgcccccagtaatttgaatatgctgttgtttgtgctttaaaattaatatattccaactacacttcaataaaataaattttttttgtgtgacaaggtctggccctgtcacccaggctggagtgcagtggtgtaatctcggctcacagcaacctcagcctcttgggctcaagcaatcctcccaccttagccttctggctacaaaaaaaaactgaaacagctaatgacttcaatgctgggtgtggttttaggagctaaaatgttgatagtaggagccaggcatggtggtacccgtctctaattccacctacttgagaggtgaggtgggagaatcacttgagcccaggagttcaaggccagcatgggcaacatagtgagactccacctctttgaaaaggaattgatagtgaactataagtcagggcacaaaattgtaaataaaatgtaatcatagcagggttttaaaaaacggatttaagatgtacaccaagtgttaccagtgttaatgggccatctttgggtaacagaattatggatgattttttttttcttctactttttagtaatttccatcttttctatgaagatgtatttaaaattgcaacctgctgatactatatcagaattcaattctggattattattccattagtattaacctcctatttttaatatgacactgaactttcgctaaaagaccaggaagttaaaagtgttaaggaaacttaccaaaaaaaaagccattttaagtcacatatacataaacatttcaaaattgttatttttaattaaacatcttggaaagatactgcttatttgcaaatagtatggagtcagtgacaaagaaataaagacctcttgtttctgtatattttatctaattttgtaaatatcactatatgattttgtgagtgggaataatatagtgaaacatttggacagttgtgtatttacatttaccttcgaagttttagtttactgcttcatagtggtggtggaatacatgtcatgtacattttgaagccattctgcaggtttgtggaaccccttactcccaatgcttcgcctcaaatccttggcataggtacataggttttagaggtggggaaatgtgggtttgaaacccactcctctttgaagttgtattattaacaacaacatttatgtaatgtttactatgagccaggtcctctaagtacatggatattccttacctcttttaatcttcagaacagccctgtgaagtcggttcttacagagatacaagttcaaggaactcacctattacaataataaatgatgaaagttaggatttaaacttaggtctgggaaataccaaagctcatggtaaataccatcttatacaaacttcctggatgaccttgagcaaaacttagctgcctcagccctgcatctgtaatttagaaacccaaaaagctttagaaattgttagtctttccgtaacttatttggtgacaaacatgtgacctgaatagatgagaggctatttatattttgttcattccatttagtgtaaatattcatgtatgttgcattaaaaattatgtgttggattaggtgatgctgctataggcccctctctagaggtgttaaaaaatatatatgcaccataattcactttctaaaatacaaaaatttctgaaatctgaaatcccccaatagattgtggacctttgtttaacttccataatactcagttttcttatctatgtaattcttaaaatctatcccagtaaatcttaacaacaattgtatgtaataatatacataagcatttgagatacctgatatataattaagtattcaatttgttgggattgttactgtcattatcttggaattcttattcagctgtgcagagtttggatcctaaagctagaccatatagaaaatgtgaattggctgggcacagtggctcacacctgtaatcctaacattttgggaggccaaggcaggtggatcacttgagcccaggagtttgagaacagcctgggcaacatggcaaaaccccgtctctacaaaaaaaatgcaaacattagcagggcatggtggtactctctggtagtcccagctactccggaggctgaggcaaggggattgcatgagcttaggaagttgaggctgcagtaagccaagatagtgccactgtgctccagcctaagtgacagagggagaccctgtttcaaaaaagaaaaaagaaggccaggtgcagtggctcatgcctgtaatcccagcactttgggaggccgagactggcagatcacctgaggtcaggagttcaagagcagcctggccaacatggtgaaatcccatctctactaaaaatacaaaaattagctgggcgtggtagttggcgcctgtaatcccagctacttggggggctgaggcgggagaattgcttgaacccaggaggcggaggttgcagtgagacgagatcatggcactgcacttcagcctgggtgacagagtgagactccatctcaaaaaaaaaaaaaaaaaaaaaaaagaaaagaaaagaaaaaggaaaagaaaaaagaaaatgtgaattttgtttagtttgcaactgaggctgaacactgcattgttttcagtacaggataggaagccaggccttttacagaatgtagtttgttttccttactaatgactttaaaccatagtgattttcttctataaatatacattattccatagtgcagggattcctgtcctttttgtcagatcccggggtctgggtccagcccatgctgaagtccgaggggcgtgggtggatgagcagaaagaacacctggggggctgtaggcaggtgaaagatagttttattcagcagcagctcaaattaacagctttcttacactagctctcttatgaacagcttttcttacactgtccacctttatctcggcggtttgctccggctgtgtggctcccgcgacccccatgcctgcggcttcccagaaggctctcccctgccttcagggtcagcagcttaaccctttatctgggcatgtgcaagccgagctgtgtcctggctccctcctgtccagacggacagctttggctgtctctctttctctgggcaccagtgcctgcacaagagccatgttgagccaggctgcgccccaagagcgcctgtacaacggtagcagggcaattataccttttacagacaacagtggctcagagccaaggatgtacttacacaaacaggttatataacaagtgggggtgtgcgcctgcacgccaaactcgctgagtcatgcaggcctggatatccaccttggcctacctccatgtaccttttcatgtgattacacacttagaaaattatttactggccaggtgcggtggcttacaccctgtaatcccagcaccttgagaggctggggcaggaggattgctctaggccaggagtttaagaccagccttaggcaacatagcaagaccctgtctctacaaaaaaaaaaataaaataaaattagctgggcatgatagcgtgcaccttagtcatagtccagctaatcaggaggctgaggcaggagggtcctttgagcacaggagttgagcctggcggtaggtaagctttgatcacacctgagatgaatgaaggaggagggtgcttcattctgctgccagtattcgaggctcacctggctgcaagggctgagggaatcaatatcttggcatacctgtaatacatcttggcaaaccagtgtataattatatacaccaaatgtaaggggaagagacatgaaatgtgggaattattagtggatttactttgattaattcctctgcgtaagcatctattttgaagccgttaagaaaattcagataaaacatgtgaaacttaaaaatactaaatagttaagtctcttaattgcctgtcttctagcagtcaggcagttgagtcaggaatgagatggagtgaccgttttacttaacgctttataaaatgtatttgtcggttttttagattaagtatattttaccctgtaagtttgaattgtgaaaaaactatgacattgtcttgaaacctttaaaacatttctaagagtagatagaaccaataatgtaattaatttaggacatttattttttaaggggctgacatttattcctttctcaagtattacagtaaaaattaggtggggtaggataattttgccaattttttttaatgcgcagattcagagtttgttagaaattatttgcagcagagttgtgggcgagaggcataccaagttgtttcaggctggtctaaaggtagtgagttatctcagttgattgttcacagtcagtttcagttacagattgaatgccttgttctgctcttaccccgttctcactactcgactagcctaaaaaataataataataaaataaaaagaagttgtttcacattatgccttccctgccaagcctaaaacctcccgaccagattttttttaaaagaggacacagagttggttctcaactggatatttctagaacatatgctgagacgctgtccacagccataaatttattacagggaggtggggcaaacatgcaggaattgtaagtgcaaatataccccacttggctcaggaatttgggggccagggaagacatcctgcatcttactggtttcccttgaaggaatggtacccagtttgaaggattcaaaggagaatttcttctcctaagtctcttcctttcgcctcggtgatctgagcagggtttgctgactcggtgttgtccccagtggcctattatttgtgatcggtggggctcctctttacccttggaggaacacatctccaatgctttcttttcttttcataggcacttgtagtggggataggggtgggagggtggcacgggtggaaaccttacctgcttcttggtgcccactcagctctgcagagccttggagctgtctactcaagctggaatctctttgaaggggattttctagaggtagaatagtatttctgacagcctcacaaatatactcatcttttaatattttgccacctttaaaagttgttattcagaataatagatgattccatagcagcctgtagctcagaatattattatgtgttaatttggaaaaaaaatgtgactagtattcagcacttctttgaaccagggtatattacttattagctgtattgcttgatttttcacagactgttacatctccatttaaatcataaatctgaattatgctgtattactgtaaagcctaccagtgttccctagaatagcatggtaataatttttgtaagaaaaaacgagtagtaacaaaacattgttcacattatgggaacagaaagataataacaaaataaaattccaggataggctgggtgtggtggcttatgcctgtaatccctacactttgggaagccaaggcaggcggatcatttgaagtcaggagtttgagaccggcctagaaaacatggtgaaactccaactctactaaaaatacaaaaattagctgggcgtggtggtgggcgcctgtacttccagctactcaggaggctgaggcaagagaatcgcttgaatccaggaggcagagattgcagtgagctgagatggccccactgtactccagcctgggcaagagagcgagactctgtcttggcgggggaaaaaagaaaattccaggatatatgaagtcattatgactaaaaaccacgtattatgtgcatcatattcttaattttattttaataattaattagtcttcctcatcatcccacaagtatatcacagaaataaatacagtctcctctcagctctcattatttttaataatgatctccttggtactaaagaagttgaagattacaactcagaaatgcaaaatgttgggccaggcgcagtggcttacctctgtaatcccaggactttgagaggccgtggcagaataatcacttgagcccaggagtttgagaccagcctgggcaacatggcaaaacaccatctctacaaaaaatacaaaaagtagccaggcatggtggtgggcgcctgtagtcccagctactcaggagcctgaggtgggagaatcacctgagactgcaaggtcgaggctgctgtgagctgtgattgtgccactgcactccagcctgggtgacagagtgagacccatctcaaaaaaaaaaaaaaaaaaaaagtgaaatcttgatgtattagggtttagagaatagctgcaaaaagttattttctgtatctgctggaaaacagcatatctttgtaagtacagattgtaaggcagacagattgtaattatgtggatagagtagcgagtggtaacagagcttgacagaccagtgttcacgtgacagagtgtgcagccctcaagcgcaggtgcaggtggctaacagtacagggttaaggggccaaagtgcacagacaaggtgttggccagggcctctccacattttgcaaacttctcttcccttaaaaaggaaggaaaaaaaaaaagaagaaagaaaggaagaaacaaacaaacatttgatatttctcagaattcagaactcatttttttttgttttgttttgtttcagaatactgaagaatgggaaaaaagtaagactgaagcagacatggaagagtatatatgggaaaatagctcatcagaaagaaatatcctggaaacgcttctccagatgaaagctgctgagaaaaatatggaaataaataaagaagagctccttggtactaaagaaattgaagagtacaaaaagtctgttgttagtcttaaaaatgaggaggaaaatgaaaattccatttctcagtacaaagaatccgtgaagagactattaaatgtgacatgaattatggagtagaaaaatctgcttgatttattaattttatgatatatgtgatcagtatctaatttgatataaaattgaaaatgttaaaaaatcattttttttcctcagagttaaaattatttccctcatactaatgcttaatggcaatgattactccagagttttttaatttttacactggggcaatagactaggaggtctctgatttcttcttggtctaaagtgttttgattttatttctacataatagctttggtattcatgtatatacatgcatttaattgtgattttatcacctttcccatttctttccccacaagctggcatttcagtagttgcttttgaataatggttttggttacctgggaaggcaggcccagaacccatttccttgacttgcagttccgggctgtgttcacatgactgctgtctagctgatgcatttttcacatttgtcaactctggttagaaacaggtcctcaggagtattctctaacctgatattttctaaaaagatatgttgattcaactttgtttagcatcctactttctagattgtggggctcattttgccagggccaagctaccagaaaagtagaagtggagattacctggtatgtatctctctgggtgccccagttagagctgccacagctcaggaaaaagatgaggcataacgaccttgaatgtaattggagtaagtgacaaaataagaactaccctgggaaaccctgcattcaatgtagctgtcaattcagtatttttaagtacacctgtcagctgtttcttaccacttcgatggttgtgattaatttaaaatcaaaataaaggaattactgagttt

SEQ ID NO: 38252 - DNA, 79413 bp, Homo sapiens
gtggcgcgcgggtccggcgggcggttggcttgagcgggaccggagctgaggcaggaagagccggcgccatggtggagaaggaggaggctggcggcggcattagcgaggaggaggcggcacagtatgaccggcagatccgcctgtggggactggaggcccagaaacggtcagggccggcgcggcttgaggccgctagggtctggagggggcgtctattctgaggcgtttgcggcccggaaggagcgggaaggtgtgatttgaagggaggaggcgggaattctgtgctctgggatcgtctctctcttggggggactggaggagttgattggggatgtttctggaaggtctgggaagtggttgggagggccgttccgaaggatgggagctctgaagggggcgttggggagtcctgagagagcgggagaattcaaactcaggaaatccgaggcccgaaagcggtgattgtggggtttgatcgcggttaggggataagaggggctggggatacgtggaaagggtgaggtgagggacgcagttcattcattcgagggtatgggacctggttccgtgctgcacacaggggagactggactggccaaccggacagacgggagcttacactcttgtgggagctcacgggcgggccagtctgagagaatgcgggttttgaggagttttggagcaagttatctcaaatgggaatcttgagaggctcggagaggctggagggggacggccgtaggctcccgaaaaggttgcttgtgtttggtatggggctgtgtcttgataggacaggagacgtagtttgggcattgtggagtagcttagggaattctttttttttttttttttttttttgagatagtctctctctgtcgcccaggctggagggcagtggcgcgatctcggctcactgcaacctctgcctcccggattcaagcgattctcctaactcagcctcccgagtagctgggattataggggcccgccagcacgcccggctaatttttgtatttttagtagacacggggtttcgccatattgacgagactggtctcgatctccttacctcaagtgatccacccgcctcggcctcctgaagtgctgggattacaggagtgagccaccgcgccaggacgtcttttgttttgtgcagttgggtgacctcggttcactgcagcctctggcctcccgggttcaagacttcctctcacctcagtcttctgagtagctgggattacaggctcgcgccaccatgcctggctaatttttgtatttttagtagacatgggttttcaccatgttggccaggctggtctcaaactccggacctcaagtgatctgcccgccacagcctcccaaagtggttggattacagacgtgagccactgtgcccagcttgttttttttttttttctttctctgtggcccagtggagtgcagtggtgggatcacagctcactgtagcctcaacctccaaggctcaagggatattccctcttcagcctcccaagtagctgggactacaggcgtgccccaccacatcatccgactaatttttgtttttttttttttttgtaggatggggttttgccatgttgcccagactggtcttgaactcccaagctcaagcgatcctcggcctcaagagatctccccccatctcagactcctaaaatgctgggattacaggcatgagctaccatgcctggcctcattgatcaatatttttacttagcctggacgcagtgactcacacctgtaatcccagcactttgggaagctgagttggggggaggggacctcttgagcccaggagtttgagactagcctgggtaatgttgccaaacccagtctctacaaaaaaatacaaaaattagccaggcatggtgacataagtttatagtcccagcttgtcaggagactgaggtgggagcatcacctgagcccctgggaggtggaggttgcagtgagccatgatcacaccactacaccccagcctgggtgacagagtgaggccccgtctcaaaaaaaaaaaaaaaatccacaagcgtgtgtatatgtgtcagttattaaaggatggtgaagtgagagggttgttttgataggttggccagggaagggctctgaagaggtaacattgagcctcagacttatatgggaaagagccctgtggtcatctgggagaactttcctagctaagagaacagcaagtgcaaattcccagaggcccaggcatgattgtcaaattagagaaataaggtggcaggaaccaaatgatttgaggagtagcttttattctaagtgtgtgggaaaacctgttggagtgttttgagtgtgggagtaacatgatctgttttttgtttgttttttgagacggagtcttgctctgtggcccaggctggagtgcaatggcacgatctcggctcactgccattgcagtgaatccgcctcccaggttcaagcgattctcctgcctcaccttcctgagtagctgggactatcggcatgtgccacaacacccggctaatcttgagtatttttagtagagacggggtttcaccatgttagacaggatagtctcgatctcctgacctcgtgatccgcctgccttgggctcccaaagtgctgtgattacaggcgtgagccactgcggcctggcctggtttgtgttttaaaatgatcgctccagaataggttaaagtggtcagaaatggaagtaaagattctggctggactgttgcagtaatccagttgagataaaaatattggtggcttgaaactcaagagaaggggtcaaataaatatattctggatatattttgaaggtagaagagggaacagaatttggggcagaagtccaggatgacaccactgtttttggcttgagcacctacctggaacgatggaattgccattttgaaagatatggagagctgtaggtttggtggggtcggggaagagtcagttctcttttaggtttcagatttgttttttttgtttgttttttttttttttgagacggagtctcactctgtcgcccaggctggagtgcagtggcatggtctcggctcactgcaacctctgcctcccaggttcaagcaattctcctgcctcagcctcccgagtagctgggattacaggcgcccgccaccatgcccagctaatttttgtatttttagtagagacggagtttcaccgtgttggtcaggctggtgttgaacccctgacctcgtgatccacctgcctcggcctcccaaagtgctgggattacaggtgtgagccaccatgcccggcctcagatttgtttttttatacaactaagtagaaatatgtgaggggttgagttcagaggtaaaatttgggtgatggtgggtattgtgtgagtacagagtatagaattaatggaggggttggggaggcagacacgtcaggagaatttagtttgagggggtgggagctttcagaaggttttagagggtgcagtggtgggatgggaattacctcaggctcatttcagatctgtggggtcttctttgatggggtggggggatgtcatcatgaggcattaacattggtgggagggttgaaggcacctggaatagattgggaattaagtgatgagaatgtgcctctggacataggtggactgcattgattttagggactgctattttctggatggagtggaaagaggatttatgtgagttggaggaaactttgaggaagcttggtgtgttctgagatcctaaagggttggggaggggattctaaggtactggaagggttaatcgaaggggtttgcggcagcagatagctttgtttgaagtggggcaaagttggtgaggtttaaactggaatgtagttagggaactttcagagggatggggatgatttttctgagaagcagtgaagaatggatgggggcctctgagtgggagatgacctaagggacaagtcagggtcagggcatggaatttgtgggaggtaggaattattctgagggagtggagctgtaccaaatttggtggagaacatgaaaaggattggctgggggttgcaggagggagggaagaggttgtttgtaatttgtactctatttttagacagtcttagagagtttattaaagtgttttttgtccattttcagccgaggtttttagaaattaaaaatttttttgtgtgagtacatagtaggtgtatacattttgggggtatgtgagatactttgatacaggcatacaatgggtaataatcacatcagggtaaatggggtatccaccaccttaagcacttatcctttgtgttacaaacaatccaattatattcttttagttgctttgaaatgtacaacaaattattgttgactgtagtcaccctgttatgctatcaaatactgtatcttattcattgtatttaattatatttttgtatccattagtcatccctccttcccctccaccccccactacccttcctagcctctggtaaccctcagtctactatctgcatgagttcaattgttttaatttttttagttcccacaaataagtgacagcgtgcaaagttttctttctgtgcctgatttatttcacttaacataataacatccagtgccctccctgttgttgtaaatgacaggatctcattcccttttttttgtagacagggtctctctgtcgcgcagactagagtgcagtggtgtgatcacaactcacttcagccttgacttcttgggctcaggtgatcctcccacctcagcctcccggtagttgtgactatagcacgtgtcacaagcccagctaatattttagtacaggtggggtttcaccaggctagtctccaactcctgggctcaaataatcctcctgcctccctgcaaagtgctgggattagaggcgtgaacagcaatgcccagcctttgtaccacaatttctatttttttttttgaaacggagtctcgccgtgtcgcctaggctggagtaggctggagtgcagtggcgcagtcttggttcactgcaagctccgcctcccaggttcacgccattctcctgcctcagcctccctagtagctgggactacaggtgcccgccaccacgcccggctaatttctgtatttttagtagagacggggtttcaccttgttggccaggatggtctcaatctcctgacctcgtgtaccacaatttctttatccatttgtctgttgatagacatatgggttgctttcaaatcttggctattgtgaagagtgctgcaataaacatgggatttattgcagttttttttcttttgagaccgagcctcgctctgttgcccaggctagaggacagtggcacgatctcagcccagtacaatctccacctcccaggttcaagcgattctcctgcctaagcctcccaagtagctgagattacaggcacctgccaccacgcccggctaatctttgtattttttagtagagatggggttgctgtgttggccaggctggtctcaaactcctggcttcaggtgattggccctccttggccccccaaagtgttgcaattacaggcgtgagccaccacacccagcctgatttattttcatttgggtatatacctagcagtgggattgcatttttacccgagtcttttttttttttttttttgagacggagtttcgctcttgttacccagactggagtatggtggcgtgatctcagctcaccgcaacccttgcctcccaggttcaagcaattcttctggttcagcctcccaagtagctgggattacaggcgtgtgccaccatgcccggctaattttgtattttagtagagacgggattcctccatgttggtcaggctgtgaactcctgacctcaggtgatccgcccgccttggcctcccaaagtgctgggattacaggcatgagccacagcccccggccttcacctgagtcttatagcagctctctggagtcggaagggcagtgatttccttctctgttcagatgaggaaggaggctccacagagcaaattgacttgcctctaagagggctctaggtgggataggagggttctaggtgggataggagaactctggagactggagttcctttatgaaacagaagccctggaaatgggcaggctgataaaatgtacaaattgtggggcattttataagacagttatcctacttctcttccaaaagtcagtttcatgggaaaaataagtgaagggactgttgtggattaaaagagagtaaaggccgtcacagtgactcagcctgtaatcccaggactttgagaggccgaggtgggtggatcacctgaggtcaggagttcgagactagcctggccaacatggtgaccgtctctactaaaaatacaaaaaaaattagccaggtgtggtggtgggtgcttgtaatcccaactacttgggaggctgaggcaggagaattgtttgaatccaggaggcagaggttttagtgagccaaggtcacactatcgcactccagcctgggtgacaagagcgaaactctgtctcaaaaataaataaataaaataaaataaagtaaagaagcagcttcctagagcagatttggttgcttaaattgaggccaagtttctggagtttttattgatagttgacaattacaactaaaatttttttttctcgctctgttacccaggctggagtgcagtgacgcagtgacgtgatcttcagctcactgcaacctccacctcccgggttcaagggattctcccgcctcagcccccaagtagctgggaccacaggcgtatgccatatcactcagctaattttgtgtgtgcatggcgtatgccgtaacactcagctgattgtgtgtgtgtgtgtgtgtgtgtgttgttttttttttttttttgtgatggactctcactctgtcgcccaggctggagtgcagtggcacaatcttggctcactgcaacctccgcctcctgagttcaagcgattctcctgccttagcctctggagtagctcggattacaggcgcgtgccaccacacctggctgatttttatatttttagtagagacggggttttaccatgttggccaggctggtctcaaactcctcacttcaagtgatctgcccacctcggcctcccaaagtgctgggattacaggcgtgagccactacacccggcctatgtgtgtgtattttatttttttatttttttgagacggaatttctctcttgttgcccaggctggagtgcaatggcgtgatctagactcactgcaacctctgcctcccgggttcaggcaattctcctgcctcagcctcctaagtagctgggattacaggcgcctgctaccgcgcccagctaatgtttgtatttttagtagagaccaggtttcgccatgttggccagggtggtcttgaactcctgacctcaggtgatctacccgcctcagcctccttaagtgctgggattacaggcatgagccactgcgcctggccagaagttaccttctttgtgcctgttttctcagctgcaaaagaggggtaacaaagtgccagcccattagattgtcatgggaattaaatgacataatacatacaaagagcttagtagaacagtgcttggcacatagtaagtgttagataaatgttggccattattattttattatgtaccagatttctataattctgctgatggacacaggtttgttttggtgtgtctattaattcacagccatttgagtaacagtatgtcctaaatgccaaggaagttactggttctagtgatacagtggtttctggagtttacattctaatggaggagggggcagtaaacatataaacaagtagtgtagcttagcacagtggtgtgtggctgtgatcccagctactggggaggctgaggttggaggatcacttgagccaggcaattgagactagcttgggcaacttagtgaggccccatttcaatcaaaacagtgggcaacacagaccccatcttaatcaaaacaaaaacaagtagcataattcgagatagaagaggatgtggacctattttaaattaggtggccagtatggacttctctaaggaggtgacaattgagctgagacctaaagaatgtgtcccttaagaagttgagggaagaagcaatgggaagcactaatgccaaggtcctaaggtgggagcaaggatgggagcaaggatgatgttctctaggatcagcctcccgagtagctgggactacaggcacgtgccaccacgcctggctaatttttgtattttgagtagagatggagtttcaccatattggccaggctggtctcgaactcctgacctcaagtgatccgaccgcctcggctaattttgtgtatttttagtagagacggggtttcaccgtgttagccacgatggtctccatctcctgaactcatggtcctcccaccttggcctcccaaagtgctgggattacaggcgtgagtcgccgcgcctggcacacccagctaatttttttttgttttgtacagatggagtcttactttgttgcccaggctggtttcgaactcatgggctcaagtgatcctcatgccttgccctcctaaagtgctgggattacaggtgtgacccactgcgtccagcctgctgtagttttgtcggagagaaacgatggtggctcagactagagtggtgtttgtggaacttgagggaagtagatggacaatgctgctgtgaatgtgtatctttttttttttttttttttgagacagagtctcactcttgtcacccaggctggagtgcagtggcgcgatctcggctcactgcaagctacaccttccgggttcacaccattctcctgtctcagcctcccgagtagctgggactacaggcacccgccaccactcccggccaatttttttttttttttttttgtatttttagtagaaacggggttttaccatgttagccaggatgatctcaatctcctgacctcgtgatctgcccgccttggcctcccaaagtgttgggattataggcgtgaggcaccgtgccctgctgaatgtgtatcatttttgtgcccacttgggtatttctttttttttttttttttttgagacggagtctcgctctttcgtccaggctgaagtgcaatggtgcggtctcggctcactgcaacctccgcctcccgggttcaagcgattctcctgcctcagcttcccgagtagctgagattacaggcgcctgccaccactcccggctaattttttttttttttctttttgaaacagacccttgttctgttgcccaggatggaatgcagtggcgccatctcggctcactgcaaactccacctcccgggttcacgccattctcttgccttagcctcccgagtagctgggactacaggcgcccgccaccatgcccagctaattttttatatttttagtagagatagggtttcaccttgttagccaggatggtctcggtcttctgacctcgtgatctgcctgtctcggcctcccaaagtgctgggattacaggtgtgagccaccgtgcccagcccacgcccggctaatttttgtaattttagtagagatggggtttcaccatgttggccaggctggtctcgaactcctgacttcaggtgatctacccaccttggcctcccaaagtgatgggatttgtaaacccagcactttgagggaggcagaggcaggaagattgcttgagcccaggagctggagatgagcctgggcaacatagtgagaccctgtgtctacaaaaaaaaaaaaaaacccataaatcagccaggtgcagtggtgtgcacctatagtcccaggactcaataggccgaggtggcgggatcacttgaacctgggaggttgaggctgcagcgagccctgatcttgccactgcccttcaatctgggttcacagaatgagaccctgtttcaataaaacaaaacgtaaacatggtatttggtgttgatggcagttgagtatttaatttaatttaatttaattttttttgagacggagtctgtcacctgggatggagtgcagcggcacagtcttggctcattgaaacctctgcctctcaggttcaagcgattctcctgcctcagcctcccaaatagctaggattacaggtgcccgccaccaacatgcccagctaattttttttttttaaacagagtctcgctgtgtcacccagactggcatgatctccgcttactgcaacctccgcctcccaggtttgagtgattctcctgcctcactgtcccgagtaactgggactacaggcgcctgccaccacgcctggctaatttttgtattttctgtagagacacggttttgccatgttagccaggctggtctcgaacccctggactcaagtgatctgcccgccttggcctcccaaagtgctgggattacaggcgtgagcccccacgcctggccataattttttttgtatttttagtagagagggtgtttcaccatgttggacaggctggtctcgaactcctgacctcaggtgatccacccatctcagcctcccaaagtgctgggattacaggcatgagtcaccgggcccggctgaataatgaattttaaacaactgcagagcagtctgtagagctatgtaggaatgtaggtcgtggagagcagatttattgtcagggactttttatatgtagctgttgctggaagagttcggggagggggagtgcttgctggtattgactcagccatgataaaaaagcctttttttgaggaaatggcattggagttgggttttgaaggggaaaggcgtaggtaggcattgagaggaagaaatggtgcattttgcgagggtggaatgttgtgattaaattttatttaatttttaattaaattaatagcaaactcttaccagcagaacttaaattgtgtgaaaattattcttagttattactaaatccttttcagtatgaataatacatttgctgcagaattattaatgagtttggttacatgatgcagcccaagatcttgatgagttgtttcataatacatgatgtaaagtctgtatttcctttttgaaatctgaaaaaattgtgactctgaaatacttctggttcaagagatttcagataagatatagttgacctattctgcttcctactgacctcagagaagtcttgggatggcctgacctctgattgccttttttcagcctcatcttctgtcactttacagatttaaaaagctaaaaacaaggctgggcacggtggctcatgcctgtaatcccagcactttgggaggctgaggcaggtggatcacttgaggtcaggggttcgagaccagcctgaacaacatggtgaaactccgtctgtaccaaaaatacaaaaactagccaggcgtgacagtaggcgcctgtaatcccagctactcgggaggctgaggcaggagaattgcttggacctgggaggcggaggttgtagtgagctgagatcacgccactgcactccagcctgggcaacagagcgagactctgtctttaaaaaaaaaaaaaaaaaggtaaaagcaattcctgtgtacatgctcttttcatgccaccatgtgttttgcttgtgtgttatacttaactagtgcctcttctcagcacctcttctgctgtcatgctagtttgagccaccatcatcctccctcaccttaactgtgacatcttcctacccccatggctttccatcatgcctcgaagaaaatccagaatccttccattgcatgtaagagccttcatgatgtggccccttgttccaacttttcagcctctctgtcattcctgtccctagaacatgccaagcactcctgcttcagggcttttgcatttgctgttttctctatctggaatgttctgctgccaaatatctgtgtgtttgtcctttatttcattttgatttttgctcatatggcatctcctcagaaaggcttgtatgatttctgtctcaaatagcgttctccatcattcttgattcttgtcacacttgattttcatcactttttcacatattatgtatctatttgtttatctgtctcctactttttcatgagggcagggactatgtctgattcaccgccttatttccacaccatagaaggatgcctggcatagttggtactcaataaatatttgttgaatgaattgttttgtgcagtatggattagagcctgtctctttcctagattcgaggtgtgatgcctcaatgcagttagaaccaaaatgatttttttttttttgagacggagtctcactcttgttgcccaagttgaagtgcagtggcatgatctcggctcactgcaacctccgcctcatggtttcaagtgattctcctgcctcagcctcccaagtagctgagattacaggcgcctgccactacgcccagctagtttttgtattttagtagagacggggtttcaccgtgttggtcaggctggtctcgaactcctgacctcaagtgatccgcctatctcagcctcctaaagtgctgggattacaggcatgagccaccgtgcctggcaaaccaaaatgatttgtgtattttttgttcttctgtgattctgcaagctcactgttctgtatcatcaggttaacaatgtttgtcttacaggctgcgggcctctcgggtgcttcttgtcggcttgaaaggacttggggctgaaattgccaagaatctcatcttggcaggagtgaaaggactgaccatgctggatcacgaacaggtgcgctgttgtgagctcattcctcccctgctctggctcccctttccagcatgaagatctgcagattttgtgagttcctccttgtgccttaagggctgtgaaaggagggctaacattaataaaccattgcctctggagactgaaggtgctattgttgggtttgaattctagctccaccacatctagctggatgagcagtagagactcacaccccctcattgagcttgcctgcctgtaaaatggggttagtaatatctcccttggtggttgcttgtgaggaggtgtagagaagtgtttttccaatttgtgcctaaaaatgacctgagtgactaactgaaaatgcagagtggcctggaggcttcgtggtgccctagctttcacccctagtgattctcatttaggtctgaggcgagctcaggagtatgtgcatttaaaaggtgttttagggctggacgcagtggctcatgcctgtaatcccaacactttggaaggctgaggcaggcggatcatctgaggtcaggagtttgagactagcctggccaacatggcaaaactctgtctgtactcagtatacaaaaattagccaggcatgttggtgtgcacctgtaatcccagctactcgggaggctgaggcacaagaatcgcttgaatctgggaggtggagtttgcagtgagctgagatggcaccactgcactccagcctgggcaacagagtgagactttgccttaaaaagaaataaattaatgaaaggtgtttcaggagattatgatttagatggtccacagacatcactttaaaaaacactggatcaggccaggcacagtggctcatgcctgtaatcccagcactttgggaggctgaggcgggcagatcatgaggtcaggagatcgagaccatcctggctagcacggtgaaaccccatcactactaaagacacaaaaaattagcagggcttggtggcgggcgcctgtggtcccagctactcgggaggctgaggcaagagaatggcgtgaacctgggaggcggagcttgcaacgagccgagatcatgccactgcactccagccttggcaacagagtgagactccgtttcaacaacaacaacaacaaaaacaaacaaaaacaaacaacactggatcagagagaatgtgggcagactgctttgtatagtgcttgaacctaacaagtatccagtaattaggaataatgatctgacatgctgtttgtttgtttgtgtgtttttgcgagacgagtcttgctgtgatgcccagactggagtgcaatggcgcaatctccgcacactgcaacctccgcttcccgggctcaagtgattctcctgcctcagcctctgaagtagctgggattacaggcacgcaccaccacgcctggctaagttttgttttgttttttttttgagacggagtttagctcttgttgcccaggctggagtgcaatggcgtgatcttggctcactgcaacctctgcctcccaggttcaagcaattctcctgcctcaatctcccgagtagctgggattacaggcatgcaacaccatgcctggctaatttaacgtttttagtagagaccgggtttctccatgttggtcaagctggtcttgaactccgacctcaggtgatcctcccacctcggcctcccaaagtgctgggattgcaggcgtgagccaccgcacccggccatgcctggctaagttttgttatttttagtagagatggggtttcaccatattggccaggttggtctcgaactcctgacctcaggtgatccgctggcctcggcctcccaaagtgcggtgattacaggtgtgagctaccatcccctgctgacataatgctgtttgattaatattataatggtagagcccaactccaatgtagctttctctgaccaggctcatcttcaaggtgaaaataagtgctgctctctctacattcccatgcctcagtgacattttatttattttatttatttattttgagacaaagacttactctgtcgcccaggctggagtacagtgacacaacctcagctcactgcaacctctgcctcccgggttcaagcacttctcctgcctcagcttccctagtagctgggattacataattacttcatctggttgtaagaatccaacattggaggccaatcacagaacagtgcgattctgacaccacaggtgtgaggccactgcacccatcttagagcgtattatgtagtttacattcaacaagcatctgagagcacctactgggtgccctgaagtctgctaggtgctggtgatagaaagatgctcacggtttggttcccattctcaaggtttttttttttttttttttccggaaaccatagcaggctccctgactgaggttgtggtacatgaaagatttcctggagtcctgatctgagctaagtcttaaagaacaaggagggttgtcaagataagagcctgtgttttaggcaggggacatagcagtgtcacaaaggcaccctacagtgtggtagaaatggaagctaaaagtagtttggtgtttttagagtgtgagacccaaagtggtgggtagggacaggttgctggtgaagtccaagtcaggaggggctcctaggaagccccactgtaagcttttacttaatcctctgggtggtgcagactcactgaagagtttcaaatgacaggaagggtgacatggttagctttgggctttatgtgtagatcagtaattactgtataaactatggttggcacaaaatacagggcagaagaccacttagaaggcagtttttagtagtttaggtgagaggtgaaagtggccttgctgatagggatggcaggaagcacacagatgtgagaaatagatttaggtggtagaattgggaggtctgtgtatgggagcttaaggaaagccaggaataaccagagcagctgacactgaaggggctaggcactgttctcagagctgcagttgtattatctcattgagtcctcacaacacatctgagatcaaggacccattaccatccctgttttacagatgggaaaactgagtaaaaggaagaaaagtactggcccatccaaggccccagtagttagtggtacggccgggacccaggcatctgactccagagcccatgttctcagccacctcactatggaccactctcatggaaatagcaaggatatgaagatgaggcttctggcttgagtgactgggtgggtggctggtggactccggagacagcacacagaagcaggcagacatgtagggtttatggatatctgagagaaaacggctggtgggcagtacagtagagaagactcaggtggatcaggaagaaatctgcaccagaaagagtgatttgaaaaataacagcagattttggtagaaactgaaagaggcattgagttggtttatggagctatacagagtggaaagataagtaattctgagatggaagcttggggacagccacacctaagagggcccaaattgagactagaatgtgtagcacgagaggagagcaaagcaaggaaggtgtgatctgtggactgatagtgatgaaatgataattgtatgtgtatgggttttttttttttttttttttttttttttgaggcagtctcactgttacccttgccggaatgcagtgggcatgatcatggctcactgtagccttaacttcctgggctcagggtattctcccacttaagcctcccagtagttgggactacaggtgcacgccaccacacctggctaattttttgtattttttgtagagactgggtttcatgattgttgctcaggctggtcttgaactttctgggctcaattatatgttttttttgtttgtttttttgagatggagtctcacttgtcgcccaggccggagtgcagtggtgagatcttggctcactgcaacctccgcctcctgggttcaagtgattctcctgtctcagcctcccaagtagctaggattacaggcgtgtgccaccacacccggctaatttttgtatttttagtagagatggggtttcaccatgttggctaggctggtctcgaacttctgacctcaagtgatccacccacctcagcctcccaagctgctgggtttacaggtgtgagccaccgtgcccagcctcaactgtatttttttttttttttgagacagagtctcgctctgttgcccaggctggagtgcagtggcgcgatcttggctcactgcaagctctgcctcccgggttcacaccattctcctgcctcagcctccctagtagctgggactacaggcgcccaccaccacgcctggctaatttttttgtattttttagtagagatggggtttcaccgtattagccaggatggtctcgatctcctgacctcgtgatctgcctgccttggcctcccaaagtgctgggattacaggcgtgagccaccacgcgtggccctcaactgtacgtttttatccatgtcctcgttttatatgggattcccacattcttgctgaggttcacacagttgttgagccaggatttgaatcaaagattgaatccagcctgaattatttcagagccttactgttaaccattgtgtggtacagcttctcagcacataatgagatccctgaagaagcaggatggaatgggtcaaggatacagggttagcctagaatgggaagtgggccagctcattttcttggaggagaaggtagtaagatagagagtgtgctgtggatggttggtaggaggtgttgaggggagattacttctgttgtacctagtcttggtgaaggtggcaaggttatttgcagagattaatggttaaattagatgtttgatgtgtgaagaaatactttgagagcagtatggaatctgtaatcttactggtggctattaggggattatattatcctgtctttgaggctctgctctgctgatgttcagccttaggggtgaaataattcctctgttccagtccccactcatctctccacctctctgagttctttttttttttttttgagacagagtctcactctgttgcccaggctggagtgcagtggcacgacctgggctcaatgcagcgtctgcctcccaggttcaagcgattctcctgcctcagcctcccgagtagctggaattacaggcgtgtgccaccacgtccggctaattttgtatttttagtagagatggggtttcaccatgttggtcaggctggttttgaactctggacctcaggtgatctgcctgcctcggcctcccaaagtgctgggattacaagcgtgagccaccgcacctggccatagtctatctatgttttttaaaagttcatttcaagcattcttaattgtgtctgatttttgcacaagtttgattttttttttaagttttctcatgaggttgcaatttttgttgttttttgagagagggcctctctgtgttgtccaggctagtcttgagctcctggcctcaagcagtgatcctcctgctttggcgtcccaaattgctgggattacagatgtgagctactgtgccaggctgcactggtctactttttttttttttttttttttttttgagacggagtcttgctctgttgcccaggctggagtacagtggtgcaatcgcagctcactgcaacctccgcctcccctgttgaagtgattctcctgcctcagcctcctgggtagctgggattacaggcacacaccaccacacctggcttatttttgtatttttagtagagatggcatttcaccatgttggccaggttggtctcaaactcctgacctcaggtgatcctcctgcctcggcctcccaaagtgctgggattacaggtgtgagccaccgtgccctgcccacactggtctagttttaaaccactggaagacagagatttaatcctttaaactacttgtgtatttccccaaatgcttatagttgggcacatgctaagtatttagtcaattcttgccactgttaatcagtcatttgttagcagttacaaatttgcatagaagaagaaagcatggatttttttgttgacagtgaattttctttataaacacaagggggtgctctttaaccatcaatgaccagtttaaaaaaagtttaaagtcattttaaagccttagaaggaagcctgcataaggcaaattgctacaggaacagtaatacattttagggctgtgcacagtgtttcatgcctgtaatctcagcactttgggaggctgaggcaggcggatcacgaggtcaagagattgagaccatcctggcaaacgtggtgaaaccctgtctctactaaaaatacaaaaattagctgttgtggtggtgcgtgcttgtagtcccagctacttgggaggctgaggcaggaggagaatcatttgaacccaggaggcggaggttgcaatgagccgagatcatgccactgcactccagcctggtgacagagcaagactgtctcaaaaaaaaaaaaaaaaaaaaatttaggtggtaggtattttagctatcctttaaaatttaaagattctttttaagatttattttccctaaaaatacaagacttaaaaaaatatgtgtattattcctaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtaagtttcttattataaaatctgctgtgggaattaaacaaattaaggtgctagttgtatatactttcaaatcccaaagcaatctgagagcattcaaatatcaaattctgagctttttcccaagaaaatgtataagctgttctattgtttaggcttagtatattgtgtgaatgtgttgctagagaggtccagtctgttgcatctgctgtagttgttggtgacttgctgtctgctggcttcttctctgggcatatgttccctcagccaggtttcgtctttggtgttttgtcttccttccagaatctttgcacataactttaatccatgttattgcaaatgttttcttccgaaaacttaacaagttggtgattaatttctgtggcagcggcatttttttgttagaaatatcaaactacagcttgtgttttgtcttaagaaaagcacacctgatcttgatctatgtctgtctgtctgtttctcacagtcacattgaccatgttgccatggataactagagaaaaatcactgtagtcgtaagtcaaatgaggcatatccagcctcatttagtttcactgccaaatctatgcggaggtgaaaggataaattctttgtcaatatctgcaacctttcagacatagttccctgcattctggaaaagcttaacaaatcttgataaatgtgaaatagtcatagatgagctactagttttttaaatgaaaggccccagtatgttacatgagaggttagaatttgggttgggtagttttttttttttgcacctttttttatttgagatggagttttgctcttgtcgcccaggctggagtgcaattgtgcgatcttggctcatggcaacctctgcctcctgggttcaagtgattctcctgcctcagcctcccaagtagctaggattacaggcactcaccaccatgctgggctaattttttgtatttttagtagagatggggtttcaccatgttggtcaggctggtcttgaacccctgacctcaggtaatccacctgcctcggcctcccaaagtggtgggattacaggtgtgagccactgcacctggcctgttttttacacttttctttctttctttctttcttttttgagatggagtctcactctgtcgcccaggctggagtgcagtggcatgatcttggctcactgcaacctccgcctccctggtttaagcagttttctgcctcagcctcccgtttttacacttttctatttcatatgtgcatctgttcaaatatgggcttggaaggatggatcatctgtgcatttgtcctgttttctttttcctagtcccttctattttttaacttgaggtattgggacactttccatttggacataagtcttcattttcttatctgtagtaaccacatttattttatgccaggtgtcccttgaacttgtagagttagagggtttgttaaaactgaagtgtgaggccagttgattgtgtaatgcgtgtgcatggggccatgttgaccgccttgcaggccgtgtttggctggtccttgcaggttttatagttactttagactctgcagggttccatttgatcaattggttgcatgttcacctgtggatttcttactttttagatgggatttttccttgggtggctgcattctttgaaacaccaaaggaacacatttctctgtgagtgttatttcggtattcaggctgctagacaacagcaaagagggtctatcaagtgaaaatgtccttttgttcaggagaaagcatgtgcaatttggaagttgtcttttgaccatgatcacaaagcttctcccgaaaagatggtattttgtgcagtagaacttagccatttccaatacctcaacttactggaatacaacctggaggccccagagcaacactgataattccactgagtggatcaccagttcattgtctaagcctgaatggaaggtcacttggtctgtaaccttttcttttgtccttaaattcagataaagtttcacaccgcaatctgtggaaaaatgatctcaacaggacttgtttatcttctttatcttaacatatcaatcaaaaggaggggggtaaaaagcccttgtatttaaacatgacctttgggtcaatttaaaaaactggttttgcttgtccctgtagcttatttggattttaatagatttagcagtatagaaacaacttgctaagttattttttttatgagaactatgaaatgtgtatatgttcgtggattacagaaaacatttgttgaatggcttttactttttagctaaacacattttattttggctgcagaacgtgacggtctcataacttatattttctacacattgaaacctgcaacttttcttttgtcttctagccatagggcccaaagaacctgttgtaccagtttgaaacatgctttgagcatgcccagagagactgttcattaagatttatttagacatcagggcagtgattcacagtttgcaaaactcaaacccagccaatttctttctttctgcaggtgtgtctgacttgctgctccagggatgtcatagttaaagttgaccagatctgtcacaaaaatagcatcaagttctttacaggagatgtttttggctaccatggatacacatttgccaatctaggagagcatgagtttgtagagtaagtgttgggagaggaggggagaacataacattttctcctttttatactttttttttttaaattatgtatttatttatgtgtagagacaggatctatgctatgttgttcaagctggtcttgaactcctgggctcaagtgatcctcccaccttggcctcccaaagtgctgggattataggcatgatccactgcgcctggtctgctgacatgttttcaagttgagagatagtaaaatgattacaaaatagttgggcgattctggaggcatattcaaccaaagtctaccttggaaaaggtgtccaatatccagagagactcctctggtagaacaaacagacctcatcctctcattttgaacactgaggctgcagaacttggtaattcttacatgacaggacttgccgtgttttgactttgtagtctctaggtgaaagatggcagatgatacattattgtaaaactatatgagttaggtattttggctgcagtttctgaccaccccctccaaaaccctccaacttgctaattgagagggaaagacaggctctgtgagataggagcttcctaccaagagactgagaactcttctcttgttcagcctctcaggcaagtcactgaaatttctctggtctccaagtttcttgcctgtaaaatcaagatgggggaaggacagtcatgttccagacatctcctaactctagtgttttatggctttaggataatctagttctttgggcatattattattattattattttattttttgagacggagttttgctgttgttgcccaggctggagtgcaatggcaccatctcagttcagaacaatctctgcctcctgggttcaagccattctcctgcctcagcctccggagtagctgagattacaggcatgcgtcaccatgcctggctaattttgtatttttagtagagacagggtttttccatgttggtcaggctggtcttgaactccggacctcaggtgatccacccacctcggcctcccaaagtgctgggattacacaggcgtgagccaccgcacccggctattattattatttttgagacggagttttgcttttgtcacccaggctggagtgccatggcacgatcttggctcactgcaacctccacctcctggattcaagtggttctcctgcttcagcttcctgagtagctgggactgcaggcacccgccaccatgcccggcaaatttttgtatttttagcagagacggggtttcactatgttggctatgctggtcttgaactcctgacctcaggtggtccacccacctcagcttcacaaagtactaggattacagccaccatgcctggcttctttgggtatattataaagaagttatagtagtgggaagcaatccagattattttaacataagctgcccacagcagaggggcagaattaagtttggcttttttttttttttttttttttttttttttctgagacagactttcactcagttgcccaggctggagtacagtggcgtgatctcagctcattgcaacctcctcctcctggggtcaaccaattctcctgcctcagcctcccaagtagctgggattacaggcgcccaccaccacgcccggctagttttttgtatttttagtagagacggggttttgctatgttggccaggatggtctcaaacccttgacctcaggtgacacgcccgccttggcctcccacagtgctgggattacaggcgtgagccactgcacccagccaagtttggctatttatttcatgattcaagtagagtgtttacaaagtaatcactttgatttattgagagcagctgtgtgcccagcagtgtgctgagcaacttacgctgctctgtttttcccacaataatttcctgagtgcccaacagtgtaccagactcatcatgttatcaatggcagagctcgatttgaaccgagatctgactccaaagcttttgcccttaaccaccatcccgatctgtgacctggagaggctttttttgattccaataacatgattcctagggtaaaattacattctctccccttgtcaccctctagggagaaaactaaagttgccaaagttagccaaggagtagaagatgggcccgacaccaagagagcaaaacttgattcttctgagacaacgatggtcaaaaaggtatgtgtaacgtgggggcagaggtcagaaaccctggggccttggaggggtcaggcaatgacgattgaaaaggataagagcaagcacttcttgaaggggtggggcgggtgcttgtcccatctaaagggaggctgccacagcttagtgtcagccagctgttgctgtgagggaatgtgggcccagtgattccagatgggatttttcaagacaatgagaaatgcaaacttttgtaggctctgtcccaaacttttttttttgtgtgtgtgagatggaattttttcttgtcgctcaggctggagtgcaatggcatgatctcggctcactacagcctccacctcctgggttcaagcaattctcctgcctcatcctcccaagtagcacccctggctaatttttttttgtatttttagtagagacggggtttcaccatgttggccaggctggtctcgaactcctgacctcaggtgatccacccgcctcagcctcccaaagtgctgggattacaggcgtgagccaccatgcccggccccataccctttttttttttttttttgagatggagtcttgctgtgtccaggctggagtggcacaatctcagctcactgcaacctccacgtcccaggttcaagagattttcctgcctcagcctcccaagtagctgggactacaggtgtgtgccaccacacccagctaatttttgtatttttagtagagacggggttccaccatgttggccaggatggtatttatctcttgacctcgtggtccacctgcctcagccccacaaagtgctgggattacaggcatgagccaccatgcccgaccagaaaacttttttttttaaagcagcaaaacaccagccctgggttacagtagcaagaccccgtgtctacaaaaaaaatgtaaaaatttgtctggcgtgatggtgagcacctgtaggcccagctactcataggctgagctgggaggattgtttgagcctgggaggtggaggctgcagtgagccatggtcacaccactgcaccccaacctgggccacctagcaagatcctgtctaaaaaaaaaaaaagcaaaacaaaaaattttttgtattttctctactaacaatacaaaaattagctgggcaaggtggtgcgttgcttgtagtcccagctacttgggaggctgaggcaggagaatagcttgaactggggaggcggatgttgcagtgagccgagacggcaacactgcactccagcctggcgacagaacgagactctgtctccaaaaaaaaaagttttctttgcctgtttttttccttttgccaaataacctttaataagaaaaatccttcaatgttgtcttgctgtgtccaggctggagtggcacaatctcagctcactgcaacctccacgtcccaggttcaagagattttcctgcctcagcctcccaagtagctgggactacaggtgtgtgccaccacacccagctaatttttgtatttttagtagagatggggttccaccatgttggccaggatggtatgaatcctcagattcatatttgttaatgtagtttatattaggggctcagcctctatttggattaggtgcaataattacatttatagaaaggagtggagaagggatcagaagacgatggtttctgtagctagtgctggaatctgagatgggaaccatgcgatggggaaagcaagatgaaggggccagaattggtttcattgaactgagaggaaagacatgaccaagcccatatttactctttgctttgtagatttaaatgttgagaaagaaaaacagctggtcagaatgttgagttaaattacgctaacgaggggattctaaagagtgcagaaaccacaaaagagactgcagaaaaccacaaaagtggaactctcagactctccagcaaggcggcgttggagattttctttctcattttgtgtttgtgttggagtagtttggtgctgtaagtgtgatacagaggaattaagccctaattttagtgtctattcacagaaccataattatccagagtgaaccttggtgttttggccaaaacttgggtgcctttctttctttttgaggcccagtcaagatttatctgaatagctccgtgaatttggtggggggagataaattgttaacaaacggaggagtacaaaagctgctttgtgggtgctgtcagtttataaatcacaccctcttacaagtgtgacacttggccttggtgtgaagggttttatggcttaagggccttctctgattgaggcaggtctttcacattcaaatggagagagtgcctagctttgttagccattcacagctggaagtttccctggagtcagttctgatggtgcccactggggtggatctggaaacctcttttgggaaccactttatctcgctatgaggagaatgtgggcagcccaggcctttgcccaccattccggagggccctacaggcacagaggtttttgtgcagcctcttcctacgtggagctgagctggaaggtatcaaaatattccccagctgacattgttagtcagctgttacacttgaacaatgcaggctcggattccaaccccaagcccttaaggttacgaggcattcagtgcattcctgctgacaatccctgggattccaaaccttgcctttgtgcagcctcaccaagggccctgcggaccgactgggctggactgggttttggccatggctttgtcaccttgcaataacatgcctccttccgttttggcacagatggccctgtgatttcaaggttctcttccaacaccaaagattccttgattcagatgctgcccttttgcctaattgtacagaataactagttgggttgtgctcagagagtgcagggtgggggtggggaagcagctacttcctgtttcctgtgaaaggttttctggttagggttcccttcccctccccgctttccctaggtttaaccaaaggttgtaaagccacttttgcttcaaggtacactttgtgctcctaaattagtaacgttgaaaaacaaaaaggaaaaacagcctgtggttttcacaccctctaggaagctggtgggcctttctagcacctgtgccattctgataaataagggcttaggaaaatgcctagcccagaaataggtgctcagtagtttgtttgcttcctttggtgctcaggagaagatttgagacggatttcgtcacaatcaggtctcgggcacaagcctcacatggacactgacatgcaggagccagaggagacagcaatgaggtggtggtaaggaagtgcccaaaaaggtttcccagaggaagagttgtttgtgttggcatgtgagggacaagctttccaggcaccagagccaagagcagtgctctgtccgaggaagtaggataaaccgaaagacggacgtaggggcagagttgctgtggctgccctcactgccgcagccagctccttccatgagttgcagaatgcctactgtgtgcaaggcactgtgttgagtgcagggaatcacatccagtcttgttgtccccatctatagctgataaagaagctatgagaaattaagtgacctgaccaaggccacacagctgtggaagaaggggcgagagcatagacagtgggtaagggcataggctcaccctatgatttacaaagagggatacccctgaagttgctagggtaacgtgacatattaggaggatggtgggataaaatatgtgaacatcgggatcattctggaaaacctttaggataaaaggccactgtcatgctcccatgttcacgtttctttattgtgagttatctgtgttaggtgctgccagagatgatgagatgcctgacagtggttactctgtaatagctctttaaaaattaaagacaaagtagggtttgttcctgactgtactagaaatacagatttaattttacctctgctcctgaaataggtgactaatttggagtactattaatactcttttcatgaattagttgagaaattccacagttgaggagtgattcattcttttgactccctctttctgagcaatttgttgacagccttctcatcctctcttacacccgtcattaaagaaacagtcgagttctttttctttcatgtggtaccttggtttccactgctggtggcccttaggttgcttgtctctgtctccccgcttccattttaagctccatagggggaaggtagtcttgttcactgctagactcctagtccagtgtgtagcacagtcatatccacggaatatttgttcagtgtactggtggctgttaactgcagcataatccagcaaccctggagattattttcttcctttttttttttttttctttgaagcagggtctgactactctgtcacctaggctgaagtgcagtggttcaaacactgctcactgcagcctcccaagtagctggaattacagacatccactacacctggctaatttttaatttttaaaaattattattatttctgagatggagtcttgctgtgtcacccaggctggagtgcagtggcacaatctcagctcactgcagcctctgcctcctgggttcaagcaattctcctgcctcagcttccggagtagctggaactgccagtgtgtgccaccacactcgactggtttttgtatttttagtagagacggtatttctccatattggccaggctggtctcgaactcctggcctcaagtgatccgcccactttggcctcccaaagtactgggattataggcgtgagccacagcttccagcctgattgtttccattttaaaaaagagtaattgaagtaacctttgttaccaatgaaatgaattaaccttctagtatattaattctcacggtttaggttatttgaactaagctgagagaacagaataccaaagaagacaatagacttgcccagaaatatttagaagtaagtcactcagttgcctggattggaaccctcaggccagagaggttcaaaatcctgcatttttttttttttttttttttttttgagacagagtctcactctatcacccaagctggagtgcaatggtgcgatctcggctcactgcaacctccgcctcccgggtttaagcgattctcctgcgttagccttccgagtagctggaactacaggtgcgcgccaccacgcccagctaattttttttttttttttttttttttgagatggactctcgctctgtcgcccaggctggagtgcagtggtgcgatctcagctcactgcaagctccacctcctgggttcatgccgttctcctgcctcagcctcccgagtagctgggactacagatgcccgccgccatgcccgactaatttttttgtatttctagtagagatggggtttcaccgtgttagccaggatggtctcgatctcctgacctcgtgatccgcccacctcggcctcccaaagtgctgggattacaggcgtgagccaccgtgcccagcctaatttttgtatttttagtagaaacggggtttcaccatgttgaccaggatggtctcaatctcctgaccttgtgatccacccgcctcagcctcccaaagtgctgggattacaggcgtgagccaccactcctggccaatcctgctaattattaatatcagaactacttggttcaaaggagtggaaatagggcaacgaggggtgtaaatttgcagttaggtggaatgctgatagcaagttttccaggtaggagagttagttggggtgggggatgctaatgttagcttatctctgtatatatatttaattttatatgttatttatttttgagatgggatgtaactctgtagcccaggctggagtgcagtggcacaaacacagctcactgcagccttgaactcctgggctaaagggatcctcccacccacctcagtctccaaggtagctgggaccacaggcatgtgccaccatgctctgctaattttttcgggtttttttttttttttgagatctcttgctgtgttgcccaggctgatctcaaactcctggcctcaagtgatcctcttgccttggcctctcaaagtgctgagattataggcatgagccaccgtacccagcctatattttttttattgtgacatttaatgcacaaaagaagatatgcagcatcaatgcagataatggaacaaaacaaacactatccgccttaaaaacacaaatatttttggtacttttgtaccaatctgtatgctgtttctctatcttctacttcttctccctgtaccctcaccaggtaagtaaccccagagctgctggtacatttgtgtggattaaaaaagacacctggaaggggcagatacagccctgcttgacttcctgttttatcacgtgtttataaatctaaacaatgacatggaacttattatacaatattttaggcataaattaagaatgatttcgctcaccatcatagacctaccactcaatttgaagcatcaaacattactggtatggtgaggccctctggctgtccctccaacagaagttaccaccctcctcagttgggtttctcattcctatgcatttcttcttactacttatgtatgtatttccaagcaacacatagaattgctttgcatgctttttatcttcttaaaaattggttttatattgtatgcatggtgccacctgcttttaaggagaagcaacacgtttgtgaggccatctgtttatatgttgttctagggctttgctgtccattttggtagccactagccacagctggctgtttaaattaattaaaatcaaatcaaatcaaatatttagttcctcagtctcactggtcacatttcaagtggccagtaagcacatgtggccattggcatctgtattgcatagcacagattacattctgttccatcatcacagctagttctcttggacagccctgcagggcatttctttttggtttttgttttgtttttatttttgttttttgctagagtctttgttgtgtaaatacattactattttatatccatttttctatttataagcatttgggtatgctcataatttgctgttacaaattgtgctgcataagcattttgtttgtgtgtgtatagatgatctccttgggcaattgtgttaatttctcttgggtatatacctgggagtaaaattaagataagggcattttcagctttaccagaccccgttaagttactctcaagtggttttatcaatttatattctagaaccaacattatgtatcagtaacatttggtaacttcaggcgttttttttccattctgctgagtgtgaaaaatgtgttttgattatggttgtcatttgttagaatactttgttaaagctttttaaagattcttggtccctctaccctccccaccccctaccccaggaattttgattgggtaggacctggggattatattcatctttatatgcagaattatattacttgttactgttaggcctgatttaagaagtaaaataaggctgggtgcagtggctcatgcctgtaatcccagcactttgggaagccaaagtgggcacatcacttgagcccaggagtttgagaccagcctgggcaatgtggctaaaaccccttctctaccaaaaatacaaaaattagctgggcgtggtagcacgtgccagtggtctcagctactggggaagctgaggcgggaggattgcctgagcctggcaagtgtaggcagcagtgagctgagattgtgccactgtagtacatcctgggtgacagagcaacacactgtctcaaaaaaaaatttttttttaagtaaaataagttcataattccaaatgtggaaaatgcagaacaagttaatgaaatgttaatcctactaccaaatgataactataaccttcctttcagtatttttctatgtatatacaacaaaattggggcactgtttaatacagataatatatatagttagctctccttattaatgggcttcacattcatggattcaaccaactgtggatcaaaaatctttagtgtgcttggagtacatccaaaaaaaaaaaaagaaaattgaaattatgttaataataaaatatttgggaaaaaacattgcgtctatctgtaccaaacatgtacagactttttttcttgtcattattccctaagcaatacaatataacaactgtttacatagcaattccattaggtattataagtaatctagagatgatttaaagtatatgggaggccaggcgcagtgcctcacgcctgaaatcccagcactttgggaggccaaggcgggtggatcacttgaggtcaggagttggagaccagcctggccaacatggtgaaaccccatctctaacagaaatacaaaattagctgggcatggtggctcacacctgtaatcccagctactcaggaggctgaggcaggagaatcacttgaacttgggaggcagaggttgcagtgagccaagatcgcaccgttgcactccagcctgggcgacagagcaagactctatctcaaaaataaataaataaataaagtatatgggaggatgcacgtagagtatatgcaagtactgtgccatttatttatttagagacagagtcttgctttattgcccaggctggagcgcagtggcgtgatctccgtctcccaggttcaagtgatcctctggcctcagcctcccgagtagctgggattacaggcttgtgctaccacacccggctaagttttgtattttaagtagagggcgttttcaccttgttcgccaggctggtctcgaactcctgacctcaggtgatccgcccacatcggcctcccaaagttttgggattacaggcgtgagccattgcacctggcttgtatatgtgtatatatatgtacatggttttgtcttttgcttttttcactcaataagcattccccaaatctgctttggagcacatgattttattttatttttatttttttatttttttgagacgaagtctcgatctgtcgcccaggctggagtgcagtggcgcaatctcggctcactgcaagctctgcctcctgggttcacgccattctcctgcctcagcctcccgagtagctgggactacagacacccgccaccacacccggctaattttttgtatttttagtagagacgggtttcaccgtgttagctaggatggtctccatctgctgacctcgtgatccgcccgccttggcctcccaaagtgctgggattacaggcatgagccaccacgtctggcctggagcgcgtgattttaaatgtctgtgtcatttttcctcttcttgcctagccataatctattttaccagtcacctattgtattgaggttattgaggttattgcagtttcctactatgctaaatggctcctgacaacaaatttgatggttgatgggctatgtggagaattcacctttttttttttttttttttttttttttgagacagagtctttctctgtcacccaggcgggagtgcagtggcatgatctcagctcactgcaacctctgcctcccaggttcaagcgattctcctgcctcagcctcctgagtagatggaactacaggcacctgccaccacgcccagctaattttatttttgtatttttagtagagagggggtttcaccgtgttagccaggatggtctcgatctcctgacctcgtgatccgcctgcctcagcctcccaaagtgctgggattacaggcgtgagccacagtgcccggctaatttttgtatttttagtagagacggagtttcaccatattggccaggctggtctcgaactccagaccttgtgatccactcaccttggcctcccaaagtgctgggattacaggcatgagccaagtctttttttttttttttttttttttttgagacggagtcttgctctcttgcccaggctggagtacagtggtttgattgtgatctcggctcactgcaacctcagcctcctgggttcaagcgattctcctgtctcagcctcccaagtagctgggattacaggcacatgccaccatgtccggctaatttttatatttttagtggagacggggtttcaccatgttggccaggctggtctcgaactcctgacctcaggtggtctacccaccttggcctcccaaagtgctgggattataggtgtgagccaccgcacccggccttgttattagtcttaactagattgttgattgaagtccttaagcccagaaatgtatgtgaaggatggtggagaagagtggctcaggcattctaggcagaggtattcttgagctgaggaagtggaggagaggaggtatgtaagttacctgttttcaggggttcattccagtggatagtggatgccactccctggcagacactgtgggtgcctcacctgaaagactcctgattccctgaaggcattgtcgggtgtattttttctttataagcgtaatgccagtggagtgggtaagacaggtaccaccttttgcatctgctgctacagattaggcagcttggttaagttttgttttgtttttaattgttatgagttagtttgaaccaaaaggattgttaagtggagtgtaagaagcactgaataactactgttatctgagaggagtagtaaagaccagggccactgggcaatcccagaggcattaggaatttgtggcctttccctttagagcattgtcattatgtgtatctgcatctctgcattccaactttcacattttcagttcccaggagagagaatctgattggcctggttggggtcctgtgcccacttctggctgtcacctgtggctttcttccctcagttgtagaccacactctggatacctgggacccctgaaatctcctgcccagacaaccccaagcttctcaggactttttgtgggctgcttccctgttctgcctgtgcagtgcaggccttgtcacaatgtctgaatgcttaggccagagacgtgggggtttggtgagaaaggatgagctgggtagctacactcaagtgcagagccaccagtattgtgggacagagccaggcatgggaagagaagtgggcacggatgggggccagctttcccgatgtgccttaatctggcacagaactcctaaggagtgtgaaaatttcaaatttgatccaggccttccaggtggttatgaagaaggcgagtttgtcaagacaggataatacaatatacttcatttaatagcttgttagtgtgatttataactaaatatgtagacatcatatatgggtcttcattcatactcttgccccaggccctgaaagtgttagctaacaggcaagacctgcctgggactgagattctaaaacacaacctccacccccaactccgtttcatcatatagtagcctaacatattagttggttcgttgcttatagtcaggcaaacaacaaagactccgaattgagctcttggtaatttttgaaacctgcctggtaatactgtgtttcctcattctgatggcattcccagaccatattgcaaatgacttgatgtgtattttcagacttgttgagaagggcctggtggtctatatagcaggcataaaatgtcaccaggccgacttcatgacttatcttttgaggtcaaacagacccattgaccaaaagatttgagggcagtgaaaacatcttgtatactatctttaacaatggatttaactcctaaaggaaagccacctaaacatgactgtttaatcttcactagcaatttgaacttttttttttttgagacggcgtctcaccttgttgcccaggctggagtgtagtggtgtgaccttggctcgctgcaacctccacctcctgggtccaagtgattctgctccctcagcttcctgagcagctgggattacaggtgcctgccaccacacccagctaatttttttgtatttttagtagagacagggtttcaccgtgttggccaggctggtctccaattcctgacctctagtgatccacccgccttggcctcccaaaatgctaggattacaggtgtgagccaccacacccggcctgcgcccagataatttttgtattttttttttttttgagagtctcgctctgtcccccaggctggggtgtagtggcacgatgggttcacgccattctcctgcctcagcctcccgagtagctgggactgcaggtgcctgccaccacgcctggctaatttttttgtatttttagtagagacggagtttcgccatgttagccaggatggtctcgatctcctgaccttgtgatctgcccgccttggcctcccaaagtgctgggattacaggtgtgagccactgcgcccagccaacaatttgaacttttatctgtcaaatctatatgcatccttagcaagctttgtaaactgcctggtaactgatagatcttggttcacttagcttcccaaattatgctgttatcatcttgtctctctgttctttaaatatctggttgggagggtatggagagagagggaggaagaaagacacctctgtaagtttgaaattatttgcatcccccccaccgcccaccaccaacctttttaaaatatagagacacagagtctataccacgcctggcctaaaataattttttttagagacgggatctaacagtgttcccccagcttggctatcttaaacttcttaagggtagctagttctaagaactgcttttttctggctaggcacagtggctcacgcctataatcccaacactttgggagaccgaggcaggcagatcacctaaggtcaggagtttgagactagcctgggcaatatagtgaaatcctgtctctactaaaaatacaaaaattagctgggcgtggtggcatgcatctgtaatcccagctactgggggcgctgaggcacgagaattgcttgaacccaggacacggaggttgcagcgagctgagatcatgcactgcactccagcctgggtgacagagggggagactgtctggaaaaaaaaaatgtttaaaacaaaaaactgtttttttgtatgtgtgtttatatgcgaaccatttgtgaaagtggtcccagcatgatgccacatgtgtcatttccaaatatttcagtctgtatttttttctctctctctctgttttttctgtcacccaggctggagtgcagtggtacgatctggctcactgcagcctcgacctcctgtgctaaaacagttctcttgcctcagcctcctgtgaagctggtaccacaggtgcatgccactgcacccagctaacttgtagagattggggtctcactttgttgcccaggctgttatttgactcctggactcaggtgatcatgccactttggcctgccagagtgctgagattacaaaagtgagccaccacactcagccataaatgtgttgttgttgttgtttttgagacagagtttcgctcttgttgctgaggctggagtgcaatggcgcgatctcagctcactgcaacctcccccctcctaggttcaagcgattctcctgcctcagcctcccaggtagttgggattacaggtgcctgccaccacgtccaactaatttttgtatttttaatagagacggggtttcactatgttggtcaggctggtcttgaactcctgacctcaggcgatccacccgcctcggcctcccaaagtgctaggatcacaggcgtgagccactgtgcctggacttgtaaatggtatttcaaagtaaaatatatgtcattgcatttatcaagataatttgattgagctttgtaggtcctagccatccttctgcctattactgggctttttgcaaatgctgttcctgtttccacaacctggagcattgtcccatcccttttattgtttctcttgctgttatttattatgtcatccatcatcattataccattcctctgccaagaaacatttaatttttgtttttgtttactattacaaaaatgttttatagaatattgttagacttacattcttgcccctcattgtggaagtattcctgtagtatgaatacagccagaggttttttagttttgttttggtttttttgaggagtcttactccttcatccagaggctggagtgcagtgacgcgatcttggctcgctgcaaactccacctcctgggttcaagcgattctcctgcctcagcctcccaagtatctgggactacaggcggccgccagcatgcctagctaatttttgtatatttgtagagacgggggtttcaccatgttggccaggctggtctcgaactcctgacctcatgtgatccgcctgcctcggtctccaaagtgttgggattacaggtgtgacccaccgcgcctggcccagtgagagttaaagggccagagtggaagcaggtctttggaagcttggctctgtcttccttcagtgcagggagtttgtgttgtccatccccagcctctacagaagcacacagtgagtgttcaataagcatttcttggatcaaatggcccctgcttcttttaatggtcagtaaactttaaataatgagatttttctgcaatagagaagagcaactgccttgtgattggaagccagcatatgttattcctaagcagttctgccttttttccacagaaggtggtcttctgccctgttaaagaagccctggaggtggactggagcagtgagaaagcaaaggctgctctgaagcgcacgacctccgactactttctccttcaaggtgaggtctcaaagcacaacttaccccgggagagcttttggctctgatttctgcaaatgtggttgcaaggtccagatggttttgtgatgtttgccttgggtggcattcttcattggctagttctcagtgatcacttgagaaaggggtggtcacttgaagggggtgaggtctaccattgagctctgggttctaatgacttctcctttttttacttgttgaaatgacctccctgtcaagttgaccttatggtaatagtgttacaggtcacagattgagaaacctctttttttttcttttttctttttttgagacagagtcttgctctgtcacccagactggagtgcagtggggtgcaatcttggctcactgcaacctccacctcctgggttgaagcgattctggtgtcttagtgtccccagaagctgggatgacaggcatgcaccactgcgcccggctaatttttgtattttgagtagagatggggtttcaccatgatgcccaggccctgaagttctgagattataggcatgagccaccatgtgaagcctgatcaaccaacttctcttcaccgccccccgcctttttttttttttttttttttgagacagagtcttgctctgtcacccaggctggaatgcagtagcgctatcatggttcactgtagcctctacttcctgggcttaagtgctccccatgcctcaggctcctgagtagctggtactacaagcacacgccactgtgcccagctagtttttgtatttttttgtagaagcgaagtttctccatgtagccaggctggacttgaactcctgagctctagtgaaatccccgcgttggccttccaaagtgctggagttaaaggcgtaagccaccagtgcttgttcccctcttcagaattctttctctgcctcaaaaccatcctcacgcttatgaaaggtggggttgtttttcctcttgctattaatgaactacttatcagtccatctttgctggtggtcaagagactgttagtaagtattggttggcttttcagtgttcttcctgtacctggcacttttttgtttgtttttgagatggagtctcgctctgtccccaggctggagtgcagtggtgtgatcttggctcactgtaacctctgcctcctgggttcaagcgattcttctgcctcagcctcccgagtagctgggactgcaggcgcgtgccaccacacccagctaatttttatatttttagtagagacagggtttcaccatgttggccaggttgggctcactctcttgacctcgtgatccgcccacctcagccccccaaagtgctgtgattacaggtgtgagccaccgcgcctggcaaacctggcacttttaatttttattttaattttttttttggagacggagtctagctctgtcgcccaggctggagtgcagtggcacgatcttggcacactgcaacctctgcctcccaggctcaagcaattctcctgcctcagcctcccgagtagctgaaatacaggcgggcaccaccatgcccagctaattttctttttttttgagatggagtctcactctgttgcccaggagagcagtggcgtgatcttggctcactgcaacctccacctcccaggttcaagcgattctcctgcctcagcatcctgagtagctgggatcacaggcacctgccaccacgcttggctaattttttgtatttttagtatttttgtattttttttgtattttcaccatcttggccaggctggtctcgaactcctgacctcaggtgatctgcccacctcagtctcccaaagtgttgggattacagacgtgagccactgcacctggctgcgctaatttttgtattttagtagagacagggtttcaccatgttggccaggctggtcttgaactcctgaccccaggtgatctgcccacctcagcctcccaaagtgctgggattacaggcatggtagttttttaaaaagtattttttttaatgttatttatgcatttatttttttgagacggagtctcactctgtcacccaggctggagtgcagtggtgcaatcttggctcactgcaacctccacctcccggttcaaacagtttccccgcctcagcctcccgagtagctgggattacaggtgcccaccagcacacccagctaatttttgtatttttagtagaaacggggtttcaccatgttggccaggctggcctcaaactcccaacctcagatgatccacctgcctcggcctcccgaagtgctgggattacaggcgtgagccaccacgctcagctggatgaactatttgaaagtcccgaatatccatttgtgtagaaataaatgggttgagcaggaatgagtgttgcatgtgagtgggctgcactcagaaaatgcctcctcttgatagtgggatcaggtgtggaagaggcaccagcagtaagagcagagtcttttccatgtgggaacagtgcctgggccctttgggagaagcttgttgctcactgcctcgcacatagaaagccctcaggaaacaatggcgctaatttgccaaggtttgggtttgacttgagcatctctaactgctgcttatgaaaggagtcaactgggctgggctactaaaaatacaaaaattagccggatgaggtggtgtgcgcctgtaatcccagctactcgggaggctgaggcagaagcacttaaacctaggaggcaaaagttgcagaatccgagatcatgccaaagcactccagcctgggtgacagagctgaactccatctccaaaaaaaagggggagaaacagagtcaatcacagatcatctactccagagttgaaaagtgtacacgccaaaaaaaaaaaagagaaaagaaaaaaagcacatatcttcacggatgacagagttctctaggacttgctctgtgccgggcgttttccatgtatatcaccttcatctcacaaaggccctcaggcaagtgctattaacaccaccagctacagaggggaatctgaggctcagggaatttaaagtcagtggctcaagatcacccatctaaaacaaaatggcagtgcccactggaagccaggtctgttttgattccaaaggtcttgttctttttctttttccccagagacagagtcttgctctatcacccaggtaggagtgcagtggggcgatcttggctcactgcaacttctgcctcctgggttcgagcgattctacaggcacgcaccaccacacccagctaatttttgtattcttagtagaggcagggttccaccgtgttggccaggctggtctcgaactcttgacctcgtgaaccgcctgcctcggcctcccaaagtgctgggattagaggcgtgagccaccgcgcccggcccaaagtcttgttcggaacaaccatgcaccactgcctgccacagaagtcatatagctactgtttcttcctcaaccacctgtccacccctccaaccccgtaacttctgatgctgatgtccagtagcacctgcactgaatattcactttgctcctagatatcagttttgtcccctcagttcaatgacccctgtgatgttgagatggatgagaaaatactctggaaactgcagaggataaaatcaggatttcctcacttcagcacactactgacattctgtgctggataacactgtcacgggggactgtcctgtgcactgtgggatatttagtaacacccctatcctctactcactagatgccagtaatatctccccacccagctctaacatcaaaaaatgtttccagacaccactgccacatgtccccagttgagaaccactggattatgctaaactcaaaggccagttgactcctttcttttctttcttttcttttttttttttttttgagacggagtctctctctgtcacccaggctggagtgcagtggtgcaatctcagctcactgcaagctcagcctcctgggttcacgccattctcctgcctcagcctcccgactagctgggactacaggcgcctgccactatgcctggctaattttttgtatttttagtagagacggggtttcaccgcgttagccaggatggtctcgaactcctgacctcgtgatccacccgcctcggcctcccaaagtgctgggattacagacgtgagccacttcgcccagcctgtttacccttaattccatccctcagtgggtattatggcaacagtctcatgagtgcctatgaccctttgctggataatatatcctatcatgtttaccactctctcccagatggcattaattatctgtctttttcagttttgagttccagggctttggatatggtaatcaaaacattaaaactatgtgcagtaaatttcttttcttttttctttttctttttttttttttttggtgtggtgaaaagcacataacataaaatttaccattataacttaagcgtataggtcagtaataatcatacaatgttttattttattttgtttttttctgagatggagtttcgctcttgttgaccaggctggagtgcaatggtgcgatctcggttcaccacaacctccacctcccaggtttaagcaattctcctgcctcagccttctgagtagctgggattacaggcatatgtcaccacgcctggcaaatttttttttttttttttttttttttgtgagacggagtctcgctctgtctcccagcctggagtgcagtggcatgatctcagctcactgcaagctctgcctcccgggttcacgccattctcctgcctcagcctcccgagtagctgggactacaggtgcccgccaccatgcccggctaatttttttgtatttttagtagagacggggtttcaccatgttagccaggatggtctcgatgttctgacctcgtgatccgcctgcctcagcctcccaaagtgctgggattacaggcgtgagccaccgcgcctggccacatttttgtatttttagtagagacggggtttcaccatgttggccaggctggtctcaaactcctgacctcaggtgatcctcctgcctcggtctcccaaagtgctgagattacaggcgtgaggcaccgtgcccggcagtgagaacatttacaatcacatattgtgtagcatcaggaaggatttttaagatcaaagttagcacattagaagtggaaataatttaaaagtggccttgattttttttttttttttttttttttgcctactgtaaagtcaagcctcagtaacattctgatttcaggatgcagggtggctttgggggatatccaagttgagtggtaaactttgtaggcactactcttgtttccatgttcctggcacctaagttgatatattttctcacagtcttgtgacaatctttgaagtatagttgttatcccattttcctataaggagaccaaggttgagcatggttgtgattgccgaaagtcatatccgtggttttatagacagtcagaatttagaccatgaggtttgttttacctgtggacttagttttcaacatatttaagatatatctgtagtctgggcgcggtggcttatgcctgtaatcccagcacattgtgaggctgaggtgggcagatcatttgaagtcaggagttcgagggcagcctggccaagatggtgaaatcccgtctctactaaaaaacacaaaaattagccaggcatggtggcacatgcctgtagtcccagctacttgggaggctgaggtgagagaatctcttgaacctaggaggcaaggttgcagtgagccgagatcgtgccactgcactccagcctgggcaacagaacgagactctgtctcaaaataaaataaataaaatatctctaaactaatatatctcattaaatttcagatctggagttctgtgagttagggaaacaggatcaccaccatagtagaaaaaactctggtgcagatagttttagacacaaagattatctgaattcaggcccagataattgtcttctttttccccaagaaacatttgaattgtatttctgttagataagcatcatagtaaaaagtcttcaaagtttttgaaggcagaaaaagttttctttgttaaacccttcccatttttttgtcttctaaatttctaggagaactactgttaagttttttagtatcttgttgaacaatggttaacaattataatcatttgtgtttatgtaatcaaactgtgaaacaccggttgggaacttgcttgtgtacacttgatggcgtaaatggtaggggaagagcatacatacaaaagtggcctcttttgctttcttggcagcatgatgttatattcctttggatgtaccgtcatctatgaccagtctcatcttgaaaggcatgcttattttccatttttcccagtgcttggaatttgtttccaaaattgtttctaggaacatgactaatgtgactgacgatgccttaggaattcctagtggggacaaggtgcttggctgggatgcatacctaagaatatctcacaaagaaacctgattttgtttcactattgcctaatggcgcacatagtaggtgctcaataaataaatattttttgcatgagtggtttttgcttgtctggtcatttgccctattgtagagggagagtagtgtgcccactggagtccccacagggtccttttgcctgcatgcctacccctgtggcacccatcaggcttttgattccaatgttgccctgggctctcactcacaggtagatgttttttattgccccattcacaattcagccacctgctgtccgcatgcatgtgcttgccatgtttagatattgggtgtttttccagtttacttaataagttagtggccagactgtacgcttcctgctgcatttttccactgtcttgagagttggcctcgccatctgtgagcaaaaggtctcttctttttattattctcccatggcatgttgcaaaacagtaagcgtgagctggtttcctgtggcaaaaaaatgactttgatttgttctttttgaggttactgtgagtttatcataacaggagtgctaaaaataccgagtctggtatggaaacagcattcacttaccagcatgaacaataacatacaggtttagcctagagcaggaagaaatggacttcatctcaagatgagaatacttatcagagaattcttggcaatcttaacttgctcagtctctgttctgatgagttatggaaaagtacttagaccatctttgagccacagaattgaagctgaaaatattcttagaccaaacattttgtgagcacctgctatgtaccagatctcatagctgggactaatcagaggaagaggaatagaataagtgttcttgccaatgtgaaagacaaacaaataattctactccttgtgaggacagctataacagagggctatagaaactatcatgtgttgttcctggtttttgtttgttttttttcccccccaaaacagggtcttgctctgctttccaggctggagtgtggtggcacaatcataactcactatagccttgaactcctgggctcaagttatcctctcacctcgacctgcaaagtagctgggactacaggcgtgtgccaccatgtccagctattttaaaaaatctgtttgtacagattggggcagggaggtcttgctatgttgcccaggctggccttgaactcctggcctcaagaaatcctctcacctcagtttcccaaagagggactataggaaagcaccaccctgcctggctcgttgttctgtttttaaatacatttgcattattccataataatcaaagtaatttattatgggaacttaggaaactgaaggtctgaccatctttggggagttgtgaagtcttgacagaggaggggagatctgagctgtatttctcggaacaggtatttgccaggtgggaaagagggaagaatattgcagagcaacacatgcacagggccagcaggatagaggctgagcctcggaggggactggagcttggagagagcaggctagtggtttccctattgatagaatatcagaatctggccaggcgcggtggctcacgcctgtaatcccagcactttgagagactgaggtgggcagatcatgaggtcaagagatcgagaccatcctggccaacatagtgaaaccccatctctactaaaaatacaaaaattagctgggcatggtggtgtgcgcctgtagtcccagctactcgggagggggaggcaggagaatcgcttgaaaacctggaaggcagaggttgcagtgagctgaggtcgcgccactgcactccagcctgacgacagggcaagactccatctccaaaaaaaaaaaagaaatctatctatctatcagtcagaatcactgaggaaaccgttgaaaaatgcggagtgcctgcttgtagctcacattactgaatccagatagctaggagtgacttgcatgtctgcatttttctatagcacccaggtttctcaaatcagccaagttaggggaaagtactgtcataggaaagggaagcccatttcccaggtcaaagcctttgcttactcgtttatgtttattttatttttgagacagagtctagctttgttgcccaggctggagttgcaggtgcaatctcagctcattgcaacctccgccttttggattcgtgcaattctcctgcctcagcctccaagtagtggggatcacaggcacacgccaccatgcctggctaatttttgtatttttagtggagacagggtttcgccatgttggccaggctggtctcgaactcttgacctcaagtgatccatgcacctcggccttccaggtgctgagtttataggcatgagccatcgtgcatagcctgcgtttttcttttaaaatgtgttaagcactgtatttcaaattacatttgtgcactgaagcagggaggaaaaaggagctaacccaagtagctgttcaatatagtattttgactgcataccctcaaagtaaagaaaaatctcacctggcgcggtggcttatgcctgtaatcccagcactttgggaggctgaggtgggtggctcacagggtcaggagatcgagaccatcctggctgacacggtgaaacctcgtctctactaaaaatacaaaaattagccgggcgtggtggcgggcgtctgtagtctcagctacttgggaggctgaggcaggagaatggtgtgaacccgggaggcagagcttgcagtgagccgagatctcaccactgcactccagcatgggcgacagaacaaggctctgtctccaaaaaaaaaaaaaaaagaaagaaaaatctctagccggtcgcgatggctcacgcctgtaatcctagcactttgggaggctgaagcaggtggattgcctgagctcagaagtttgagaccagcctgggcaacatggtgaaaccctgtctctactaaagtacaaaaaaattagccagacatggtggcacactcctataatcctagctacttgggaggctgaggcaggagaattgcttgaaccctggaggcagaggttgcagtgagccgaggttgctccattgcactccagcctgggtgacagagcatcttaagaaaaaaaaaaaaagaaaaactctaaataaatattgaactctgcttagtagggattttgttttcagatgaggtcttgctctgtaccccaggctggagtgcagtgtcacgatcataacttactgcagcttctccctcccagctcaagcaatcctcacatcacagcctcccaagtagctgggattataggcaagtagcagggattacaggcatgcaataccacacccagctgattttggtattatttgtagagacggggtttcactgtgttgcccagggtagtctctgtctcctgggctgaagtgagcctcctgcccaaagtgttgggattacaggtgtgagccactttgcctggcctagtaggtttgtttttcacagtgataggggttagcaattctgaaactacttactgttcttctaagattgagcagataggtaagtatagtgttaatagtgagaatcaagttttcttattgtcagaaaagggtgttcctatgaatgtggacagtgggaaaggctagaaggagccatgtggtattggattggaattgaagttatctggatgaactcatggtttcttatacgtagatgtagtaatagatgtatgtgtgtatgcatatccacttttacacgtgtttatttcctagaattgtttcctagaattgttgagagggtttatgcccagagacatcccagaagcactgaacgcactcatgccaagatgttaatacctttcctcactaaagagaaaccagggttccttggagaaatggctgtttccagatctggggtaggaaaattacaggtgagcttggaatatcctgctatgccagaaagtaaggaagtgctctaagaatgataggggcatgtcaaaagaacaagaagaataatcaattaatgtaaacaaggaattatgaagataacaaagtctatctttgactatcaccatagtagtaacaattgtttcaatcaagaatcaaagtgctaaaatcaatggggaacagtttgcggtgaaacagtgtagatgtttccttatcagatgcttttatgctatgcctggtggctcacccctataaatcccaagaggctgaggcaaattgatcacttgcacccaggagttttgagaccagcctgggcaacaaaacgagaccccatctctacaaaaaataaaaaagttagccagatacagtggtgcatgcatgtagtcctagctactcaggaggatgagatgggaggatcggttgagcgcaggaggtcgaagctgcagtgagttgtgattgcaccactgcactccagcctgggagcaagactttgtctcccccgaaaaagaagatgcttttaaatgaattacatagagagacattggagaaccctggcaggttgtacctcagctgagtgatgaaattaacaatctagggatggacagttagacctcatgcctcttggaatatgtaaccctgggttggatctgagaatagaggaaggttttttttcttttgctctaaaggatgttagtggaacaattggtaaaaagaggccccggcgtggtggctcacgcctataatcccagcactttgggaagccgaggcaggtggatcacctgaggtcgggagttcgagaccagcctgcccaacatggagaaaccccatctctactaaaaatacaaaattagccaggcgtggtggtgcatgcctgtaatcccagctacttgggaagctgaggcaggagaatcgcttgaacccaggaggcggaggttgtggtgagccgagatcgcgccattgcactccagcttgggcaacaagagcgaaactctatctcaaaatagtaataataataataaaataaaaaacaaataaaaaggtctgtaggttagatagcagtactgtttccatgttatttatttttacagttatgataattgtctcatggttatttaagagaatggtttttgttttgtttttcttgttttttcttttccttttttttttttttttttttgagatggagtctcactctgtcgcccatgctggagtgcagtggcatcatctcggctcactgcaagctccacctcataggtttacgccattctcctgcctccccctcccaggtagctgggactacaggtgcccgccaccacacctggctaatttttgtatttttggtagagatggggtttcgccatgttagccaggctggtctcgaactcctagcctcaggtgatcctcccacctcagcctcctgaagtgctgggattataagtgtgagccagtgcacctggcctctttttttttttttttttttttaattttacagaattttttttttttttaagacagagtcttgctctaaggctgtagtgcagtggtatgatcacagcttgctgcagcctcagcctcctggactcaagcgatcctcccacatcacccttctgagtaggtgggattattgtaggctaaatttttaattttattgtagagaggcctcactccatggcctaggctggtcttgaactcctgggctcaagtgatcctcccacttctgcctcccaaagcattgggataacagacgtgagccactgcacccagcctgttagataatttagaaaattttctttcctcattcttcaatttcccctcattcacactcccaactttcctgttttgtgatttttaaatgacgttgtctttggatgccggctggatttggtgattagttctcttcagaagaaacttcttattttagaacttgtaacctttgcaaagcaggccataggcagccatcgctatttgggtatgacattccccagtgggtttttggtgtccagtaatgacaaaaactgctgagaaagagacagccacagggaaatgggttccgataatggggcagcagctgagtgcttgttgatttgctgctgtcatgaccacagatgtttaaaaataatttgtaaggaaaaagaaaaaagcgtagtgtgtgtgtgtgtgtgtgtgtgtgtgtgtgtgcgcgcacgcacgcgcgcgcgcacaccactgccttatcagtggtagagaatgcagaccacagtcattcagaaaggaagaaggcaccaccatggaaacaggagaggtgaggagaagggcagaggtgacccacaaatgcggctcagtgccttacagcagagagctcatgagagaacagaactggttagtcaccgactctgctcctcggtctgcaagagaggttcagcaccaagtctatactacacagtactggaaggattagatgaaggcctggcacacattgtgaattaatagttactggttacaggcggggtgtggtggctcaggcttgtaatcccagccctttgggaggccaaagtgggaggattgcttgaggccaatagtccaagaccaacatgggcaacatagcaacaccctgtctctttttttgactgtttttttgaaacagtctcgttctgtcagccaggctggagtgcagtggcacaatcttggctcactgcaacctctgcctcccaggttcaagcaattctcctgcctctgcctcccgagtagctgggattacaggtgcctaccaccacgtccggctaatttttgtatttttagtggagatgggctttcaccatgttggccaggctggtctcaaactcttgacctcaggtgatccacccaccttggcctcccaaagtgctgggattacaggcgtgagccactgtgcctgaccggttcacgtactttacatgcattgtgatcatattaaatcttcatgacagccttactagatcaggtcttgtcctgttttcacatgaggaaattgaatcttggaagggctaagtcatttgtccagggtcatcacacgcagtaagtgttagagtctaaacgagccagagctgtcacactgtcatccccagggccttgtgtttaagcatcgcccaacaaagtgctcagtcagactttaattattagcattactaataataccattatgatgattattttgtctaaacttcacaggcacctcgtgacattttcttattccacttttgcagatgggaaactgaggcccaccaagatcagattacaataatgggcaacattgtcagcaacctgccttgctttttttcttagcaggcccacatctcccccactcccccacccacttggcagtagcctgtgtttgagctgctcacaggccccaaggcccagctgcaattcttgtttaaagcctcacatcttttctctgactgtcagacaacagtcacgggaatgtcctgtgccatcttccctcggcaagaggggttggcagagagcagcagatgcctagagtcaaggtcatgtgctgctcaagtgctgggctggagacaagaccctctctccctgctgcttgtgaccaggcagggtggctctgaatgtagagggctctgtcagaacagttctgtgaccagagggtgtggttggcaaagcaatgcattaggggcccatggaagtttattcttgttgtccacattatttccctgtgacttttagatttttttttcctttttgtaaattagttttttcatactagttagaatgtttcaccttaaaggtgagagtcaagctctggaatcgcctgacatttttaaggaaaggaatagaatattgggctggggctagtctgaaatggtggtttgtattattttaaattgatgggctctgggttaggggagccaaatccattttaaagtgatttttgtaaaaattggcatgtcttctgtttcttctcttttccaaaggtgacactataacgtagaggttaagaatgtggtgacttttaaatccgtcgtgaccataagcctctcctaagccccagttttcctaccactaaaatgggggtggtaacagttgtacctacctcattctgtcttttttgttttttgcttgtttgtttgttttttagatggagtcttgctcttgtcgcccaggctggagtgcaatggtgtgattttggctcattgcaacctccacctcctgggttcaagcgattctcctgcctcaacttcccgagtagctgggatgacaggcacccgccaccatgcccatttagtttttgtatttttagtagagatggggtttcaccacgttggccaggctactcttgaactcctgacctcaggtgatccacccacctcagcctcccaaagtgctgggattacaggcgtgagccaccactgccggcctcgttctgtcgtatttttttacgtaggagagctcagtctgaatgtaggatatgacatggttgtggggttttttttgtttttgttttgtttttgttttgttttgttttgttttgttttgttttgttttgtttttgagacagtctcactctgtcccccaggctggagtgcagtggtgtgatagctcactgaaacctctacctcccaagttcaagcgattctcctgcctcagcccccaagtagctggaattacaggtgcccaccaccatgcccagctaatttttgtagttttagtagagatgaggtttcaccatgttggccaggctgctctcgaactcctgacctcgggtgatccacccgcctcggccttccaagtactgggattataggcgtacttggaaggtaccatgcccggccattatatgctttttaaaaaaacctaaatgttgcaaaaaacatgtgtctaaaatctctgtttcaacatagttttttaatagccatgtaatattccattctgtcaatatgtctttatatgtggtacagactgagtgtctaaatccaagaacccaaaatctgaatttttttttatttttcatttttatttgtttacttatttttgagacagagtcttgctctgtcacccaggttggagtgcggtggtgtgtcggctcactgcgacctccacctcccaggttcaagtgattttcctgcctcagcttcccaagtagctgggattacaggtgcccgccaccatgcctggctaattttttgtatttttagtggacacgaggtttcaccgtgttggccaggctgatcctgaactcctgacctcaagtaatcctcccacctctgtctaccaaagtgctgggattacaggctgagctactgcgcccagcctatttttgtttttttgagacagagtctcactgtgtctcccaggctagagtacagtagccccatctctgctcactgcaacctccgcctcctgggttcaagtgattctcctgccttagtctcctgagtacctgggattacagacgtgtgccaccacacccggctaatttttgtatttttagtagagacagggtttcactatgttggccagcctgatcttgaactactgacctcaagtgatccacccatctcagcctcccaaagtgctgggattacaggcatgagccaccgcaccaagcccccaaaatctgaaatgttttgagtgccgacataacactcaaaaaaatgcttattggccccgggcgtggtggctcatgcctgtaatcccagcactttgggaggcctaggtgggtggatcacctgaggtcaggagttcaagaccagcctggctaacatggtgaaaccccgtctctactaaaaatacaaaaattgaccaggtgtagtggtgggtgcctgtagtcccagctactagggaggctgaagcaggagaatcacttgaacccaggaggcacagcttgcggtgagccgagatcccgccactgcattccagcctgggcaacagagagagactctgtctcaaaaataaaaataaaaaaaaaataataaaagctcattggagcattttggatttgggattcttagatttggggtgctctattggtaagtacaatgcaaatatttcaaaatctgaaaatacccaaaattcaaacacttctgctccctgacatcctgtgtaaacaacactgcagtgaacatttataggtaattcattcagcgggtaagggtcaggaccttttatagggatccttaataccacatttttacatggttcattgagcattcgtgctcccctctgctgtgggtgagggtgcaggtccctcagccttcttgcttgggttgagtcatcctggtctttaatttggtaagcaaaaaatggcatcttgtttttgagctcgtttctgagaaagtgcatgctccttttccccatcaacaactttcatccggcgcctcggaacctcttcagtagagagtgagatgcaaatagcgaggcacagcttctttccctcttctgagctgatgcctggtgaggtcatagactgggtttcattgcaaagacgaaagcgtgggcaggacttttggagcacaaaaaggggcatttcagagtagtcttcatgggcggccactccagaggtgaagttttctagagaaagacatgaaagtactgtgtggctgtggcgacagacagaggcttacgagcctgccctctagagactgtgagctccgcgtgtgagggcaaggcctggggctgtctgggtcgcttctgggtccccaccacagctagcatagggtaggggtggagggggggtgctcaggaagtgatttttgaagagtggatgactgaatacatgcacacacatacttttaagtttctgggttaaagaggaaaacagaatgaggtaaacaaaggaaagtaatgtggaggtgaactgagcagatggcaagatgccgtgaatggttagaggccaggagagccagaatcagagtggcttccgtgaagtgtccctacctcctcccccagcccagctatgtcactcctctgagcttcacacctatggactgttctgcaccctagccctcagatgcaacggtgaaagtgggactcctattgggtttccctgttgaggacagacatggtgccctgtgtatctgctgctgcttttttctttttttcttgctgagtattccatgtgtagcatgtttgtaacacttgataagaaacagaaccatcccagatagcttgaacacttttcaattcagtcagtaacagaccaggtctgctttggatttccaggagcttgtgtcactttattttttttctgagccagggtctcgctttgtcacccagctggagtgcagtggtgcaatgtcagctcaccacagcctctgcctcctgggttcaagcaattctcgtacctcagcctcccaagtagctgggactacaggtgcctgccacaacacccggctcatttttgtgtttttagcagagacggggtttcaccatgttggccaggctggtctcaaactcctgacctcagttgatctgcttgccttggcctctcaaagtgctgggattacaggcgtgagccactgcacccggcctctggattgcccggcctgtgtcactttgtcatgagcccttctcccctagttatcctttattcttcaaacaggcttcctgtgtgacatattttttgagtgcctgctatggggcaagccctgtgccaggtgttcagtatagagtagtgacatcgcctttgccccacagagcataaaaatctaatggaggagacaagccagtccttgtgctagttcatttccacaggtgaatataaaaccacaaactgggcagggcatggtggctcacgcctgtaatcccagcactttcagaggacaaggcaggtggacaacttgagctcaggagtttgagaccagcctgggcaacatggtgagacctcgtctctacaaaaaataaaaaatgaaccaccaggcatggtggtgcatgcctgtagtcccagctatttgggaggctgaggcaggaggatcacttgagttcaggaggtccaggcagcaatgagctgagattgtgctgctcattccagcctgggtgacagactgaggccatgtctcaaaaaaaaaaaagaaaaaaataatcacaaactgtgagtaaggtatctaagggaaaaaactgtgctgggagtgaatgtcaggagacagggagatctgaggcagtatcgtgtccagagcccacagctgaattaatggtaatgcaggtaaatgagctactgtgtgacacaggttaccacagcaagtgtatcggcttttctagggcgagtgtgagctgggtttctggactttgcttaagagcagtgacagacctggaagatactgccccaggcactcttgggtgctttacatgtattggttcatttaatctttaaaccccacaagtgcccttgggattcccattttgcagaggaggctcagggtccttgtcacttgcccaaggtcacagtaagtggaagaatagggagtctagagctgtgctcttcgctgctgccctccagttggaaagctgtccaggccagggacaggctttgcagagagaaggtacagaggacgggacaggcaaatattcagagactatgaggactgaggtggttctgccaactgtggagggcctggtcacttgacaaggcacctcattgcacccccctgaggctctctcaaagccccttttcgagttaggacattgttatctcctgtgtagtttttgttgattgccctctgaaatgctgtgagagggtagaccatccattctgccctcgcctgcccagcccagcacctggcacagtcattgctcagtgtatatttattgaatgaacaattgactgaatgtcaggcccagggctttgccttaggaaacaggctgttggataagaggtagtactaccatactttgcaatttttctggaaatttatgtcacctgggagtggagcagattaccaggctgtttccagagatagcgactctccataaagtgagccaacctgggggctgggcgcagtggctcacgcctgtaaccccagcgctttgggaggctgaggcaggcggatcacgaggtcaggaatttgagaccagcctgaccaacatggtgaaaccccatctctactaaaaaatatgtatataaatgagccgggcgtagtggtgcgtgcctgtaatcccagctactcaggaggctgaggcagtagaatcgcttgcacctgggaggcggaggttgcagtgagcaaagatcgcgccactgcactccagcctgggtgacagagcgagactctgtcttaaaacgaacaaacaaaaaaaacaaaagtgagccaaccctggggaggagtctacgttcagctgcagggagccagggaattggggccgaggtgtctggcacagaaaagctttgggcctgtctcaggtaaatgaagttttgatatagattcaactcccctgccccccacaattgaactgtttttgggggccagcaattaggggctaatttgtgacagtgactttattttcttcctactaaagtactggtttattcggtggccttggtgattagatttaggcataatagttaaatgtaatagaagtttatgtaacaaacagtgattaataatgttgctgtccagattcccgttatagcgctaacctgatgttatgaactgagattaaatttgaatttgagtgcttacattattttgtaaaggtggttgtatattcacatatccacagttttttctataaataacgtgaaaccgtgcttggtttctcttttccaaagtttgccttttccattacatgggcaagtcctgaacctaagccgagacactagtccatcatctccagcaatgaatgtcatccccccagacttcagcatcctgagttaattaaaaggtgcagatgaagttaatcaagtttggaactctaattttgtgcagtgttttgatacgatttgatgagtcatcttttggtagagcacctctctatccctgacagtgtttgatcttaacggaacagttttataatgtgtaaactggtgggaggtgctcttcagaaatgcagtcaacagtggtatgtgtgcgtgtttggctcttggggcggggcggaaagcagaacaaaggagaatttaataagcgagaacttgtcaggggctagggtcagttctgaggctgctgcctgtcaagaacatggctttcttcctgcccccctccactgctgctaactggagtctgaccttcgagaaagagtgaaaaaagacagcttctgtttgttttgctgcaagtaagtggctggactgattggcccccttcccagaggccctgcaaggacttcagatgtggtcagcgaggtatgtggatggtgccagcctgccggccctcgtccagccaaactgcaccaggaacaggcaagggtcccagagaaacagcggggtcagctgctgccgcctttgctcctgctcttaatgctgtcctatttcttcctaagaggaagctggtttactctctcaagattgatgggcaaagttttatatgaccacggtctccacttctcacccactgaacttacagcttgaaattaacagaggcgaggcccatctggaaaaatgcatttgacaaaaacttgatcaaatgggggatcccctgaggtgggtggcaaagaaccagaccacttggaatcctaggtgctgtgtccctgtatggacctgctgtttcttttggattccattagggttaagaagcacaaattctgaagctagatttgagtttacatttctgctccagtacttgggagttacagtgaccaagtcatttaatgtttctgaacttcagtttcctgatctgtaaagtaggatgggtaggttgggcgtagtgggtcatgcctataatcccagcactttgggaggctgaggcaggaggatcacttaaggtcagaagttcgagaccagcctggccaacatagtgaagccccgtcactagtaaaaatacaaaagttatttgggcgtggttgtgggcgtctccagcctgggtgacagagtgagactccatctcaaaaaaaaagaagaaaaacaaaaacaagtaaataaatgaataaaaataaaggaatccagccatctgttagtatagccaaagcagaggatattgcatcaaatgttaaacgctagtcctgtcagtcactcctgagagaacagggcaacaagacccagaaagggtatcaacactgcctgagcagatggaggcaaagctgtgcatgggctgcttatagggcacagtctgaggccttgcagcagtcacgtggaaactgaggctgcctgctttccaggtgcaaggtgatggacagtggcaggaaccctgtgctagatgactcttgtgcgatcttatttctttgttactgggacacaagcaccaactgtcacaagggaccaacaagaggaggtgattttttttttcagctgttaccacaaagcttttcatcttttggtttgaaaacatagctgtgggaataggccgggcgcggtggctcacacctgtaatcccagcactttgggaggccaaggcgggccgatcacaaggtcaggagatcgagaccatcctggctaacacggtgaaaccccgtctatactaaaaatacaaaaattagccgggcgtggtgatggccgcctgtagtcccagctactcgggaggctgaggcaggagaatggcgtgaacccgggaggcggagcttgcagtgagccgagatcgcgccaccgcactccagcctgggcaacagagcgagactctgtctcaaaaaaaaaaaaagaaaaaagagagagaaagaaaatatagctttgggagcaccaaagcccaaagcgttatagtgcctactatgtgtcaggcactatactaaacatttcacatggcttagcactcatgtgatcttcacgataacctggtgagcgggtaattattatcacccttcctactggtttgttgttgttgttgttgtcgtcgttgttgttttgagacagagtctcgctctgtcacccaggctagattgcagtggcacgataccggctcactgcaacctctgcctcctgggtttgagcgactcctgcctcaggctcccgagtagctgggattaaaagcgtccgccaccatgcccagctaatttttgtatttttaatagagatggggttttatcatcttggccaggctggtcttgaacccctgacctcgtgatccacccgccttggcctcccaaagtgctgggattacaggcatcagccaccatgcccggctacttaatttattttttgagacagcctctctctgtagcccagactggagtgcagcggtgtgatttcggctcaccgcaacctctgaatcctgggttcaagcaattctactgcctcagcctcccaagtacttgattataggcacccaccacactttcggctaattttcctatttttagtagagatggggtttcaccatgttggccaggctggtctcaaactcctgacctcaagtgatctgcccaccttagcctcccaaagtgctggggttacaggtgtgagccactgcacctggcctcctttattttatgggacattttttgaaaagaggcttggtccaaacaggcagtacttgccacttctgcagtcatttctctaccctgccccaaaatggttactcagttgcatttatttactacaatcggaataccagcaggacatctacaaaagtagaagtattgggtggtagcagatcagtgctctctggcatccagatcgtctagatggtcacagcctttttttttttttttttggagacagagtcttgctctgtcgcccaggctggagtgcagtggcacaatctcggctcactgcaacctccacctcccgggttcaagagattctcctgcctcagcctcccgagtagctgagattacaggcacccaccaccatgcacggctaatttttttggtatttttagtagagatggggtttcgctgtgttggccaggctggtcttgaactcctgacctcaggtgatccacctgcctcagcctctgaaagtgctgggattacaggcatgagccaccacacctggccaattgttacagctttgagttgactgccaagtgttgaggtagcattgagggttgcagaagctgtgttcttgaaaaagagaagagagtaacattctcagaaagcaaacagtattcagaagagtcaatgggtgttctggagcttttttcttttctttcctttttttttttaaagaaattaccagctgggtgctgtggctcacgcctgtaattccagcactttggggggccaaggtgggaggatcacctgaggtcaggaacttgagaccaggaatttttctatttttagtgaaaccccatctctactaaaaatacaaaaaattagctgggtgtggctgcaggcacctgtaatccccagttacttggcaggttgaggcaggagaatggcttgaacccgggaggtggaggttgcattgagccgagatcacgccattgcactccagcctgggcaacagagcaagattgtctcaaaaaaaaaaaaaaagaaagaaaagaaaaagaaaaagaaattacctcttctctgatatgcagagccccgtctatactggacaggtggaagttaccagagaaatacaggccaggggcctttgtctgacattggcactgagaaaagcatagcccagaagcagggtgtgtcttttttttttacctgggcatctgtggtttgagatcttcttggaacactttataacccatttctgaacgtctcccaggcttcagtggagccacctgttgtagcttctaaaactgtgtcctcctcagttgttctcccacccattgccttcacagatgcagagaccaagattcactcactcgccattggacctttagcacccaggtctgtctggcacaaagtaagtgccaggctggtggagtgaatgaattctacttagagaatggccctcaacacaggctgctcattaccaaaactatttggtctttaaaaagtgtgactctgatgcttcagtctggggtgggtaccaaatacttgtattttttaaagagcctcacagcaacttgaatttaccttaatttttatgtaggaacccttgtcctggtagagagtataatttgctgaataagtctactttttcaatcaacatatacggaagagatatcaatgaaagaactgacaaactgtaaagccccctctccaggtgtaaagcactcagggcttgggcctagaagctgatccatgtctctgtgtctgttctgaaatagcctgtgtgatgtgggagaaagagtattgtccttagagacaaggctcgagactggctgtgccctttccttgggcagtatgtagggaacaagaatgcctgcccgcccgcaggcaggttacctgtggacaaggtgtagtgggcagttagaaggtgttggtatgttaatcagtcttttttttttttttttttttgagatggagttacgctctatcgcacaggcaaagtgcagtggcgcgatctcagctcactgcaacctcccaggttcaagtgattcttctgcttcagcctcccaagtacctgggactacaggcgtgcgccaccacgcctggctaatttatgtatttttttagtagagacggggtttcaccatgttggccaggctggtctctaacttctgacctcgtgatctgcctgcctcggcctcccaaagtgctgggattacagacgttacagacgtgagccaccacacctggccagtctttttttttttttttctgagatgaagtctcactctgttgcccaggctggagttcagtggcacgatctcggctcactgcaacctctgcctcccgggttcaagcgattctcctgcctcagcctcctgactaagtgggactacaggtgcctgccaccacgcctggctaatttttgtatttttagtagagaccgggtttcaccatgttggccaggttggtctcgaactcctgacctcagatgatccacccgccttggcctcccaaaatgcttggattacaggcgtgagccactgcacccagcctaattagtcttttgctcctatttgtctttatttgggataaaagttatagccttgttggggtcttcttacacagtagttctgactcacagccatcatctgaacctttcctctggttcacaaccaaaattaaacatccatttatggggattgagatagttttcatagtaaaggaagttttgtttgtaatgaccttcctgtttgatgggtctaagtatatggctggcccttctggctaaagcaggctttaaactggtcctgcctagaatgtgtacctcccactccttatcatctctcttctaggtcccttcccctttccctttcccttccccttccccttcgcttcttccttccctttgttccttttcctttcctttttttcttctttttttttttttttttttgacagggtctcactctgtcacccaggctggagtgcagtgatgagatctctgctcatgtagccttgaccttctgggctcaagtgatcttctgccttggcctccttagtagctgggactacaggcaccaccatacttggctaaattttttttttttttttggtagcagtgaggtctcactatgttgcccaggattatctcaaactcctgggctcaagcgatcctcacgccttggccccccaaagtgttgggattgcagatgtgtgccatcacactctgcctcttccgggtctttttttttttttttttcccagacggagtctcgctctgttgcccaggctggagtgcagtggcacgatcttggctcactgcaacctctgcctcctgggttcaagcgattctcctgcctcagccttccgagtagctgggattataggtgcctggctaattttttttatatttttagtagagacggggtttcaccatgttggtcaggctggtctcaaactcctgacctcgtgatcctcccacctcggcctcccaaagtgctgggattacaggcgtgagccaccgcgcctggcttttttttttttttttttttttttttttttttttaattttacttttttgagacggagtctcactctgtcacccaggctagattgcagtggcacaatcttggttcactgcaacttccgcctgctggattcaagtgattctcctgcttcagtctcccaagtagctgggactacaggcacgtgtcaccacacctggctaatttttgtatttttagtagagacagggtttcactatgttggccaggctggtctcgaactcctgaccttgtgatccacctgcctcggcctcccaaagtgctggggttacagctgtgagccaccgcacccggctcttccaggtcttaatagagcctttttcctctactgaaagcttccactgctttctgcccccttcaaactcatatatacttcattgaattgtttcctcggggaagccttcctgataccaccctacagagggtgtcagacgccctattatgctgtcacagcacttttcacagtaaggtaaattgcttttataattattggattgcctctctgactatgtttgttgaataaataaaaaaaggtggccaggtgccgtggctcacacctgtaatcccagcactttgggaggccgaggcgggcggatcacgaggtcaggagtttgagacaagcctgaccaacatggtgaaaacccgtctctactaaatatacaaaaattagccaggcatggtggttcgtgcctgtagtcctagctactcaggaggctgaggcagaagaatcacttgaacccgggaggcagaggttgcagtgagccaagattgtgccattgcactccagcctgggcgacagtgtgagcctccatctccaaaaaaaaaaaaaagtggctttataacctgccttctttttcttattcccagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggttggtgtcagtatttatcactgtttagtctggacagataaagtttgttttcaggatttgccttaatttgacaagctcttttattagaaacccttcagagagcaccctgccacattctgctcgctcctgtagacttctgcctctccactagaatagcaatatataaaaaataaagaggggacagattctgatttttacaataagtatcttatattcacgtggttcaaaattcaaggcaatgtaagatctgtaaacattattctctaccttttttcactttatgtgatcttgttatctcttggggacatctccagatcagtacatagtttgctccctcttttccacagctccttagtattctagagtgtgaagcgatggagtttattgaaccagttgcctgctcactcaagttgtgttcaggcttttctaactgcgtaacactgcagtgtgtgaccttgtgtcgtacgtgtgcaggtacaactgcaggataattaggaggaagggagttgctgggtcagaaggttgtaatttatcatttggtcagcattgccaccttgcctccattggtatcctatcaattcatacccccagcagcaaaaccacccatgttcccagcatcctctcacttggacactccatgctttcaccttacgtgactacctttttgctctcataaacaggcttaggatttgattggagaagaccacatagtgactaggtcacaatctctctctctcttttttttttttgagacagagttttgctcttgttgcccaggctggagtgcaatggcacaatctcaactcaccgcaacttctgccgcctgggtccaagcgattctcctaactcagccttttgagtagctgggattacaggtgcctgccaccacgcccagctaattttttttgtatttttagtagagatggggttttccatgttggccaggcaggtcttgaactcttgacctcaggtgatccgcctaccttggcctcccaaagtgctgagattacaggcatgagccaccacgcgctccatccacatctccttccaagcagctctgggatcatgtacacaccctaattccctttccatgtcttgagaggcttcctaaactcggctttgcagtgcctccagcttgtagcagtgataatgatggctgcagtttactgagcagctgttatgtactaggcatcaggtagtaagtagccaacccagatcccaccccaggtatcattacagtgcttgctctagtagcagcatgctaccttggtttcttatcaacagtaaggtctgccagagtccctagtcctttctttgttgacttcctgctgggaacttcaggtgagcaacagcaaaccccactccatttagggccagcagtggtctttgaagcacctgtggtgccctgacccaaaaagccatgattgtcctggtacagtggctcacacctataatcccagcactttgggaggttgaggcaggcagattgctttgagcttaggagtttgaggccaaccttgacaacatggtgaaaccctgtctctacaaaaaatagaaaaattaactgggcatcgatgactggtgcttgtagtctcagctactctggaggctgaggctagagcatcgcttgagcccaggaaagcagaggttgcagtgaaccaagattgcaccactgcattccagcctgggtgacagagagagaccgtgtctcaatacatatagcgtaaggctgggcgcggtggctcacgcctgtaatcccagcactttgggaggccgagacaggcagatcatgaggtcaggagattgagaccatcgtggctaacatggtgaaaccccatctctactaaaaatacaaaaaattagccaggtgtggtggtgggtgcctaagtcccagctactcgggaggctgaggcaggagaatggcgtgaacccgggaggcagaggttgcagtgagctgagatcacgccactgcactccagcctgggcgacagagcgagagggagactccttctcaaaaaaaaaaaaaaaaaaaaaaaggcagcaatagagtggcagtgcctgagcacacgagactgagacatggaaaagcggtttccccaaagagggtgggcagggaaggaaccactttggagagaaaaccagccagcagctcgttaggctgtggctttcctcttctaggaagcagggccttcaactctgctggccggtgatgcagagccagaccgttcatcactttgaatgcccaagtagtcacttggctgcacactcacggcccagcacacagccccaggtatgctcagtggctgccgcttgccactggctgactggctgggattattggaactgaagccctgcatgacccagtccttcttcctgctgcgaagcacagcagaggaaacacttgcttctcacaaactggtcattcctccaccaagagatgagtgccccagtgagttaccatgagatccaagcctgtacagtgtcatcagccgctgacctcacggtgctgatgttacaaaggcaccttgtaaactgctgcctatgtttagatgatggctttttttttttttggagacagagtctcgctctgtcccccaggctggagtgcgatggcatgatcttggctcactgcaagttccgcctcccgggttcacgccattctcctgcctcagcctccccagtagctgggataacaggcgcccgccaccacgcccagctaattttttttgtattttttagtagagatgtggtttcgctgtgttagccaggatggtcttgatctcctgacctcatgatccacctgcctcggcctcccaaagtgttgggattacaagtgtgagccaccacgcccagcctctttttttttttttttttaagatagggtctctctctgttgcctaggctagagtgcagtggcacatcatagctcactgcagcatcaacctcctgggctcaggcaacactctcatctcggcctcttgcgtagctgggactataggcgtgtactaccaagcctgcctaattttttttttttttttttttttttgtattgacagggtctcactatgttcaccaggctgtttcctattttttaaagttatgaaccgcataacaagagagtatacaaagcacatctgcctgagttaaatgataattaatacttatttatttttgttgtagagacgggggtctcactctgctgcccaggctgttctcagactcctggattcaagccatccttctgccttggctttccaaaacttctgggatagacaggcgtcagccacttgtatctcttttaatttggaatagcccttggcaaactggcttgccacctctttttgtaaataaagttttattggcacacttactcatttatatattatctgtggcagcttttgtgccacagcagggttaaatagttataacaaagaccatatggcccataaagctgaaaatattttattatctggttcttttgtttgtttgtttgtttttgagacaaagtttcactttgtcacctaggctagagtgcagtggcatgatctcggctcactgcaacctccacctcccgggttcaagtgaatctcctgcctcagcctcctgagtagctgggattacgggcatacgccaccatgcccagctatttttttttatttttttattttttttatttttttttgagatggagtcttactctgtcacccaagctagagtgcaatggcccgatcttggctcactgcaacctccgcctctgtgctctgtggttcaagtgattcttctgtctcaacctcctgagtagctgggactacaggcgcgtgccaccacgcccggctaatttttgtatttttagtagagatggggtttcaccatattggccagactgatctcaaactcctgacctcatgatccacccagcttggcctccgaaagtgctgggattacaggcatgagccactgcacctggcctgttatctggttcctttttttttttttttttttttttttttttgaatcagagtcttgctgtgtcacccaggctggagtgcagtggcgtgatctcggcttattgcaacctctgcctcccagctttaagtgattcttttgcctcagcctctggagtagctgggactataggcacgtgccaccacgcccagctaatttctgtatttttagtagagacggggtttcaccatattggccagactgaactattcctccaatacggccaaaatgagattctaccagcaatgggaggagtttttttaattattattattgggagtctctctctcacccaggctggagtgcagtggcaccatctcggctcactgcaacctccacctcctgggttcatgcaattcttccacctcagcctcccgagtatctggcattacagctgcccgccaccacacccggctaacttttgtattttagtagagacggggtttcactatgtaggtcaagctggtcttgaactcctgacctcaaatgatccacccgccttggcctcccaaagtgctgggattacagatgtgagccaccgcacccagccctagttctccatgtattttagagctctgtagtggaccttgataagcaggaagatgttacccctggatgaacaaaatgggaatgtgctggtcctggccagggcgtaaggagccggaggtgcctttggacacagctcttgggattggaatggatacagccttttgggagggcattttggcaatacatatgaaaaactagcattgctatatttagaaatttgtcttaaggaattatttcgacgcctgtgtctttgtcaagatgtatgattacagtgttgaacagcttaaatgtccctcaataggttatagaacagaagagtaatagttgataatatttgggtttaaaattatacctatttatttatttatttattttttgagacagtcttgccctgtcaccaggctggagtgtagttgtgcgatctcagctcactgcaacctatgcctcccaggttcaagcgattctcctgcctcaacctcctgagtagctgggactacaggctcaccccaccacaccaagctaatttttgtatttttagtagaaacggggtttcaccatgtgggccaggatgatctcgatctcttgactttgtgatccgcccacctcgacctcccaaagtgctgggattacaggcatcagccactgagcccgccctaattatacccgtttagattgtgcacttttaaaaatgtctagaaggggctgggcgcagtggctcacacctgtaatcccagcgctttgggaggccgaggcgggcggatcacgaggtcaagagattgagaccatcctggccaacatggtgaaaccccgtctctactaaaaattcagagtagccgggcgtggtggcgggtgcctgtagtctcagctactcaggaggctgaggcaggaaaatgacatgaatccgggaggcggagcttgcagtaagccaagatcgcgccactgcactccagcctgggtgacagagcgagactccgtctcaaaaaaagtctagaaggatgtgcaccacactggggagattggaggtagttctgtagggaggctttccctttcacttgtctgtgttccagtttgcttggtgagcacacagcattgtgttcaggagtaggagctggcagagcacacttcctttggggaagtggtggaattaagtgatttgcttactaggatgggtaacttggaggggcaggtgactgtgtcatctaaaatttgtcctctagatgccccatcctggcccagaagggctggtttctatgtgggttgtgaagactttttctgccctcatactttaatttcacgcctcaaatttcccttgcttcctacatgttaacacaggcctgctccctgacatttgtctgggaatagcatatagaacccactggccattatgggtaagaagagaattgcgagaatgtgaccagggcactgaaacatctgatatctctaggacagatataggaagcacagatatagtctttcctttaacttataaaggtaaaaataaaagtattgtgaaagaatttctgcttgccaaagttcaaaggtcttttccaaccacttatgaatcccttgctcagatttcattttcacgcctagatgccagcattaacactgctatctgaatcgggccctcctgctagaagttgtttttattcaggagagcctactactgaatttctccagatgtcatggtcacagttctgttcccagtgctccattttccttgtcttcctctcttttaggtactgcttctccgagatggccccagtgtgtgcggtggttggagggattttggcacaggaaattgtgaaggtaaaacatcactgtggagcagaaaattgttaaccatgactttgtatatgtgctgacagagagaatggaaactgtcttagacagctgcctgctttctctcaccccattcatctttgtttcatgccctccccatttccacctcatcccattttctctggcccatccaggtgccattcagcaaatgaccttggagtgcctgctctgtgcttagctcacagttggccatagtgcctcgaaggtgtgatctgctctcccctaactgtattagttatccagtgcctgttgtattggtcagggattctgcttctcatagctctataagtgagtactatcatgatccccacttaagaggaagacacttgggcccatgaaagggactccagaacctgtgctcttaacctctgtacagtttatctctattcatcaccatgacatcaaagccctcccttttttttttttttttttttttttttttgagatggagtctcgctctgtcccccaggctggagtgcagtagcacgatctcagatcactgcaagctccacctcccgggttcacgccattctcctaccttagccttccaagtagctgggactacaggcgcctgccaccacgcccagctaatttttttgtatttttagtagagacagggtttcactgtgttagccaggatggtctggatctcctgacatcgtgatctgcccacctcagcctctcaaagtgctgggattacaggcatgagccactgtacccagccgcaccccccccctttttttttttttttgagacagaatctcactttgtctctcagactggagtgcagtggcatgatcttgactcactgcaacctccgcctcctgggttcaagcgattctcctgcctcagcctcccgagcagctgagagtacaggttcccaccaccacaccaggctaatttttgtatttttagtagttcaccatattggccaggctggtctcgaactcctgaccttgtgatcctcccacctcagcctcccaaagtgctgggattataggtgtgagccaccgcacccggccaagcccccgtctttttaaccacacactgtaggtatttgtagagaaatcagtttctgtgtccccatgaacacaccaggagcccctcaaggctctgtacaggatgacccgtgaccctgttaggtaggtgttagtgtgtctctcagaagggaagcatcttatacagggtcacataaccagtaactagcacagccttttgagggtcttctggaacatttgggttgctaaaactataccatacccccaaatatattgtacattctttgcagactttgctatttgcccgaagatgttaaatttgccttttgcaggttcttggctgccttcgtggactccggtgaggctttttccttctttcttatggagcagagtcgtgcctggttaaatgattggccatgtccatgtacatgtcaagtttgagcttgggaggacagtttggaggccagcccttaacactttgtcttggggtctgtacattctggaggcgtttggctcaatttgttagtcacaccgttttcctaaggctactttttttttttttttttgtctattttttctgatccttctctctggtctaaattcttcctttgatcaaatctaactttcttctatgtaatgggcaccgaggagatatttggagggggaagaaaagtgtgcaatggccatacctctttccttgctcacattttatacatagcccagagtgatgtgaaaattacagtttatatgcccaatctgagaagagggtaatggccacccagaggactgttcgagcaggattctgaggctccctgtagacaaactgcaggaaagagtgcagcaatgggaatgttctaagtggggaatgggaatgtacatatttttgtagcctaaaatgacgacaccaccaataatagacaagacttactgaaagcccactgtctgccacacaaagacagtgttttttacgtggatactcatttcatctcccaccggccctatgaggtaggaactcctgtgatccctggtttataaaagagagactaaggtgcaggaaagaagatgcttgcccaggctagtgagtgtggtgccaggatgtgggcccaggcagtctggtttctgagcctgtcctcttcaccacggggcagtcatgcatcaggtgttgccttcaatggcaccatcatgtagagactgcatggaccccagggccgctgcccttgcattgtcagccttacttctgcacatcccattgaggggctccccctaaatttttcatgtgggatggagactggaggttggggcaggtagccttgaccccattgttggtggtagtttctcacatccccatcctcacacagccccctccttcctgcctgctggagacagctggtgcccagcatcttgtttctgtttatcccagatagccagagtactctgcattcttcgttgctgggtgtgtttggaatctcctcctaccccatcttgcttgggaagcactttaccttttgccccatgtcaccccatgccctgctctcatccccagtactccttcatacttattactggtcagccttcagccagctggcaggcggggcctgcagtccaagggcctcagactcacctttctctcctgaggcactgtctgagcgcctatggaaagcttacactaggagatgggtcaagcgcaagtctgctcctttggaatcatcttttgcgtctttcctttcttacgtccttctagataccctattttatatccatgtctacttccttgggtttaaagcagttttcctttctctccatccccaccgtccacggcaggtctccctgtctatggtaagagaggtgatagtgaaagcagcagccatcccaggttcatggtaaaacacataccatctcctgtatcttgggtttgagggtctaagagttccacctgtgtactgttggacccttccacctggctaggttggtggcatccccagtattggtaaaggactcctggccctattattattaatagcagctcctacttactaagaatttactacgtgctcggcactttacaagcctagtcacatttcattctcaccaaaactctagcaggcaggtgctttttatttgcctatttgcccagagaagcaaacttctttctgatccaagctccatgtggacagagacctcagaatccttaatgtctagctgaatacctggcatagagtagatgcttaataaatgttcccttgactgggtgcagtagctcatgcctgtaattccagcactttgggaggattgcttgaacctagaagttcaagactagcttgggcaacatgaggagacctcatctctacaaaagtcccagctactcaagagggtatgggaggatatctggagctggggagacggaggttgcagtaagccgagaatgtgcctcccacctgggtagcagaacaagatcctatctcaaaaaattaaaaacatttacaaataaataaaatttccctggaaaaatggctgactaacactatttgtatatggtagatgtgattgtccctgttttatggatgaggaaaagggtttggtgctgagtttgaagaggagcagttcaggatgtgtagccccaccttcctcatgaatgatgggacggtgctcctgggaaccgttaaaccctgccctggcagcttgcctaggtgatgtcttcctctttaaatggtagcttgtggtgaaatttcaatcctttctgggttaaggacctgtttgaaaatttgtgacaattgtgaaccctttctcagaaagatgtatgtgcatacaagactcagtatgttgtttcgggggctgaccctgcctcaaaagacagggccacgtgctcactctccttcccacccctctctctcgctctctgttgcccaggctggagtacagtggtgccatcacagctcactgcagacttgatttccctggacttaagtgatcctcccacctcagcttcctgaggcactgagactataagcacacgccaccacatccaactaattttttttattttttgtagatatggggttttgccatgttgcccaggctggtctcgaactcctgggctcaagtgattctcccgcctcggcctccctaagtgctgggattacagatgtgagacattaagcccagccctgttcttgtattttaaagtgctctgtctggtaaccccacaagataatcaccattgccattgctaaatagcattgtccaggccctctggatcccagccctgaccccctgtggaagcctagcgactctatgtcctcatggaatagcccccgcttctgcatcagtgtgttccttgattaaatgtgtccccttaggtgataaaggccacagcctaagaactgccacctttctcagttgaatagtcatgaataattatttctgctgtttgcccaatggtggtgcaacacagtgttagtcattgttttagttttaaggtgtttttttgtttgtttgttttttgttttgagacagggtctcactctgttccccaggctggagtatagtggcactattacagctcactgcagcctcaatgtcccaggctcaagcgatcctcccacctcagcctcccgagtagctggcaccttgggcatgcatcaccatacctggctaatttatgtcatttttctttttctctttttttttgagacagagtctcactgtgtcgcccaggctggagtgcggtggcgcaatctcagtttactgcaacctctgcctcctgggttcaagcaattctcctgcctcagcctcccgagtagcatgccaccatactcggctaatttctgtatttttagtagagacaggtttcaccgtgttggccaggctggtctccaactcccaacctcaggtgatccgcccacttcagcctcccagagtgctgggattacaggcgtgagccactgcgccccacctattttagttttcatatagacgggatctcaccatgttgcacagactggtcttgaattcctgggctcaagtgattctcccacctcagcctcccaaagtgctgggattacaggtgtgaatgtgcctggccctggcctgttttacatttttgagatacatagtttaacccaggcaaatacatttcttaatctcatgttaggaaaataaggtaatgtttggagaggttaaataatctccccatggacacacagcttgtaagggacagagcaaggagataggacaatcaaaattgtctccagacattgccaaatagccctttgggagcaaaatcgaccccagttaagaaccactgccctagactgcttttagaatttttttttccctctattcctcttaaagcacttgagctaaaccctcttttcatttttctccccaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaggatttgcttgtttttcttccacttcagaagcttctgagagggaatgggatgatcctaccagttgccttttcagacctgaggctcta

SEQ ID NO: 38253 - DNA, 4101 bp, Homo sapiens
cgattccgcacgtcccttacccgcttcactagtcccggcattcttcgctgttttcctaactcgcccgcttgactagcgccctggaacagccatttgggtcgtggagtgcgagcacggccggccaatcgccgagtcagagggccaggaggggcgcggccattcgccgcccggcccctgctccgtggctggttttctccgcgggcgcctcgggcggaacctggagataatgggcagcacctgggggagccctggctgggtgcggctcgctctttgcctgacgggcttagtgctctcgctctacgcgctgcacgtgaaggcggcgcgcgcccgggaccgggattaccgcgcgctctgcgacgtgggcaccgccatcagctgttcgcgcgtcttctcctccaggtgtgcacgggagtgggaggcgtggggcctcggagcagggcggccaggatgccagatgattattctggagtctgggatcggtgtgcccggggaacggacacggggctggactgctcgcggggtcgttgcacaggggctgagctacccagcgatactggtgttcgaaataagagtgcgaggcaagggaccagacagtgctggggactgggattattccggggactcgcacgtgaattggatgccaaggaataacggtgaccaggaaaggcggggaggcaggatggcggtagagattgacgatggtctcaaggacggcgcgcaggtgaaggggggtgttggcgatggctgcgcccaggaacaaggtggcccggtctggctgtgcgtgatggccaggcgttagcataatgacggaatacagaggaggcgagtgagtggccagggagctggagattctggggtccagggcaaagataatctgcccccgactcccagtctctgatgcaaaaccgagtgaaccgttataccagccttgccattttaagaattacttaagggccgggcgcggtggcccactcctgtaatcccagcactttgggaggccgaggcggatggatcacttgaagtcaggagttgaccagcctggccaacatggtgaaagcctgtctctaccaaaaatagaaaaattaatcgggcgctatggcgggtgccttaatcccagctactcgggggggctaaggcaggagaatcgcttgaacccgggaggcggaggtttcagtgagccgagatcgcgccactgcactccagcctgggccagagtgagactccgtctcaaaaaaaaaaaaaaaaaaaaaaaaaaagagacttacttaaggtctaagatgaaaagcagggcctacggagtagccacgtccgggcctggtctggggagaggggaggatagggtcagtgacatggaatcctgacgtggccaaaggtgcccggtgccaggagatcatcgacccttggactaggatgggaggtcggggaacagaggatagcccaggtggcttcttggaaatcacctttctcgggcagggtccaaggcactgggttgacagtcctaacctggttccaccccaccccacccctctgccaggtggggcaggggtttcgggctggtggagcatgtgctgggacaggacagcatcctcaatcaatccaacagcatattcggttgcatcttctacacactacagctattgttaggtgagtggctccgccccctccctgcccgccccgccccgcccctcatcccccttggtcagctcagccccactccatgcaatcttggtgatccacacagctgacagccagctagctgctcatcacggagcgtcctgcgggtggggatgtggggaggtaactaacaggagtcttttaattggtttaagtactgttagaggctgaagggcccttaaagacatcctaggtccccaggttttttgtttgttgttgttttgagacagggtctggctctgttgcccaaagtgaggtctaggatgcccttagtgtgcactggcgtgatctcagttcatggcaacctctgcctccctgcccaagggatcctcccaccttagcctcccaagcagctggaatcacaggcgtgcaccactatgcccagctaatttttgtttttgtttttttttggtagagatggtgtctcgccatgttgcccaggctggtctcaagcaatctgtctgcctcagcctcccaaagtgctggggggattacaggcgtgagctaccatgccccaccaacaccccagttttgtggaaaagatgccgaaattcctttttaaggagaagctgagcatgagctatcttttgtctcatttagtgctcagcaggaaaatttgtatctagtcccataagaacagagagaggaaccaagggagtggaagacgatggcgccccaggccttgctgatgccatatgccggagatgagactatccattaccacccttcccagcaggctcccacgctccctttgagtcacccttcccagctccagagaaggcatcactgagggaggcccagcaccatggtcctggctgacacatggttcagacttggccgatttatttaagaaattttattgctcagaactttccctccctgggcaatggcaagagcttcagagaccagtcccttggaggggacctgttgaagccttctttttttttttttttaagaaataatcttgctctgttgcccaggctggagtgcagtggcacaatcatagctcactgtaacctggctcaagcgatcctcctgagtagctaggactataggcatgtcactgcacccagctaattttttttttttttttttttttttttttgcgacatagtctcgctctgtcaccaggctggagtgcagtggcacgatcttggctcactgcaacctctgcctcccgggttcaagcaattttcctgcctcagcctcctgagtagctgggactacaggcgcgtgtcaccacgcccagctaatttttgtatttttagtggagacagggtttcaccatgttggctaggatggtctcaatctcttgacctggtgatccatccgccttggcctcccaaagtgctaggattacaggcgtgagtcaacctcaccgggcattttttttttgagacgaagtcttgctcttgctgcccaagctggaatgtggtggcatgatctcggctcactgcaacctccacctcctaggttcaagcgattctccaccttagcctccccagcagctgggattacaggtgcccatcaacacacccggctaatttttgtatttttattagagatggggttttgccatgttggccaggctgctctcgaactcctaacctcaggtgatccacccccattggcctcccaaaatactgggattacaggcatgagccaccgtgcccagctgaatttctaaatttttgatagagatcgggtctttctatgttgcccaagctggtcttgaactcctagcctaaagcagtcttcccacctcggcctcccagagtgtttggaatacgtgcgtaagccaccacatctgccctggagcctcttgttttagagacccttcccagcagctcctggcatctaggtagtgcagtgacatcatggagtgttcgggaggtggccagtgcctgaagcccacaccggaccctcttctgccttgcaggttgcctgcggacacgctgggcctctgtcctgatgctgctgagctccctggtgtctctcgctggttctgtctacctggcctggatcctgttcttcgtgctctatgatttctgcattgtttgtatcaccacctatgctatcaacgtgagcctgatgtggctcagtttccggaaggtccaagaaccccagggcaaggctaagaggcactgagccctcaacccaagccaggctgacctcatctgctttgctttggcatgtgagccttgcctaagggggcatatctgggtccctagaaggccctagatgtggggcttctagattaccccctcctcctgccatacccgcacatgacaatggaccaaatgtgccacacgctcgctcttttttacacccagtgcctctgactctgtccccatgggctggtctccaaagctctttccattgcccagggagggaaggttctgagcaataaagtttcttagatcaatc

SEQ ID NO: 38254 - DNA, 24845 bp, Homo sapiens
cacagttgaagaagcgaccgagggactgggagtcgttagtgaggtgagttcgaggcggtgcaggaagagtgttgctgggatcgctttcctgcgggctagaggcctggggtcttgagggagactggggcaagattttggattcccgattccctgtcaatcattattaatacagctgtccgggcgccccaagtttgaagctgaactacactctgctggaggtggccaaccgtccatcgggcagttctctctctctttgtctctctctctcactataaactcagtcaagtggtagctagcatcggccagttctcctgagagttacagttctgctgtagatgatggctatttgctggtggtcccaagggaaggagtggactgggattgctgggggtctaaggagtgggagttgaggagggagaactcctttcctggcctcagtttctcagactgtggtgggacggcgggcgatactagattgtgcagtcatccatcgccaccttctcttcacctttttgacagccccttccctttcggggttggtgcagggattcacgttttcttgtgtggagcttcggggtcaggcagtcatggattcccattctgattgtgctgctaattctgtgaacttggggcttgaacggtccttgaggcagtttgatgttaatgttttcttacgaaaatgttcaaacttatataaaagtgagagaagaatacaggaattcctgtcacccaaatcaccaatgattatttttgccatacttgctgtatttttttaaacttaaagagattaaaacaaatcgtaggcatcatgacacttaaggattgtcaaaagacaaaattgcaacacatttagtgagaagatcttaattggcatttattcgtgaatctacaatcaaacaacatctaattatggaaaatagcgtgagtgttccgatgagctgagcagaggttgttttcagagacaaagggctgagaaaatcagaaacggaaaacaaaaagctagttgattaaattgattaacttgattaaatttctaagttaaaggttaaagtagaggggacttcctttatcaggtgggctaaaactgggttgtttggggatttggctattatctctctcctgatatctcagaagatcagatatcaacttagttttggcttggaagcatggaactttagcatgagtgtctccattttggtttggtctgttgaacctagtgcaggagctcaatccaaaccaatgaccttctataaattttatctaacagggtgcgtgtgtaaaaaccagaaacattgctgatatgaccacaataccatcatcacactttaaaagaacaaccgtaattctagactactatccattacgtggtgcagagtcaagtccagtgtaactgtgggtttgttggaatcaggatatagttaagtaattgctatcgtcttttacatctctcttaatttagaactgttcccccttccactccactttggttatttcttggtgtaatcgattcattgaagaaactaattctagttcagttgatcatcccaccatctgaatttgtcccgtttgcttttttgtggtctcattttacctgcttctgttttctttctttttttttttaagtatttaaaaataggccagacacagtggctcatgcctgtaatcccagcactttgggaggccaaggcgggcggatcatgagatcaggagatcaagaccatcctggctaacacggtgaaaccccttagccgggcatgatggcaggcacctgtagtcccagctactcaggaggctgaggcaggagaattgcgtgaacccgggaggcagagcttgcagtgagccgagatcacgccactgcactctagcctgggcgacagagtgagactctgtctcaaaaaaaaaaaagaaaaaatagatagagacaaggtgtcactatgttgcccaggctggtctcaaactcctgggcttaagcgatcctcctgccttggcctcccaaagtgctgtgcttagattacaggtgtgagccattgagcccggcctcattttacttgtttcctcatgccagggatcagctaattatgttctacagaccaaactcaaatcctgccagctacctgttttaaaaatccccattgggcaggcacagtggctcatgcctgtaatccttgcactttgggaggtgaaggcaggtggatcatctgaggtcaggagttcgaaaccagcctggccaacatggtaaaacctcatctctactaaaaatacaaaaattggctggtcatggtggctggcacctataatcccagctactcaggaggctgaggcaggagaattgcttgaaccctagggacagaggttgcagtgagctgagatcatgccacttcactccagcctgggcaaaagagcataactccctctcaaaaaaaaaaagcattagtgggatatgatttacctaacatatagttcacccattgaaaatatacaattcagtggtgtttagtacgttgacagagttgtgcaaccatcaacactatcattttaagaatattttcatcacccaaaaagaaaccctggtactcattagcagtcattccctatttcctcccaatccttcccaccccagtctttggcagccactactctgctatatctgtggatttgcctaatctgggtattttgcacaaatgaaaccataaaatattattgtgactgccttccttctttcatttagcatgttttcaaggttcacctatgttgtggcatgtatcaatacttctttttttttttttttttcccgagacacggccttgctctgttacccaggctggagtgcagtggttcgatcatggctcactgcagcctcaacctcctgggttcaagtgatcctcctgccttggcctcccaaagtactgggattacaggtgtgagccatcggcgcccagccagctactttattctttttatggctggataatattcctttacccaagatatacttcttttctttttttttctttttttgagacagagtcttgctctgtcacccaggctggagtgcagtggcgtgatctcggctcccaggtttgagcgactctcctgcctcagcctcccgactagctggggctacaggcatgcgctaccacgcctagctaatttttgtatttttagtagagatggggtttcgccatgttggccaggatggtctcgatttcttgacctcatgatccgcccgctttggcctcccaaagtgctgggattacaggcatgagccaccgcgccccgcctgcatggatgtatgtttttatttctattggcagtggaattgctgggtcaaaaggtgactatttaaccttttgagaaactgtgacttttccagaatggctgtaccattttacatttctaccaccaatgtataagggttccagtttctccatatccacaccagcacttattatttatctttttgattatagtcattctagggggtgtgaactggtgtcttttaacatgcttattggccatttgtagatctttgaagaactgtctattccaatcctttacccattttcaaattgtgttaggtgtcctttcattattgagttgtaagtttttaatatattctcactgcaattcccttatcagatatcctgatttttttttttttttttttttttttgagacagagtttcactcttgttgcctaggctggagtgcaatggtgcgatcttggctcatcacgaccttcgcctcccaggttcaagtgattgtcccatttcagcctcccgagtagctgggattacaggtatgcaccaccacgcccagctaattttgtatttttagtagagatggggtttctccatgttggtcaggctggtctcgaattcccaacctcaggtgatccgcccacctcggcctcccaaagtgctgggattacaggtgtgagccacctcacctggcatttttttttttttccccagagacaaggtctcactctgtcactcagtctggagtgcagtggtgcagtggcacgatcataactcactgcagcctcaacctcctgggatcaagtgatcctcctgcctcagcctcccaagtagctgggaccacaggcgcatgccactatgcccggctaattttttaaattttgttttgtggagatggagtcttgctatgttgcccatagcaagttcaagtctggtctcaaaaaccatgctgctgctgcttttttttggtagagacagggttttggcatgttgctcaggctggtcttgaactcgtgagttcaagtgatcctcctgcctttgcctcccaaagcaccctatccaggtatgagccacaacagccaggagatatctgacttttgtaactgctacctgtttttgttcagcctgcaaactaaaaatggtttttaacattttttttttataagatggagtctcgctctgtcgctcaggctggagtgcagtggcgtgatctccgctcactgcaagctccacctcccgggttcatgccattctcctgcctcagcttccggagtagctgggactacaggcgcccgccaccacgcccggctaattttgtttttgtattattagtagagacggggtttcaccgtgttagtcaggatggtctcaatctcctgacctcacgatctgcccgccttggcctcccaaagtgctgggattacaggcgtgagccactgcgcctggcctggtttttaacgtttttacataactggaaaaaaccaaaagaatgaatttggtgacctatgacaattatatgtgattccgtgtcagagtctaaaagtaaagttttattggaacacagccatgcccgtttgtgtgtctgtggctgcttttatgctacaggggctgagtggagtacttacaggggctgtttggcctgcaaagttcaaaacatttactctctggcccttttttgttattccctgctatatcctctgacttcctagaatcaggaaattgaatgtaaagacttgattaaatttccattcagctgtcaggtgattacttcagagctggtcgcttcatgttgcatactgcctgggtgccccattttcaggggtagtgaaattcattcaggctcaggcagcattatagactgaatgtcccccccagattcgtatattgaagccctaattccccaaggtgattatatttggaggtagggcctttgtggagataattaaggtgaaagagtggggccctaatctgatggattggtgtccttataataggaggaggctgcgcatggtggctcatgcctataatcccagcactgtgggaggccaaggcaggtggatcacatgagatcaggagttcaagaccagcctggccaacatggtgaaactctgtctctactaaaaatacaaaaatgaggccgggcgcagtggctcacgcctgtaatcccagcactttgggaggccgaggtgggcagatcacgaagtcaggagatagagaccatcctggctaacgtggtgaaaccccctctctactaaaaatacaaaaaaattagccgggcatggtggcgggcgcctgtagtcccagctactcgggaggctgaggcaggagaatggcatgaaccctggaggcagagcttgcagtgagccgagatcacgccactgcactccagcctgggtgacagagcgaaactccgtctcaaaaaaaaaaaaaaaaaattagccaggcatggtggtggacgcctgtaatcccagctacttaggaggctgaagcaggagattcacttgggcctgggaggcgagatccgccgctgcactccaacctaggtgacaaagtgagactcctcccaaaaaacagaaggagacaccagagagctttctctctgccactgaagatagccatctgcaaaccaggaagagggtgtcaccagaaccccacaatgctggtagcctgaacttagacttccagcctcaggaactggagaaaataggtctgttgtttaagccacccagagtggtgttttgttatggcagctggagcagactgagacaggtggcagccatcgaaaaccgcattgtaaagctacaactgtgtattttccagtagcaagaattagcatcctgtgactatccaggccccatcagcctctcctttaatgccatccatcaacaatcattgcctgagtcagctatttcaccagaggttgcaaaatggcagttttcctattctcccatttctcttacacttagtctgaataatttggtttttgtcttgagtcatgtccaagaagcagttgaagagagtgacttaatcaaacttccattctgaaaagcccccctgaggctggtttgtcaaggaatagactgaggaagaggccaatttctccaagcttcaattttcctacctattaaatgagcaagactgggcgcggtagctcatgcctgtaatcccagcactttgggaggccgaggtagtagatcacctgaggtcaggagttcaagacccagcctggccaacatggtgaaaccccgtctctactaaaaatacaaaaaaagtatctaggcatggtggtgtgtgcttgtaatcccagctacttgggaggctgaggcaggagaatcacttgaacctgggaggtggaggttgcagtgagtcaagatcgtgccactgcactccagtccgggtgacagagtgagactccgtctccaaaaaaaaaaaaaaaaaaatacttcagtcctggtgacagtgagactgtctccaaaataaatacatacatacatacatacatacataaaataaaataaatgggcagaacgtggggaggttgtcatgaggaccgaatgtgttcacatgtggaaagtgcttcccacaaggtctgattcttaaggggttgaaggatgtgatgattacttctgttcttccagtgcttctgtgattcacatgttactaatgaattattagtgtattaatggcatgatgtcatggctgcatggttagttcattgctaacccacctcccctggccctaggattggaggtggttcattgattctatcatgacatctctgagacctcccaggtgccaggcaatgctgggacccaggctgaagttcaacccaggccccaccaaccagggcccctactctggagccgaaataccgagggacgggctgtaacggaggtagctcagggcacggtcaagtgcaaggagaacctaactgatcccggagaggcaggcttcttggaggaggcaaaccttggcagtgctctggaggagaaaggagacaggatttcaggggaggacaagacacacactagctgtctgatccactcccagagttcagcacagtgcctgaggccgcctgcagccagctggcacagtggatggtcaaagccacaggtgcttggatcaaacacagctgtaggactcactagctgcataacctagggcaccgcctctgtgcctctcttcatttatagcaactatttgaggtgctgtgatattcagtggagtgttgtgatattcgaccgtttgaggtgttatgatattcagtaaaatgcttagagccagggtctgcttcagagccgggctttttttttttttttttttttgagacacagtcttgatctgttggccaggctggagtgcagtggcccgatcttggctcactgcaacctctgcccccaggttcaagcgattctcctgcctcagcctcccgagtagctgggactacaggcacctgccaccacacccagccaatttttgcatttttagtagagacagggtttcgccacattggccaggctggtcttgaactcctgacctcaggtgatctgcccgccttgggctcccaaagtgctgggattacaggcgtgagccactgctcccagccatatatatatatatattttaaagtatctccaatgaaaatttagcatctgatggccaggccaatgtggtgaaaccccatctgtgctaaaaatacaaatataaaaatacaaaaatgagctgggcatggtggcacacgcctggaattccagttacttgggaggctgaggcaggagaatggcttgagccctggaggtggaggttgcagtgagccaagattgcactattttgcactccagactgggcaacagagcgagactctgtctcaaaaaaaaaaaaaaaaaaaaaaggctgggtgcagtgactcatgcttgtaatcctagcactttgggaggctgaggcgggtggatcacctgaggtcaggagttcgagaccagcctgcccaacatggcgaaaccccatctctactaaaaatacaaaaaattagccaggcatggtggcgggtgcctgtaatcccagctacctggaaggctgaggcaggagaatcacttgaatcggggaggtgaaggttgcagtgagccgagatcacaccactgcactccaccctaggtgataaaagcgaaactccatctcaaaaaaaaaagaaaaaaaaaagaaaatttagcatctgaattactgaaattactgagatgtgctgaaagagtaaaatacattctggatttcaaaggctacaaataaaggaatggattggcttttttttttttttttttttgagacagagtctcactctgtcgccaggctgaagtgcagtggtgcgatctgggctcactgcaacctccacctcctgggttcaagcgattcttctgcctcagcctcccgagcagctgggaccacaggcgcgcaccaacacacccagctaatttttgtatttttagtagagatggggtttcaccatgttggcctggatggtctcaacatcttgaccttgtgatccacccgtctcagcctcccagagtgctggcattacaggtttaagccaccgtggccagcctgattggccttttttctgagattgtgactttcctaggaaaactgacagttgtcacctagttaaaaggaatggctccagagcctggctgcctgggtctgagtcccagctctgccatttcccagctgggacatgctgtgagcctgtttcctgtgctgtgaggtagggattatgctgacatcggtcgctcctgctctttgcctgtttcctctctgaaatgctggtgacagcagatggcagcagtctgctttgtagtttgaaattggacctaccaaagagacaatatagtgtggggcaggagagctcagctttcagagtttgtaaatcctgaaactggctattcttccacccttggttggaggcgctcacgctttctggtctcaggatcttaaaaatcactgagttttaaaaatcaaagagtttgccgggtgcagtggttcatgcccgtaatccttgcactttgggaggctgaggtgggcggatcacttgagatcaggagttcagaactagcctggccaacatggtgaaaccctgtctctactaaaaaatacaaaaaaaaaaaaaaaaaaattagctgggcgtgggcgcctgttatctcagctacttgggagtctgaggcaggagaattgcttgaacccaggaggtggaggttgcagtgagccgagatcacaccactgcactccagcttcggcaacagagcaagactccatctcaaaaaaaacaaattaaattaaaaaaagtttaaatgctccctctataggtgttcctcctatttttggagggaaaatgtccccatctatgtagaaacctcagttcttggccacaaaacagcaagcaagctcatctctgggaaagccgaggtgcccagagccaaatactgcagagggtcaagggagttgacaactaagaatagagtggggaatgtgtccatgaaaaggtcaccgtgaccttcatgagtggcagttgtgggggctggggagcggatggcaggtgaggggaggcaacaggtgttggacgttcactgagaagcttgggggtcagggggaagtcggaggaggagcctggcatgtggaggggaccctgggtcaagttggggtgtttgatcaaggtcgcccttctgcaagcagccctggctgcctcagggggcacattgatcgggaaggggcgtgagggggtatttagcgtgataggaaggttctgtatctccatagggtcgtggtcacaagggtgtatacatttgtcagatcgcatccaactgtaaaggtctttgctttgattctgtgtaaatatacctaaaacccaaagagtggcttctgagaagacgccagtagggggagagagagctccatagctcccagaggtttgtgtttcaagttttgaatgggaaaggcaagtttttcaaagcaaccagaagggggcgatagagatgaagttgctttttacatcggtgggacccttggttgtgctccccaccccaacttctggatcctacttgcaggctacttgagagcaggagacaatctttcctgaatgcaactaatatgtgtcatgtggagccttttgtctgcaagagttctttatattttattctttctttattttttgagatgagtgtctgtcacccaggctggagtgcattggcacagtctcggctcactgcaacctccgcctcctgggttcaagcgattcttgtgcctcagcctcccaagtagctgggattacaggtggccaccacgactggctcatttttgtatttttggtagagacagggttttaccatgttgaccaggctggtcttgaactcctgacctcaggtgatctgctcacctcaggcatgagccacctcgccccacctgcaagtgttcttttttgttgttgttgttgttgtttttgttttttgagacaaagtctcactcttgtcccccaggctggagtgcgatggcgcgatcttggctcactgcaacctccacctcccgggttcaagcaattctcttgcctcagcctcctgagtagctgagattacaggcgcctgccacctcgcccggctaatttttgtatttttagtagagacgtggtttcaccatgttggccaggctggtctcaaaactcctgacctcaagtgatccgcccacctcggcctcctaaagtgctgggattacaggtgtgagccaccgtgcccggccaaatgttctttaaaatgtatcattgtaggccaggcacggtggctcacacctgtaatcccagcactttggaaggccgaggcgggcagatcacgaggtcaggagatcaagaccatcctggctaacatggtgaaaccccatctctactaaaaaaaaaataaaaaaaattagctgggtgtggtggcaggtgcctgtagtcccagctactcaggaggctgaggcaggagaatggtgtgaacctgggaggtggagcttgcagtgagattgtgccactgcgctccagcctgggtgaaagagcgagataacgtctcaaaaaaaaaaaaaaaaagtatcattgtatgcacagtagatttcctgtgcctacatggtattgagctcttgttttactcttttctcactaagcattatgatttaaagatcctcccaggccgggcgcagtgggctcacacctgtaatcccagcactctgggaggccaaggcgggcagatcacgaggtcaggagttcgagaccatcgtgaccaacgtggtgaaagcccatctctgctaaaaatacaaaaattagccaggcgtggtggtgcaggcctgtagtcccagctactcaggaggctgaggcaggagaatcgcttgaacctgggaggcggaggttgcagtgagccgagattgcgccactgcactccagcctggtgacagagcaagactctgtctcaaaaaaaaaaacaaacaaacaaactattttttttttttttttagagatggggtctagctatattgcccaggctggtcttgaactcctggccttaagcaatcttcctgccttggtttcccaaagtgttgggattacaggcatgagccacggcacccagcctcttttactcatctttctattggagtggctgtaattttcttcttgatttgctggagtttcatgtaccatcagttctgctataatgcttattttgaaaatgtgaatttattccaatgcagttgatatatcagggaacaatttgagcataacaccaatttcacatttgcttatgtgcatccaaggtgaatccaggaaactgcactctgctataagtgtgtgtgtgggaatacacaaagcacacatacacggcacttcaaacaaataccaccaccgcagttccccgggtgttaggagccacacccatccacatctggtactaggactttccatcagatctcaaataaccctctttccaccacatcacagtaattcacaaggcgctccctccaccccacacccattgccacaacaaacttcaagtctttgtcaaggtcaactgccatatttttggagtatgttggtatgtcttaaccacctagcccgtgtgaaactgttctctccttttgtattctgttcttatctttttctttaagcatcaccgacaaagtttacgaggattgtgacacaatcctgttttctctgtaagccttgtggtttttgactgcaggattttgcatattgctgtgatttctatgaatgcatgccttatagtagaactgactattctacatattagtcccttgttggttgggtgtggtggctcatgcctgtaatcccagcactttgagaagccaaggtggccagattacctgaggtcaggagttcgagatcagcctggccaacgtggtgaaccctgtctctactaaaaaaaaaatgcaaaaaaattagccgggcctggtggcagacacctatcatctcagctgctggggaggctgaggcaggagaatcgcttgaacacaggaggcagagaggttgcagtgagccgagatcatgctactacactccaacctgggcgacagagcaagattctgtctcaaaataaataaaataaaaatgaaaatgatattagtcccttgttgattgtaggcattacaagtatcttctcccagtctctcactgatggcacattttccacagcatggtgcaggaggttccttgctgacccaggcacagctcagagccagtcccaggaagccctggggcaaagttgtgaggagtggctctctcatgttgttggaggtatatagacctgtgcagtctgtatggagagcaactagtaaattctaacaaaaaaatttttggggccgggcacggtggctcacgcctgtaatcccagcactttgggaggccgaggcgggcggatcacgaggtcaggagatcgagaccatcctggctaacacagtgaaaacccgtttccactaaaaatacaaaaaattatacggtgtggtggcgggtgcctgtagtcccagctactcgggaggctgaggcaggagaatggcgtgaacccgggaggtggagcttgcagtgagccgagatcgcgccactgcactccagcctgggagacagagcgagactccgtctcaaaaaaaaaaaaaaaaaagttttttggctgggcacggtggctcatgcctataatcccagcactttgggaggccgaggcaggtggaccacctgaggtcaggagttcaagaccagcctggccaacatggcgaaaccccatctctactaaaaatacaacaattagctgggcatggtggtgcgcgcctgtaatcccagctactcaggaggctgaggcaggagaatttgcttgaacctgggaggcagaggttgcagtgagccaagatcatgccgctgcactccagcctgggcgacagcgagactctgtctcaaaaaaaaaaaaaaaatagtatgtgtgtatatatatatatgtatgtatatgtatttatatttttaaggctggtcaagtgaaggagtggaagtggaaaggaacaaagaaatctgtagctggttgtgatcaattagttgtaaacattgctgcactcagcccagcctctaaccacattttaaatgcacacaccctttgaatcagttattccacttttaaaatttatcttaaaagcagggttgggtgcagtagctcatacccttcatcctagcactttgggaggccaaagcaggaggaccacttgagcccaggagttcaagaccaacctggacaacatagcaagaccctgcctggataaaaaattagctgggcatggtggtgcatgcctgtattcccagctacttgggaagctatggtgggaggatcacttgagcccaggagtttgaggctgcagcgagctatgattgtaccactgtattcagcctagatgacagagtgagaccctgtcttaaagaaaaggccgggcgcagtggctcacgcctgtaatcccagcactttgggaagccgaggtgggcggatcacgaggtcaggagatcgagaccatcctggctaacacggtgaaaccccgttttcactaaaaaatacaaaaaattagccaggcgtggtggcgagcgcctgtagtgccagctactcgggaggctgaggcaggagaatggcgtgaacccgggtggcagaggttgcactgagccgagattgcgccactgcactccagcctggacgacagagcgagactgtctcaaaaaaaaaaaagaagaagaaaagaaagaaagaaaaaaagaatttatctgaaaaacatccttggacacgtgctagacattgggtaccaaactgctttgtcatagtggacaaggatgtctgtccacaggtgtcaaatccaagagttgtgttcattcagggatgaatctgtagccacataaagaccaaggacgtgcctggtgggctgatggggaatgatgtccaagatggagtgggggttcccccgccattaatttctttctttctttcttttttttttcttttgagacaggttctcactctattgcccaggctggagagcagtggctccatcttggctcactgcagccttcacctcccaggctcaagcagtcctcctgcttcagcctcctgagtagctgggattacaggcgtgtgccaccacacccagcaaatttttatatatatatatttttttgtagagatggggtctcaatatgttgcccagactagtctcaaactcctgagctcaagtgatcttccagcttcagcctcccgaagtgctgagattacaggcgtgcaccatggcacccagccaatttctttttataacatgtacagagaagtacagaaagcataactgtctaacccagcgactttcagagcaaacacacccatgtaaccagcacccagatcaagaaacaacattcccagcctcccagatgctacctgtgcccctcctagtcacccccaccttctgcctcccaaaggcacctgacttttttttttttgagacagggtctcactctgactcccaggctggagtgcagtggcccaatcatggctcactgcagccttgacctccctgggctcaggtgatccatctcagactcccaagtagctgcgactacaggcatgcaccaccatgcccagctaatttttctatgttttgtagtgacaaggttttgctatgttgctcaggctggtctcaaactcctgggctcaaacaatcctcctgccttggcctccccaagtgttcatattacaggtgtgagccaccacacccacccacacataacttctggtgtagtaattactttgtgagtttttgaacgtcacatgaatgggatcatacagtaagttttcttttgcgtgtctggtgtctcgcctgcgtggtgtctgtgagattcagctatactatgggtatgacagtaggctgttgtgtctcattgctgggtgtttccattatgtgatatggcccagtttctttatctactctgtgctgacaggcatggggtagtttccagtttatgagccattgtgaatagggcagtgtatgtgtcttgtaaacaggtgtacccttctgttaggtgtatacgtgggagacgaattgctggctcataggactggcatatgcctggcttcagtagatactgacagttgctttccaaagtggttgtgctggtctgcactcccctgagcagtgcacgagggttctagtagctccatgtcctcgcctgcacccctctgtctaattgcaacccttgtggtgcgtgtggggaggtatctcaatgaagttttattttgtttttttttttttttttttttttgagatggagtctcgctctgtcccctaggctagagtgccgtggcgtgatcttggctcactgcaacctccgcctcccaggttcaagcgattctcatgcctcagcctccccagtagctgggattacaggcgcacaccaccacgaccagctaactttttgtatttttagtacagatggggttttgccatgttggccaggctggacttgaactcctgacctcaagtgatctgcccgcttcagcctccaaagtgctgggattacaggtgtaagccacggtgctcggccttcagtgaagttttaatgtgcgtttccctggtgactatattagtttcctatcattgttgtaacaaattactactaatttagtgttgcagtgtcacacctcatggagcctctggtgtacttgtgagagaatgagaatcagaaaggcaaataatgtcttagtattattaagacaacagttttgaccttgcagactgtctagaaatgtgttgggggaccacagggtcctaggacccacactttgagaaccactgatctagaagagtattggactcttatagcctaggaacaatgggaaatgtttaaaaggatttcctatccatattttttatttcttgcagagacatataacagggtgatcactaaagcaagtattttcaggctgggcacagtggctcacacctgtaatcccagcactttgggaggccgaggcgggtggatcacctgaggtcaggagttcaaggccagcctagccaatatggtaaaaccctgtttctactaaaaatacaaaaaattagctgggtatggtggcatgcacctgtaatcccagctacttaggaggctgaggcaggagaattgcttgaacccaagaggcggaggttgtagtgagctgagatcgtgccattgcactccagcttgggcaacaagagcaaaactcgatctcaaaaaaaaaaaaaagaattttcaagcacaaaagatatgatgtgccaggtgcagtggctcacacctgtaatcccaacactttgggaggccaggagttcacttgagtccaggagttcaaggccaacctgggcaacatggcaaaaccccatctctactaaaaatataaaaattagctgggcgtggtggcacatgcctgtagtcccagctactcgagaggctgaggcaggagaatcacttgagcccaggaggtcaaggctgcagtgagctgtgattgtaccactgcactccagcctggacaacagagtgagtccctgtctcaaaaaaaaaaacaaaaagaaaaaacgatgttagattaaaaatgggtggcagagagggaagtggaacggaaatacaagttcaaagagaaaaacaggacatgtataattttctgctgttgaaacagctttttcttgcatttttcaaatggtctcaaattattacagtatttagattccatcagctacacatttacgttgctggaaattgtatcctttgcaactgtttaagcttgggagaatttttaggtggcaacttagagatgagtgagacaagtatataatgttactagatcttctctcttctcttctttttcttttgacagagtctctgtctgtcaccaggctggagtgtagtggtgcaatctccactccctgcaacctgcacctcccaggttcaatgagtctcctgtttcagcctcccgagtagctgggactacaggcatgtgccatcacacccagctaatttttgtatttttagtagagacagggtttcaccatgttggccaggatggtctcgatctcttgatctcgtgatccgcccccgcctcggcttcccaaagtgctgggattacaggcatcagccactgcacctggccatcaacttctttgtttttaaatttaatagagatggatcttgctgtgttgcctaggctcatctccatctcctgggctcaacagtcctcttgcttcagcctcccaaagttttgggattacaggcgtgagccctgagcctggctctaaatcattttaagggataaaaaagcctgcaggggccaggcacagtgactcacgcctgtaatcccagcactttgggaggctgaggcaggtggatcacctgaggtcaggagctcaagaccagcctggccaacacggtgaaaccccgtctctactaaaaatacaaaaaaattagccaggcgtggtggcaggcacctgtaatccctgctatttgggaagctgaggcaggagaatcgctttaacttgggaggcagaggtttcagtgagccaagatcatgctattgcattccagtctgggcaacaagagtgaaactccgtctcaaaaaacaaacaaacaaacaggcatgcaggctgtttactggccaagcagtcttggtgaaagctgcccagcctctgtgggttcagggcttctccttttacaaatgaactccagaaaagtagggggctcccttcctcacaccatacacaaaaattaactcaaaaagtaaaagttaaaatgatcaaacccctagaagaaaacataggaataaatgtgcattatcttggcttaggcaatgtctttttttttttttttttaattgtgacagagccttgctctgtctaggttggagtgcagtggcatgatgtcggctcactgcaacccctgcctcctgggctcaagtgattctcagtgcctcagcctcccgagtagttgggattactggcgtgtgccaccacgcccagctaatttttgtatttttagtagagacggggtttcaccatgttggccaggctgatcttgaactcctgaactcaagtgatccacctgactcagcctcccaaagtgctgagattacaggcgtgagccactacacctggtctgaaaccactttaaaagggttaattttatggtatgtgaattgtgtctcaataaagtcatttaaaagggtgggggttgcccttaagtatggggaatgatcaaaggtatcaaagtaaggtggcaaaatgttgacagctgctggaccgcaggacatgggtacatcatgggggttccttatactattctggttttgtatgtgtttgaaaacttacagaataaaaaaagctttgctttttgaattgagctccagggttctggggtcttctcttcctcctttacctgcagtgggagtggaggtagctcttcccctagacacagagccctactctgacctgccctctgatcggtcgatctgagacataatcacagctgctagatccagtcgctagtggactggcaggcagcgattgggtcaagccttagctaagtgtcaagccttagctaagtgcccagccttgagccaatcactgggctggtccacgccttggcctcagtcagagcttacagatatgagaggggaagggaaggtggagtggattcatcaacaatagtggcccccttggtgtctttttttttcccctccattaaatggcacagccaccaccctagctaatctgaagtagtggctagaatttgaactctggtctctcaccctcttacctccaaacaaagagttttgttgttaaaggtgctattttcacatataaatgagtctaggtgagtctggaaggaggacttcctggaggaggcctggcgaccacatgccctccctctcttccacctcaccccccttctccgcctccgctttcccatcaaggggggcagatcagctctgagggctgcagaggtcttccctgtgctgcctgcctccggtaaccacagtcctgccactgtcccttcctccctaggatgacgcggcatggcaagaactgcaccgcaggggccgtctacacctaccacgagaagaagaaggacacaggtgcagggctggggtgggaagaggcgggacatggctgtgtcttggagtcaccctctcccctcgtgccccaggttttgcttcctctgtccctgtctctctcccgcccccgatatacactgatggccatgaccatgtaaacaacagctgggtgatcccatgaccccatgtggcccggcactgtgttctctgccttctgcgcatgaactcactcctcccaacagagtgtcagggagggtgctcttgttaccccatgttccagaggaagaaactgaggcccaaagagggacaggcacttgagcttggtcacagtcagaagggtggaggggagtcagccgtcagcccctccaccaagctgccactcagtgaccaggcctgtctgcctctcaccctccagggttgacaactccctgtgggttcagcccgtggccccagcacacaggcagcggctcccaactgcctgtttctctctgagtcccccacccccaccaccgcgttgtctctgtgcctctctctggggctttggagacggacatgtctcctgttgctccgcccctccatcactctgcccatctctgtccccagcggcctcgggctatgggacccagaacattcgactgagccgggatgccgtgaaggacttcgactgctgttgtctctccctgcagccttgccacgatcctgttgtcacgtgagctgggaacagggatgggtaggtctgggtggggagagcaagggaaccgccaggaggaggctgtgtgcgtgggtctggccacctgcacagccagggaaccctggatgagcagtttatcctcagagcctctgtattctcacatgggacatgggcatgatcctagcatctgtttcatagtgtggaacatatggaaaggaacatacttctaatggggtgtagggctctcagagcattgccgaggccatcggagcagctcacctttggacacttcccatgacctacctctgatggtagggcaaaggcttaacaggtgctgagtccaggcactaaatacgtgctcaattagtggtatattttgtagaagacagtaattaatgatcagggcccccaaggccaccttcaggtttcttttttttttttgagacagagtcttcactttgttgcccaggctggagtgcaatggggacatcttggctcactgatatcccaggctcaggtgatcctcctgcctcagcccccacgagtagctggaaccacgggtgtgcactaccacacctggcgtttttgtttgttttttgtagagaggggagctcactttgttgcccaggctggtctcgaactcgtggctgcaacaatatgtggcacacattgttgctgagagaatgaagcactttccctgcagctctattgggagaggacagctggaagctcaaatctagtctctactagattctgccccatgtgcctttttcctttgctgattttaatctgcatcctttcactgcagtaaactatcaccatgagtataacagctttgctgagttctgtgaattctagcaaataattgaacttgggactgatcatgatgacttctgcctataatcccagcacttcgggaggccgaggcgggaggatcactttctttctttctcattgcaccctgtctttgcagcccagatggctacctgtatgagcgtgaggccatcctggagtacattctgcaccagaagaaggagattgcccggcagatgaaggtgatggggatggggaggaggcggcacacggaggcaggagcttttgagtctgagctcacaggcagagccactcagagccctctgatctcagttccctctgcctggtacaccattcccctcccctgcttccggccaaatccttctcaccgatttcagcccagatgctgcctcctctgagctcctgccagtccccaggatctgccccagtcacctcttctcttagcacttagcatagttgtagctgtacatgtggctgtctgacacatgcccactttcccttatggacttcgagttttcccaccctgtagcttaggtccttagtaaagatatgctaaatgggtcgggggtggtggctcacacctgtaatcccaggactttgggaggccgaggcaggcggatcacttgaggtcaacagttagaggccagcctggccaacatggtgaaaccctgtctgtactaaaaataaaaaaataaaaaaaaaaattgagccgggcatggcgggcgcctgtaatcccagctactcaggaagctgaggcaggagaatcgcttgaacccatgaggtagaggtcgcagtgagctgagatggcaccgctgcacttcagcctgggtaaccgagcgagattctgtttcaaaaaaaaaaaaaaaaaaaaagatgtgctacgtgaattgacatcacctcattttttctgggcctcagtttcatcgtctgtaaaacgggctgacggccaaatcagaggacacagcagggcacctgggaggtacacgcagatgagcattctcaaggcgtgttactgggaacccggcctggccttccatggacaaagccatttgatgggtaggaggggccctgtttgaggcacagtgggtctgtccccctcttcccctgcctggttgctggcgctcaggaaacactacaggtcacatgcttattgggctttttgtcccaagcaggtggctccccctgtgcccatgtcctccacacagcctggtggtcatgtcggaggccctcatgagcatccatcactgtcactgttacctcctcactcagctgggtggcccagggtggtctggaactgcagcaccgcccaggcaactgctgtgcgccaggcagggctgagctcaggtcatggcttcacttctcccgtcctcactcactgtccgtccatagacatgggctcctcagcattcccttagatctgaagtctacatcccccgtcccaaacacgggctggggcatgcactgtatagaaaacttaattggccagcaggtgacattaattaaatgcttagctgagtgccaggtgaggctctccatgctgtaaacactcaccttatgtaacccttcagtgagccgctgaggtgggtaaccactgttaggctgttttacagatgaagaaactgaggccaggagaggtcatagtgctcacttaggccacagagtgacagagatgggctttgagccctggcagtctggctatacaacgcagtaaggttcacacccacccagggtggcagttaccaccctctgccacatagtgcctccatcagagggtcccctttgtgggcctcagtttacctacctgtgaaatgggaggaagatacccccagccccacgggcagatgctcagcccactttccccgacgcaggcctacgagaagcagcggggcacccggcgcgaggagcagaaggagcttcagcgggcggcctcgcaggaccatgtgcggggcttcctggagaaggagtcggctatcgtgagccggcccctcaaccctttcacagccaaggccctctcgggcaccagcccaggtgactcaggttgggcttcttgtgggttggggggcggggcgccgcgggctgggcgggcccagggggcggcatctgagtcccttccttcccccacagatgatgtccaacctgggcccagtgtgggtcctccaagtaaggacaaggacaaagtgctgcccagcttctggatcccgtcgctgacgcccgaagccaaggccaccaagctggagaagccggtgagcccccacagcgccccggcacgcacggtgccagggcgccagggttccccaccgtcctcctcacgcacagggaccacgcgctctccacctgcgccagccctgcctactgagcccgcctctctctgccccttgcagtcccgcacggtgacctgccccatgtcagggaagcccctgcgcatgtcggacctgacgcccgtgcacttcacaccgctagacagctccgtggaccgcgtggggctcatcacccgcagcgagcgctacgtgtgtgccgtgacccgcgacagcctgagcaacgccaccccctgcgctgtgctgcggccctcgtgagtcacctgggaggggagggaagggaccactcgggaacctgcggggcggtccggctttggggccagtaggtccccaggaaggcccctgatcagagtctcccgccttcggcctcaccgtagtggggctgtggtcaccctcgaatgcgtggagaagctgattcggaaggacatggtggaccctgtgactggagacaaactcacagaccgcgacatcatcgtgctgcagcgggtaagagtcccacccctccccttcccccagcactccaaggccccgcccctccccttcaccccctccaaggcttcgtcccctccccttcccccaactctccaaggccccgccttcttctctgctctgtaaggccgccccccccccccgctttctcctgcaaggccccgcccttccccccctccgctctcctaggccccgcctcctccttccttttcaaggccccgccccttccctgcctccagccctccacggctccaccccctccacacgctccctcccaaggctcctcccctgccactctctaccctcttctctgcgccctgcgccctgtccatccgtacccactgcggtcgcctcgccccctccccaactcctactccttagccagcaacccgcttcaccttgacccgcttaggaatccccactaccacctggagccccactggtcacccccgggccggcctctacctcgtccttctctctacctcccccagggcggtaccggcttcgcgggctccggagtgaagctgcaagcggagaaatcacggccggtgatgcaggcctgagtgtgtgcgggagaccaaataaaccggcttgggtgcgc

SEQ ID NO: 38255 - DNA, 40492 bp, Homo sapiens
cctgctcacgagttcagggctcctgggcggccgccttttccagttccaggtgtgcagaagtgtcctctccccacgcgcggcgggctgcacttggtcgctggctccgagatcgcgcggggccgccggaagcccaagacggtaccgggggccgcagccgcagccggcgccgccctccgccctccccaacagcaggccgagtcccgtagcatccggtagggaaatggtcgtgctttcggtccccgccgaagtcaccgtgatcctgttagatatcgaaggtaccacaaccccgattgctttcgtgaaggtgaggggcggaagggagcggggatgttacttttccttaaaaacagttattattttttctaagtatttcaggccttgcattggagacgagggttaggagaggcggtgtggctgcctcttgtgtggaatggggaggaaggagagaaagcctgcggtgggttgcggggatgcttttcctcgcgacactagcttctccctcccccgcccttgcgcttggttggatccagatgggtgggaagggatggaagttgacgctaaaaatcaccgaagggcaggtaagccggggcggggtgtgacggtgcgggcctcgccacccggcaggtgtgcacccggtcgcttccgcaggtgagcgcagcctttctgctccgtcgggcctggtgtggcagcggcagcgatttaatggtccttaaagcttccgatctcaaaatggaaagactgaagtgtcaagatgacttttcaggtggccctggtgtcgggcaatcaaggttcctcttcgccccttcccactcttgctgttagtggccaaactgcacagtgtattattttactctgttaggcgctgtggtccatagcgctgattttttgagctataggacacgtctagattccgttcactttcctcagaaaaccacagaagcttgaagctcttatccagagcattccttctaggatgtcactgtgaaccagcacttgtctgcacctcagcttgcaacttagcggattccttctttattctttgtctgttagaataagcaaatatgaaatgttactttaatttttgaaagaattcctcgggccttgtctttttatttggctccctgaggtttaagaattcattgcagatacaagtacttcttagaggtgcttgcatgcacaataatagtcgagatatacaaagtatattaccaagtaggaaaaatccatcttccaagaaactgagcagcttgggttttaaattctattttagtttccatttttaaaaaaaattatctgtgaataaggcttttttttttttttctttgagagtctcactctgttcccaggctggagtggagtggagtggtgcaatcacagctcactgcagcctctacctccttgggcttaaggcatcctcctgccccagcctctcgagtagttgggactgaagggagagccaccatgcctggctaatttttgtattttttgtagagacggggtttcgccatattgcccaggctagtctggaattcttggcctcccaaagtgctgagattacaggcatgagccaaggcgcctggcctgaatgagtttcttgatgtaggttataatataaaatccatgtacacttttaggacaccaaacataacaacctttaaaattcttttagaagaatcacagtaccttgacatcttagcataggttcagaagaaatcgagtttagcattttctccacggtttttgtttttgttttgaggcggagtctcgctctgttgcccaggctggagtgcagtggtgtgagctcagctcactgcaacctctgcctcccagcttcaagcgattcttctgtcgcagcctctccagtagctgggattacagacatgtgccaccacacccagctaatttttatatttttagtagaagagggtttcaccaggctggtctcaaactcctgacctcaagtgattcacccacctcagcctcccaaagtgctggaattacaggcgtgaaccatggcacccggcctcttccccacgttttgttttgttttgttttgttttgtttgagacagagtcttgttctgtctcccaggctggaatacagtggtgcaacctctgcttccggggttcaagcgattctggtgcctcagccttccgagtagctgagattacagacgcgcaccaccacgcccggctaatttttgtatttttagttgaccaggctggtctgacctcaggtaatcctcccgtgtcggcctcccaaagtgctgggattataggcgcgagccaccgcgcctgaccttcccccacgtttttaatcacaccagagacctctgcggaaaatttcaggacaaatactgatgattgattaatttcctttttttttggattgtgacagagtaaccgctttcttggttttcagagaaaaaaggagtcctcatttttgtaatttatagttaacagctcactcgttccactctggctctctcttgctttctgcggtcatcaggagaccaaggataaggacaggagaggtagtgatgtggcattagatcattagatactaccgttttctgaaggtagatttggggagtaagaaacctcatacaaaatcaattttgcaacaaaacataatacccctcccccacctttttccccaagtgtgtcttctgctagatgacattatgagccacttcttggaatctttgtgtctgtggcagacttattctgaaatccaaaaataaaaatgtcttagttgcctaaataaatttttctgaatttgacgctaggcaatgtgcaatttcaatgcaggctgcaaaagaatgatttagggatcttgtttaaaggataatttcttgtgccctgtcctataataatatctattgttattaatattgttaatctattataatctaatctattattataatttgttagacatgaatttatcaaaaccatttttcctaaaagtatgtttaaaagaaagttaggtctgtgtggatgtttatggtaattatgtaaaaaaggattccattaaatgcacttttgggaaatgctagttagaatgagttcaaatagatttctttattgcaagacttctcagaaccttcggtatcatacatatatatacacacatacacactttgtgagatttcaagagagtgacatttcacaaatctacttgaacaaaaaacttttagtagagtatctcagtgactaatcttttaaacaccttttaaagagatgctgagttacattcttgaatctgagcacggaaaggttgagcatgggagttgaaagataatctgcttggagctttaaagtcagagtaggtgtgtgaacttgtagcccttccttctgtggaatgatggaaggaaacattgagtactgtatacgtgcagtactcaatccttgactcattctaaaagaccatgaggtgtatgtactgtctacactttacttaggatgaaacaaagcctctgaaaagttgaacaagatgcctgggatttgaactcagattgtcttattcataaaaactcttattttttccattactgcactcagccttggaaatgggatgctactgtttgtcctgtctcctttgcttggtggttgtgtatgttaaatgacacagttagtatgagagttctttaatcaatgtgaagtactgtgctataaaagtatatggtaacaagccaggtacggtggctcaggcatgtaatcccagcactttgggacgccgaagcaggtggatctcttgaggtcaggagttcgaggccagcctggccaacatggtgaaagccagtctctactaaaaatacaaaaagtaggccaggcatggtggctcataatcccagcactttgggaggccgagacaggtggatcacctgaggtcaggagtttgagaccagcctggtcaacatggtgaaaccccgtctctactaaaaatacaaaaattagccgggcatggtggtgggcacctgtaatcccagctactcaggaagctgaggcagaagaatcacttgaacccaggaggtggaggttgcagtgagccgagattgtaccactgccttccagcctgggcaacagaggaagacgctgtctcaaaaaaagaaaagaaaagaaaaaaaggaataaataattcaaaaattagctgggcatggtggcgcacacctgtaatcccagctactggggaggctgaggtgggagaatcgcttgtacctgggaggcggaggttgcagtgagccgagatcgtgccagtgcactccaacctgagtgacagagcgagactgtctttaaaaaaaaaaaaaagtatatggtaacaaatttcagtttatagcatgtctttgtgtcttgcctgaggatcatcaaaatttgttgggagtagagctgcagcagagcccagttttccttagatgttcccaccgcatctaaatccaccgccaccatccctgcactttaccgcaggacacatacctctggtgtttgttcttttttgtctttgtttttctgaagcagggtcaggctgtgtcacccaggctggagtacagtggcacgatcacagctcaccgcaacctcgacctctcaggcttaagcaatcctcctacctcagtctcctgagtagctgggaccacgagtgtgcaccaccatgcctagctagcttatttttattttttataaagatggggtttcacagtgttgcccaggctgttctcaaactcctggactcaaacagtcctcccatcacggcttcccagagtgctgggattataggcatgtgccaccatgtccagctaatttttaaaattttttgcagagatggggtctcactgggttgtccaggctggtaaagcatttttagaaatagtgaattcattcttgattatttaacagtcctctttatgtcctcttataatgtattttagaagataataattggggagtgttgcagttaacatctttcttatgaaaactgctatattaaattatggtctttttaggaagagagctttaaagtctgatagttatctcccaactttggttaaacatccatttgataagtagtattacttctattattgccagcattgagaagtgtaggatgcgcactctgcctgcacaatgaaacagctagaagacagcctacaaggaatggcacactggaagcattcttctacctgtgctatttattattgacaccagtaactgtaatagggtctctttccctatcttcattcagtctacggatttaggctttttcatccgcagggatgggctactaggatatgctttgtttataaaggtggtgatgaaggttaaataagatggaattcaaaagcctttgaaaattacgaagtcctatagaaacactgattataatgcaggaagtgtcagactggaggaaatagaaagtgcttatgaaggaaggattgataaggaaaagagggatcttacatttcctgaaacccaccatgctcccagttacgtctaccatggttactcccagtgacttctgctccttattgccctacccagaaatatgttaaaaataagacgcaggatattgttgatctctaagaatttgtggaagcactggaatggcagataagtagttgttgatgggttgataaacaactgcccccctctccccaaacttttctactgcttagggcagtgtttcccagctacattcatggtagtacgtgagaggatttttgttgactcagcttgaaacaaggtgaggagtctttggagaatcactgtcttgcgtatatcaagaggtggatggaggctagccttagccttggtggctcacacttgtaatcctagcactttggaaggccaaggtgagaggattgcttgaacctaggagttcaagaccagcctgcgcaatgtagcatgacctcgtctctactaaaaataaaaaaagttagccaggtgtagtggcatgtgcctgtgatcccagctactcaggaggctgaggtagaaggatcatttgagcccaggaggtcaaggctgcagtaagccatgatcgtgccactgcagtccagcctggatgacaaagcaagaccctgtctcaaaaaaaaaaaaaaaaaatggtggatagaaagcacctctggcctctgggaggaagctgtcccacctagctgggagggacctcacctaggattcaggagacctgggctgcctaccacatgagccttagacaatctgctcacccagccacctgttagttccctaaagctgggactgtcatgttcatcctgctctcacacagaatatgtcatcgtcgtcatcatcatcatcatcatcctatcgttgttggaacccaaagaatctgcattaagtaaataattcagtatgggcatggtggctcacccctgtaatccgaacactttgggaggcaaaggttggaggatcacttgaggctaggagtttcagaccagcctgggcaacatagcaagaccctgtcttaaaaaaaaattataaaaaaagaaagcacctctcactttgatttctggttccttatttttctagaaccttcagtattgtggcattagcataatctttccagcctaatcaatccttctttcctttccctcacatttaattgaatacctgtcatgttccaggatatggtagggatccagagtccttaagacccagctgtcaccctcaggttcctcagggaacctagaaaggaagacagttacataaataggtcgcctttgcataatcaaagtcctctgtagtctctcactggctgtgagatgagagttcaacaaattgggttttccaactttctatccctctctttacactttacatagctgaacatgcacattccaatcatgccctttcttgctgccaccattcttccagcttggaatgtcataccttttcgtctccaagtgtgggtcccatgcactcattaacttaaaaaaaaattacttattgtgctaagctgtgggaatatggaagtaagagctacctcttcttgtaaaggacctatttaagcaggaatttcaaagtcctttctcttcgtcctctgaactcattgtcagtaccatgtgtagtatttgctactggagccaatagctgacttgtgatgttggatgtgtgtcctctttttcaagctgtgtggaaggctcctcaagggcagagaccagagcctcacacagtgcttacacatcaggcatgctgtaacatgctgggtgatggtgatatgcattccggaatgggtgtgggagggactgggattcagtttcttccatactctgcaatccttgctatttcagatttcctcaaggtggtactctattatatttgaacaatttaactgaaagtgtttctagagtggcattagaattcattgactcaacatttccaaaacctacaagttatagaggatgaaaccagctgataatggaaattaaatgtcataaaagagaaaattttattaacaaaattaagataaaaagtgaaatatgttatttatagaaacttgcatctgttaatgtaagactagaggaaaggtttttctacccccccaaatattcttcctagaaaattagttcgccctgattataaaattgcagacaaagaagagtatgatatagagagtgaaagccctgatatgctcctgccatccagaggtgaccattaagagtttggtgaatattccttctgtttttttccctaggtacacagtaaagtcatacagatctttgaaagatatgtagtcagacttattgagtaaaaggggttgggcatggtggctcacacctgtaatcccagcactttggaaggccatggcaaggagattacttgagtccaggagttcaagaccagcctgggcaacatagggagaccccatctctacaaaaaataaaaaattggctggacatggtgatgtgcacctgtaatcccagctactcaggaggctgaggtgggaggatcacttgagcccaggaggtagagactgtggtgaggtgtgattgtgccactgcactgcatgcagcctgggtgacagagctggaatgcagtggcgtgatcgaaaaaataacaatttttaaaaggggcactgattttaagctataacccctatattttaaatacataggctggattttatcttgctcatacagacttttaaaatgataccctgtgtttagccctgaaaagtgcttacttcttctttgtctgatgggtcttaaaattttctatccttgcagcttaccctgtgttaccactccactaaagaaaacaaagtattcttttttacaataaaaggttatttttatatgaaactttgaatttcacatttatcaactcatttgattttcaaaactggttttgttggaggtgcaggtcagaagaggagtggaaaccaacctgccctaatcctattgcacccattttcccatcagctcactaaagagtcgtgtggaaagttggtagctttatcctcagaggccctcctggatcctctctggacctttcccaggtgataccatttcaggaaaatgggtttcttttcaaagacagaatgtctttaggacagaaaggggttgtttgccttctaggtatgtgcatgaggggttcatttcttagcttgattttctttccagtgattcatgatgtgaccttctaacaagttccttttcttaagtctaaaaagtgtggacctggtacccctttactgagtaaagagaaactaaggcatgcggtttggaaactaatggtaatttcagcattgagaccttggtgggactttggagctcacaatcagaccagtgtttgacagttaagcttgtgtatacttactccagctctctctggactggtcttgtatgggtccaagtcgttgtaagttcaggaaggtaattagatccctttgatgggggtaaagagtgggatctttacccccgatctgatactggggagattccaggcatctgactctataaactcaaaaagaaagacctgattggtaaactataatctcagtttgttaatttgtacttaacctttatgtgcctctgaaaaatggaggaagtagtagcaccaatttcacagggttattatgaagattaaaatgacattatcagtaagttgagtaaattttgagtgcttggtggtggcagtggtgagaagtgattggatctgaatatattttgaaggtagagctgatgggatttgctgatggattggttggatgtggagtttgagagaaagaggagtcaaagatgactctaaggtttttggcctgagcatctggaaggatggttctgtcatttactgtgatgtggagatgtagggggaggaggaggattaagggatggaatcaagagtttggtttcagatgtgtttagtttgagatactgaatagacatgcaagtggggatattgggtaggcatttggaaaaggtccaagctaaaggtaaggatttggggatcattagtataaatggtatttaaagtcatggaattaggtaagatcacaaaggagtgattatagatagaaaagagaagtgtttgtcatagtaagtgctcagtaaatgttggcagttactcccattactataactacttgaattattattgctgatactttataggaaatgttacagaactactgggtgaaccataatctctcattttctttgtatgaaacctctttggggaatcaaagctatattagaaatttccatagagaatatgctgtcaagatccagggagttagatgatcctggtgagtagtgctccttgaagtcattcacccgtgagagctggatggcttcaggtgttgggatttgataggcctgggtttgagtcctggctttactctgcaccagcagcgaaacctctttgaacctcagtgtcttcctctatgaaagaaggcttactttgcagggatgttaggcagattcaaggagatgaatgtgaatgccttcctttcccctccactgttaaggactaggactctgggccagtcaagttccctttctggaactcattggagatactctgtttcttttgtgctgcttcttaaaaccttactccaattactagccctcttgtactgataacaatcccttgttcagtgtgattcattgcacttaattagataacagtgtatcttttgttaattataatttaatctccttaatggggctatcttttgtcttatcagcaccacattgattaattcattttgaatgcacatgtgaaatctgatgttcattcctaagctttcagttttcaacctacaccccttgtatgggtccagccctgtttactcccatgaagacgaggacagtaggattttaattcctgagaccatgtggccccatgtggcagccagaacacagaaacttcttgatagctcctactgtggtcttcaggaagcctttttgaagagcaattctaataccacaactgctgaaactatctggcagatggcatggaccactccaaaaagtagcaattctcgttgttagaagtatttaaacaaagcttggtgtattagtctgttctcatgctgctaataaagacatacctgagactgagtagttgataaaggaaagaggtataatggacttacagttccacatggctggggaggcctcacaatcatggtggaagaagaaggaagagcaaagggatattttatatggtggcaggcaagagggcatgttcaagggagctcccctttataaaaccatcaggttgtcaggtgtggtggctcatgcctgtaatcccagctgtttgggaggccaaggtgggcagatcacgaggtcaggagatcgagaccatcctgtttaacacggtgaaaccccgtttctgctaaaaatacaaaaaattggccgggtgtggtggcaggcgtggtggcgggtgcctgtagtcccagctactctggaggctgaggcaggagaatgacgtgaacccgggaggcagagcttgcagtgagctgagatggcgccactgcactccagcctgggcgacagagcgagactgcatctcaaaataaaataaaataaagtaaaaaccatcagatcttgtgacagttatttactcccagcactttgagaggttgagatgggaggatcacttaagcccaggagttcacgacccgcctgggcaacatagtgagactgtctctacaaaaacaacaacaacaacaacaaaaataaatttaaaaaaccaaaaaagcctaatgtattacattttcctaatactattatcacagacatctggcagtaaacatctgtgggaaaactacatgggaaggctaactttaacagagaaagatgctaggtgacaagatcatcaaagtaagtgactttgagccagggaagaaaagtggctcagcacaaatgtggtctttcttcagactgatcatagtatagctgattcactacctgtgccgataaagctctattctcttgaagtcacagtgtagtcattctgattggaatttggattttgctaaattcttcagtcattctgcctcagataactagctcttcttgtccattgcatgtaatttcccctaagtttattcactggatacagcctttaattatttgtctttgtagggggtgattttatttaaaacactgtcagcaggccagcttggtggtggctcctgtaatcccagcactttgggaggccaagatgcgggggatcatcagaggtcaggagttcgagaccagcctggccaacatggtgaaaccccatctctactaaaaatgcaaaaatcagttgggcgtggtggcacacacctgtaatcccagctactcaggaggccgaggcaggaaaattgcttgaactcaggaggtggaggttgcagtgagctgagatcgcaccattgtattccaccctgggtgacagagcgagactctgtctcaaaaaaacaaacaaaaaaaacactgtcggcaatctatgattttttttttaacacttagttttgctaacttttagcactattaaggttatacatttttattgcagaaaagagatatgcaaaaaagtttcttttaatgtcataacccagagagaacctttgtaaacatttaagttcatgttctctcatattttgttcagtgtgttaaatatccccccgataggattatgctgtacatactgtttgtaacctgttttattaattatttgtatgatgtgatttatatttaggaaccatcaagccagttaattttgtttgttgttgttgagacagagtcctgctctatcgcccaggctggcgtgcagtggcgtgatcttggcttaccgtgaccttttcctcctgggttcaagcaattctcatgtctgggattacaggcgcgagccaccacacctggctaagtttttgtttttagtagagagggggtttcaccatgttggccaggctgatctcaaactcgtgacctcaagtgatcactggccttggcctcccacagtgctgggactacaggcggagccaccgcgcccgggcgtatgtctctattaatgttagagaataaaaagcaacataaatttatgtggggccggtcatggtggctcatgcctgtaatgccagcactttgggaggccgcgatgggatgattgcctgagtccacgagcttgagaccagcctggctaacatggcgaaaccccatctctactaaaaattcaaaaaattagctgggtatggtggctcacgcctgtagtcccagctactcaggaggctgaggtgggaggatcacctgagcccaggagacgaagttgcagtgagccaagatcatgccactgcactccgtccaaaaaaaaaagaaagaaataatagcccaccaatgggggctgggcgcggtggctcacgcttgtaatcccagcactttgggaggccgaggctggcagatcacgaggtcaggagatcgaggccatcctggttaacatggtgaaaccccgtctctactaaaaacacaaaaaattggccgggcgtggtggcgggcgcctgaagtcccagctactcgggaggctgaggcaggaaaatggcatgaacccagcaggtggagcttgcagtgagctgagattgtgccactgccctccagcctgggacagagtgagactccagtctcaaaaaaaaaagggaaataatagcccacaatattgcttttgtgttgtttaatttgttttctaaaaaatactaagttctcaagtactataaatcatttgcattgtatagttcccttggagggcttttgttttatttattatttattatttttatttttttttgagacagagtctccctgtcacccagggagtacaggctggagtacagtggtgtgatctcagctcactacaacttctacttccgggttcaagcgattctcctgcctcagtctcccaagtagccgggattacaggctcgcgccaccacatccagataatttttgtatttttagtagaaacagggtttcgccatgttggccaggctggtctcgaactcctgacttcaagtgatccacctgcctcggcctcccaaagtgctgggattacaggcgtgggccacggcgcccggccagaaagcttttaaagtagtttctttatgtagctgtactctcagcactattcttttttttttttttgagacggagtctcactctctcacctaggctgcagtgcagtggcacaatctcggctcactacaacctccgcctcccgggttcaagcatttctcttgtctcagcctccggagtagctgggactataggcgtgtaccaccacgccccgactaatttttgtttttttagtagagacggggtttcactgtgttggcctggcctctcagcactatttttaggaggtaccttttattacccgttttcttcaaaggagatgaataaatacggtaacaacagtttgatttttattaattctatgaccttttcattaaaacaaccacgtgaccgtaaagcatatccatatttgaacttctaaacatttacaaggcaactttttaaattaggtcttcgaaatttcatggctctttcagtaagcgatcactgagctttgcagagtaatataaattgctgcttgcacagtatcctctgtaacatctaatggaatttaatcatattcccctacaaggcaaataactctagttctatagccttttgttgtatgtactgctaaatcataacaactccctaagtgcctggtggactgaaaatattcgcacatttatttgtagaatcctgagtttattgtagcatatttgtcatactatagtattctgaaattatctgtaagtggattataactgaagttaaaacatttattgtcaatgggtactgtggtttatgcctgtaatcccagcactttaggaggctgaggtgggatgattgcttaagctcaggagttcaagaccagcctgagcaacatagcgagatcttgtctttacaaaacattttttaaaaaattagcaaggctaattacaggtggtgcacacctgtaatcccatctactcaggaggatgaggtgggacgatctcttgagtccaggagttcaagacaggagtgagctgtaattgtcaccactgcattccagcctgagtgacagatcaagactctgtctcaaaaaagaaaaaaaaaattcttataatgtatgatagtacatgccaggccatttaataagcaacttgaaggcattgtatttgtcttacagatattctcaataagtatgttgaaagattggataaaattttcacaatttagttgattatttcatgtacatacttttatgcagtaacacttttgcactaaaatagtaccgtctgctaacatgttgactgtaaatcatttgtttttttgtttgttttttgagtaggagtcccgctttgttacccagggtggagtgcagtggtgcaatcacagctcactgcagcctcagcctcctggggtcaagtaattctcctatctcagcccctccaagtagctgggaccacagatgtgcatcaccatgcccagctagctttttaattttttgtggagacagggtcaggctggtcttgaactcctgggttcaagtgatcttactgccttggcctcccaaaatgctgggattacaggcatgagccaccatgcccagcagcaaataatatttatagtccagatgttatactaaattctagcctcattgtctagcttttgtgatgacttagtacagtggcgcattttatagatgaggagaggggcatattggatgatcaggaactctaaagtaatctccaacttctaaggctgttctcgaacattcaatattgtttgaaaccttgcaccttttatttccttgagttctctgagaagagtggcttcataactccagtgtcctgctctctgtaggctctcaggaaagttgaatgaataagttggttgtgcttgtgatttatcttctgggaacttctctgctattatttatcatgaaatttgggtaatccttgctcagtttaactgcatgtgctggagaatatgttaagaatatatcaccaggcacagtgactcacgcctgtaatcccagcactttgggaggctgaggccggtggatcatttgaggtcaggagttcaagaccagcctggccaacatggtgaaaccctgtgtctactaaaaatacaaaaattagccgggtgtggtggcaggtgcctgtaatcccagctacttgggaggctgaggcaggacaatctcttgaactcgggaggcggagggaggttgcagtgagccgagatctcaccactgcactccagcctgggcaataaagcaagactccatctcaaaaaaaaaaaagaacatattaagtggtaagatgccaggtgctttccattagacagtgcaatcctccgatgactttgccttgtgttagtcctgtgtagcaaatgagaaaactgtggctcaggagcataagttgtttgaacacagctagtaaaaagcggaggtagaagcctgactgggaaagaaattcctaatgcatggattactgacaggttatttattactgaattgttttgcacatcacttttttttttttttgtgtgacggaatcttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcctggccaacggaatcttattctgtcccccaggctggaatacaatgatgggatctcagcttactgcaacctctgcctcccaggttcaagcgattctcctgcctcagcctcccgagtacctgagattacaggcacccgccaccacacctggctaatttttgtatttttagtagagacagggtttcaccatgttggccaggctggtctcaaactcctgacctcaggtgatctgcctgcctcggcctcccaaagtgctaggattacaagtgtgagccaccatgcccagctgcatatcactttcttataggatgctccaaaggtagtctagttaccaagaaagagtcatggtgatcaagtttgttttgtttttttttaaatacttgtcatgtatggacaccattcttttcagcagattatttgagtgatatgtacaataatgtggtatgcatgggggataaagctgtgagcaagacacatttaatccatatcctcaaggacctttggtctggccatctagttctgtagttgggagacttttcctgtaaaggaccagacagtgaatattttaggctttgcaggccctatggtcttggttgcaaatactgaattctgccattgtgatgcaaaagtagccacagacattatttaaataaatgagtgtggctatgttccaataaaacttcatttacagaaataggcagtggacttgatttggcctgcaggttgtagtttgccgactcttggtctagtttatttgtttcttggcctctgtctctctttcttgctcatattcacagcagcaattttcatagagttccattgatttatttgttacagttatgtaggtaagattgtggaagaactggatcttttacaactgataaaagctaactcttgtattttcttttactcttttatccaggacattttatttccttacatcgaagaaaatgttaaagagtatctgcagacacattgggaagaagaggagtgccagcaggatgtcagtcttttgaggaaacaggttgggacatttctgtcttaaattcccaagtgtcttagaaatgagggtacctggagatttaggacatgctctgagcattttgtaaaataagtgccctggtttgataggggatagaagttgcagtgacttagtgagttgcctgcttaggaattcacagtacataattaaaggctggatcatgtcagtttgttgtttctggagttgctctttggttgtttttttttgttttgttttgttttgttttttttgtttttttttgagatggagtctcacttcgttgcccaggctggagtgtggtggtgtgatcttagctcactgcaacctcgcttactgggttcaggcgattctcctgcctcagcctcccgagtagctgggactacaggcacctgccaccatgcccagctaattttttgtatttttagtggagattgggtttcaccgcattggacaggctggtctagaactcctgatttcaagtgatctaccctcctcggcctcccaaagtgctgggattacaggcatgagcttaccacccccagcccacccaaaaagggcttaagtttgcaaatatatgatattgttaggcaatttaaatagctctagaaaaaggcaactctaggctgggcacggtggctcacacctgtaatctcagcactttgggaggccgaggtgggtggatcactcgaggtcaggagtttgagaccagcctggccaaaatggtgaaacgctgcctctactaaaaatacaaaaaattaggccgggcgcggtggctcacgcctgtaatcccagcactttgggaggccgaggcgggcggatcacgaggtcaggagatcgagaccatctcggctaaaacggtgaaaccccgtctctactaaaaatacaaaaaattagccgggcgtagtggccggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaatacaaaaaattagccggacatggtggcgggcacctgtagtcacaactccttgggaggctgaggcaggagaattgcttgaacgtgggaggtgaaggttgtagtgagccgagatggcgccactgcactctagcctgggctacagagcaagactccgtctcaaaaaaaaagagtcctttctgggtagaatgcaaaaggttttgagcagtctctacattttttattaacgtctctatattagtctgttctcacattgctgtaaagaaatacctgagagtgggtaatttttaagaaaagaggtttaattggctcacaggtctacaggctatacaggaaacatagcggcatctgcttctggggagacctcaggaagcttctaatcatgatggaaggcaaagccggagcaggcgtctcagatggtgaaagtcaggagcaagagagtggggaggggaggtgctacacactttaaaacaaccagaactcactattgtgaggacagcatcaaggaggatggtgctaaacaaaccattcacgagaagtctatccccgcgatccagtcacctcccactaggcctcacctccagcactgaggattacatttcaatgtgcaatttgggtggggacacacatccaagccatgtcattctccatatgacagtacttcatcattttgcactccctccttccttactgcaagcccctgctgccccctctgcagtgctcctgggtcctcacactcacactccccttccagactcctcaccccagctcactctggcccagccctcatacctcctttggtctcctgtgctttgttctaccctcttctccccaccagtcatcagtctgtcttttccttccacattgtgtgctatggaactcctgctctgttgtttttcttgttaaaattgcttcagtggcaaagatcttacatggtctgcagagctaactcactggcagttattttctagttctatattggatactgtggaatgctctctgtggatgttttactgttaggaattaggattcaaaatgtagttatgtcctttgggcatggaatatttgggattttaattttctggataactcagggttaatctgaaatacagtgagtccttacttaatgttgtctttaggttcttggaaactaagtgaaatgacacttaaatttcaattttcaattttaaaccaaccataacaaaaccaattttttctccacataaatgttataacaaaatgatgttgaaggaaatgacattacttgagaaggtcatgccacttgaagtcacagtttccaagaacctttcaatgatgttaaatgaggacttactttactttcctcccttacctttttttgttgtcaaaaccttgttgaaacatacatacatagtcccccattattgtatataaatatgtacacatgtatctttagaaattggactgctttgtcacaaggtcattgttctaagtggctactaggatttttgcaagatgtgggagattataggagactgaatgtgaaccaacctcattacttcactagcttctttttgctgaattccaggcataaactaatttatgagattttctttgtttctttctccattagttatagtgcagagaaaattatcagattgagttaaagtcctggtttgttgatcccagtagtgaatcaacaaatcaaatcttaattctatcattatgtgctctctcttctcatatacaacatgcgtctcagtttaaatttcagcttttagcaaaaggaaaggtaatgtaaatttattaatccaggttcttttaggaatcatttgtatcagctccaaagtatatgatgtttcaatttgcagccatactagggctaatgatggagaaagttgttctgctgggtttttgggtctcgttttaaatgactgttttttgaataagcaaaaaacaaacatcatgttgtttctgacttaaaggctgaagaggacgcccacctggatggggctgttcctatccctgcagcatctgggaatggagtggatgatctgcaacagatgatccaggccgtggtagataatgtgtgctggcagatgtccctggatcgaaagaccactgcactcaaacagctgcagggccacatgtggagggcggcattcacagctgggcgcatgaaagcagagtatgtgcttgagtcagcctaaacatttcaccagtcccaaatccaaatatgttttttcaccagtcctctctttccagcgtaagtcacaagactggtaaaacagataaaaatccacactctttttagtctaacaagtgagctttgtttcattttttcaaaacttggctaaaatatttcagctgactagattacccggacctgccagtctggtcttgtgggttgattgaaggacttgtcaaagtctccgtttaaaatagcttcctagaaaatggtgacttccttgaactaagtcatatttgattcttagcacatgagtgacagctccgttgggctgcttgcctggactgttaattacctgctttttgctctatgagacataggaaattttgtgccccaccgtgttgaggttactcagaggatgtccgcactaccacgttcttctttgctcttttgagcaacttccacagattctttgagtcttggttatggagttcctaatagcactcctgcctgaggagacttttgagtattatacttactgagaaattcttgattgattcagacagggtcctactctgttggctggagtgcagtggcatgatcatggctcactgcagccttgacctcccctagttcaggtgatcctcccacctcagcctaccgagtagctgggactaggcatgtgccaccatgcccagctagtttttgtatttttagtacagatggggttctaccatgttgcccaggctagtctcaaacttctgggcttgagcgatctgcctgccttggactcccaaaatgctggggttacaggcgtaagtcacaatacctggcctatttttttttttttagagctggggtcttgctctgtgatccacactggagtgcagtggtgccatcatagctcactgtagccttcaagtgaacctcccgcctcagcctcctcattagctgggaccacaggcacgcaccaccacacctggctattcaaaaaacatttttgtagaggtgtggtcttgctatgttgtccataccatattgctgataaattcttttcgtttgtttgtttctgtttttgctttgagaccgagtcttgctctttgcccaggctggagtgcagtggcgcaatctcagctcactgcaacttctacctcctgggttcaagcgattctcctgcctcagcctctggagtagccgcctgccactatgctaatttttgtatttttagtagacatggggtttcaccatattggccaggctggtcttgaactcctgacctcaagtggtccaccccatctcagcctcccaaactgctaggattacaggtatgagccacccctcccggcctatttttgtttttggagatagtctcactctgttgtccaggatggagtgcattcacacaatcttagctcactgcaacctccgccctctgggttcaagcaattcttgtacctcagcctcccaaacagcggggactacaggtgcgtgccaccacacctggctaattttttgtattttagtagagacagggttttatcatgttgtccaggctggtcttaagctcctgagctcagggcagtccacctaccttggcctcccaaagtgctaggattacaggcgtgagccactgtgccaggcctgctgagaaattctttttttttttttttttttgagacggagtcttgctctgtcacccaggctggagtgcagtggcgtgatctcagctcgctgcaagctccgcctcctgggttcacgccattctcctgcctcagcctcccgagtagctgggactacaggcgtgtgccaccacgcccggctaattttttgtatttttagtagagacagtgtttcaccgtgttagccaggatgctctcgatctcctgaccttgtgatccgcccccccttggcctcccaaagtgctgggattacaggtgtgagccactgcacctgggtgtgaaattcttaaggattttaggccattgcctgctgtaaaccctaggatccaagattgtttccagctgcatatatttcttttgtgtttctgtcaaatgagatgttgtttctttatttatgtactttacgaggagcttctaccttttaaaggatggactggaatttcaggatatgccagtgatctgggaatatcagccaggttcactttgtaaagcactcaaaaaagtggagacaggagactgtgcacccggtagttagcccatacttctcttggtcttggttccttaattatacaactaactgctgaagacaggaaaaatcctgtctccatgagtgcaaactagtactcagaataacatacttacatgtgtactggttttgaatacgttgatctctttccttcaattagtgcaacatgttaagcatgttaatacatataaagcggaagactccactgacattttccaggtaatcttttagagatgactggttctacaacccaagttctttgtgcttctcttttcacctttctcctgtgatgttaatttcctccatgactatggaaaacactagaattggtaagagagactgagtgtcagaagtcagaaaaagacatcttttgctgactggttaatgtgagttggtacaagtctcaactgacttgttatgtaattttttccccatataataaaacattgttttcttagttctcaaaaaatgcaggccgggtgcagtggctcatgcctgtaatcccagcactttgggaggctgaagtggggggatcacttgagtccaggagtttgagaccagcctgggtgacatggcaaagcaccatctctacaaaaaattaaaaaaaaaaaaaaaaagctgggggtggtagcacatgcttgtagtcccaactacctgggaggctgaggtgggaggatcactcgagcccaggaggtagaggttgcagtgagctgagatcatgccactgcactccagcctaggcaacagagcaagaccctgtctcaaaaaaaagtaattccattttctagctaatcataagtttatagctttgagccttcaaactttgttttgattattttgggtgcagatctttctaaaagcatttccatgctttcttaaagcacagtggacataatttaaccttttcttgtcatgaagaacatcaaagattatattatatcattgctgttgtttgcttttttgagttcttcgggaatttaaaaaacactttcccatttcatccttttatctgtagtccctttttactgtcactagtggctgtctgttcaaaactatcctcctttccacatagattgttgcttctaatctgctgtgagcctggaacttgggcagtatgtttattagaactgcaggagtttgtagtctcagggagctgcttctcaggttaccatgtgggcacaaagagagaaacatatggcatctgttttgacaggtttttatctggctagatgaggtgttcctgtattttaacttagtggtcttccctctaggttctttgcagatgtagttccagcagtcaggaagtggagagaggccggaatgaaggtgtacatctattcctcagggagtgtggaggcacagaaactgttattcgggcattctacggagggagatattcttgaggtaggttacctagtttactttgttgttttgacgctatcaaagcataaaataatgaatcttaatggaaaactaattggaactaatagaatgcttttttttttttggttgtttaaaattaggtaagaagaaaataatcacttttaattatattgtatttacagtttcttctatataaggttgttatataaagtttattctgtgtcttgaaaaataaaatcagttaggatgcaaaataggattgtgcagtcctgagaaatatataaagactttttgaatacagcagagaacaaggtgcactcatttgtttctggctctttgaagaaatatagatttcatttaagaagaaccagcattattataggagaaccaggcacatttttaaatgtaataaggtcgtcacctgttgcatttcatgtacatgagaaaattcttgctagcccctctgtgtcatcatccctgcaccccctggaggatggggtgatcagtgaaagaagtgactacatttagggttttaaaaagaagtgctgattagctgaatatagaccaaacttaacaataggtaacttggaatatagacttaacttaaaataggttacttacaataggtaacttgaccagatactttttaaaaataaatatttaccggccgggcgcagtggctcacgcctgtaattccagcacttttggaggccaaggtgggcggatcacgaggtcaggagatcgagaccatcctggctaacatggtgaaaccccgtctctactaaaaatacaaaaaaaaaaaattagccggacgtggtggcgggcacctgtagtcccagctactcgggaggctgaggcaggagaatggcttgaacccaggaggcggagcttacagtgagctgagatcgtgccactgcactccagcctgggcgatagagtgagattccatctcaaaaaaaaaaaaatttacttattttaacttacaataggtaacttgaatatagaccgaacttataataggttacttacaataggtaacttggccagacaagtttttaaaataaatatgtattgagcacctaccatgtgcaaagaacactttggctttggaggttgtaatattctaattttagtattttcctactttctgtcttatttttaaatcaaatattaataatgaaaccctttaatcattggtgactgttctcttaatacagatacaacttcttttctgctctctctgacaatcatgacaggacaaaagtacctactgagttcactaataagaattttactctctagttaccaagtgaggcaaactgcaagaaaaagaaaataagcaaaatcagttttaactttaaaaaaaaaaaacttaaaattacttttttttttttttttaccttcccattggccaaacccagtttgagtgcttactatgcttgtttttagtttgtgaaaagttctgaaaacattcaaaagatcacatcttagtaactgaccctaaatatggacttattttaattactgttggtcaaattagcaagttacagatttgactccaattgtttccaagagggcagagacatagacgagcccttgggtagaatttcaaaacgttttaactagaaaatgagaatttcttgtaagtaaaataatagcttattcatgaggcaggttagagaaattttttcatcgtaagattaaaggacagtgttcagaatctttcatcaggagtaaaattcaatccagtgagtagtttgagtgcaaatcatctttaagggtaggatgtagggcatgtttattttaaactatttcagatgtaaaatgaacggtagtgaaaaccaggtagattatgaaatgatcttatgtatgttgagctggtagttttcttcttccaaatgtctgttgctataaaatctttatttttactttgtatagcctccataaagttccctattaagtagattttcagaaaatactgaacgaatgaagtaattgtgattgtcatgtatttcagagaaaggcatgaggggcatgcaagtgtatttgtattgccagtctttccccttctctttgttcagcttgttgatggtcactttgataccaagattggacacaaagtagagagtgaaagttaccgaaagattgcagacagcattgggtgctcaaccaacaacattttgtttctgacagatgttactcgaggtgagtaatagacttcttatattatatactccaggatatgaactgagcctggcactacaaatacattgcctctttaaagaaactttatatggggatccttgaaaaataaaacagttttacggttttatataaagaaacagtgtctggttcaagttcatgtttgaattaaaaaaaaaaaacacagcagtgaaggcaggcttggtggctcatgcctgtaatcccagcacttctgtgggctcaggcaggaggattgcttgaacccaggagttcgacactagcctgggcaacaatgtaagacctctgtctctacagaaaaattcagaaagttagttgggtatgatggctcactcctgtggtcccagctgcatgggaggctgaggcaggggcatcaggtgagcccaggaggtcgaggccgcagtgagccgtgtttgtgccactgcactccagcctgggtgacagagcaagactgtctcaaaaaagaatgaaccaactctgggggttgcatgtggggaagtggcattgaaaagactaactcttctcgtttaactccttgtccgtgatttcccagccatcgctatgtacacacacacacacactatgacacaggaaattaacaggaagacttagaggagttgtcatgggaaggagcatgcaagcggggttgtgagtataaggggtaggtagttgagccagccagttctgggattaaatgcacagttccatttgtgatccccggacctttgctctatctcaatattaagaattataacccctgtccttagaccacttatagtttcttcatattcttgtgtttagccacttaatttttgtatttgggatcacatagtacatctataatttcagatctttctcttctcatttaagccatttcctcagttgcaattgtagaaattattcctaattttggagaatagaaataatccctaaattggcttcaaaatgaaattagctccctttgattctctgtaaggaggttttattcctgcccttcatcttctgctggccccatacacacttaggccagaacttgggtcatcggcagctgggatgaggcagggagctgtctgcctgcttgctcttttctctctggtcctgttttggtaccacatgcccagacttccactgctgaggcagaatgaaaaactaagttaatatcccaaataatggctgggcgcggtaactcacacctataatcctagcactttgggaggccaaggtgggtggatcatttgaggtcaggaattcaagaccagcctggccaacatggtgaaaccttgtgtctactaaaatacaaatattagccaggcagtagtggtacacgcctgtaatcctggctactcggctgggggctgaggcaggagaattgcttgagcctgggaggcggaggttgggatgagccgagatcatgccactgcactccagcctgagcgacagagagagacccttctgaaaaaacacaataaaataaaaaataaaatcccaaataatacccaagtatgaaaaagtgtctcagcattacaacagtagagcaaatagatgcttagggataaaacttgccctgcagtgaattagataaaaagcctgaatatggaacggccacttgtagtgtcaagtcccatgtggattgtgatggcttaacttggtcatattcccgggttgccagtcacgatgaaaactttgctcagggcagtcaggctaggaagtaggggtgagtggaagatagctgcctttctccaatggcatctgcagaggtggtctgaagaagacattcccacacagagaggggagtcttgagtactgtttgctctgggaaagtgacaggccctttcacaggcagaacagaaagcaggcacttgaggaggtgggtgggtggaagaaacagctcagccccagtgtgtctcctgggaacttaactctctcagcacgactgcccttcagttaatctgttcaggtgctgtgactcttctccaaaggctgagaaactaatggtgattactcttacaccaaatctaaattccacgggatttatatatatatattccagatttctcaccagttttgttctatctgtcctagtaagcgccatctctcttatcacaggcctgtatcccatttcccactctaacttgctccattctaggctgggagtatgacatgtttagggtctggaggtaagagcagatatcttgggctgattaaaccataggattccatttgtcccattatcttctttgtgtttttatttttttgatacagggtctcactctgtcacccaggctggagtgcagtagtgcgatctcggcttgctgcagccttgacctcctgggcttaagcaatcctcccacctcagcactcttgagtagctgggactacaggcacacgccaccacgcccggctaatttttgtattgttttgtagagatagagtttcaccatgttgcccaggctggtctcgaactcttggactcaagtctggcgttcaagtgaactcctgggtccaccgtgcccagccccatatcattttaattcgtgttaccaacagcttgtcctttgggaaacagctcagttctcggtatgggctgatgggaggaagtggaggaaaggtgtaggacagaacatggctccatccttctgcattcataagtacttaataaagctcagaagtgtaggatacactgccattctcttctgtcaagtacagttacgtattttttaaaattttatcatggaaaaattaaaacatacataaaagagataataatatagtcaaccccagggtgcccatcttttagcttcaacagtcatcaaatcagggccaaattcatttcttccatccccacatccccctgctgactttgctgcaaatctcagacatcattttttggtgtttctgacacacacacatcctttgatttttcacagaggccagtgctgctgaggaagcagatgtgcacgtagctgtggtggtgagaccaggcaacgcaggattaacagatgatgagaagacttactacagcctcatcacatccttcagtgaactatacctgccttcctcaacctagagaagggttgttaaggcagaccgccctgttccccagagttgtccctgtagtgtctaggtttattctaatggtaaaagtaacttacttaaaaaacatatgtacacatatgtatgcaagtatgtatatatgtgtatgctcagattaacttccataggtacataagtgaaagaagtctcagttcagtgaacacaaaacttatttaaagatgctttatatgtagaaattgtttcaaatcatactctaacccttagtgagggcaaagtgtagttggtagaagaaattgctaaatacctatctaatgtgctatgtttatcaaatcgtgtactaaaatggaaagctagttttgagaaattattcagaagccttgttattttaaaaatgaaatatttcaaagactgaatattttcaaagaaaatgaataattcattgcccttgtgatttagaagattataacagctgtatttcatatttgcctccttatatatatcaaagaccaaggtatttccttctgcttcaaaagaacaaaattgggaaagaaaactcacttgagtcttgatcaaacaagtgtcttttacttaagaagaaacttggtaatcattgtggcacccacagcaagcagttgccttaccagtgaaaaaggtgcactgaggtaacatctaaaacagagatgtggttcttaatgtttaacagaacagttctaatcctgccacgtgttatcattatagattttatagttgcctttctaactacttagcacagtttgagaatacgttaattgctatttactatttaaaaagttttactgaaatcagtccataacattaagatgagccctaatatgtaagattttcctctggaatggatgtgagaaatgtaaattttataacagcagtatttatcctggtttaattctaatacgatgtcatgttaatttcatgttgtgattaataaaagcattttttcttcactcagttttatataggttcctgaactctatccacatgccgccatagcaaaagagaaactgaaaaacaagaatatttagctcttatcttaatcgtgtatcatgtgtgtgttttaatggagtgccggtggcaattcatggttattatttgagttatgtatacatataaggttactattccatttggatagtaagcattcaggatatgagtggagttccttatatttttgagaatcttaactttgaggtctctaaggtaatgcttgaaggagggagttactctcctaactaatcaagaaaaactcacgaatcctggaggagcaattttagaaatgctttgaataaggaaaaagaagtcttagaactatgagaggacaggggatataaaagattttatgttgataattttgatctagtagccaattaagaaatctagggtctatgaaaatatatgaataaaaaagaaaggaaatgagtttaggtacatcttagaaatgggaataatttgtaaatgatgataaaaccacaaatagtaataaaaggatgaacttaataccttttttggaaagctcataggcagatggcagaaaggggtatatcttaatgttatttaaggagtagttggaaaatgaagaaatgagaagattaggcactaggatctagattagaaaggaattgaataaaaaggaaggcacacagcatctagccagcaaaggattgaggtggagaggcattttactacccatgtacactgagtaaggaggacagaaaatcaatagatttcaggaattaagagaaaattgaagtatcagatttattttgcaaagtaagggaaaaactagttgaatggaatcgtttttagatcctaggaaaaccattcacaaatgatggagaaaggtcgtaggaagaatttgaaagataaagtagattggcaagagaggaaaaatacctatctaagaatgtaagcagtgatacacaatgtatacatgtattgaaacaccacagtgtaccccataaatatgcacagttatgcatcattaaaaaactttttttaatgtggataatgagctagaagatgaagtcagatgaattcatagtccttatgaggggaaggaaggcaaaaaacctctggaacttccaaaaagaggacaaaggcctcagcctcttgtttgcagagaatatggaggacaaaagcgtcttaaagttgtggctctttttattcctgtttattaatccagatgtacctctgttgttctctttcctacagtggcgctgatttctaatcttgggtcaaagcccaggttggttttttagaagagaagcccttaacagaagattctctaatcttatcaacatttctggagtagcaggacttctttttggtctggaaagcgggttttagttgctacgcagaatgtcaaatgtgtagttgcacaaggaaaggttgaaagccactggcttattgccagggcagatgcacggcagcctttccccagcagatggtgctgtttctccagacttgatatgaagtgtgaggctccacccctcctccccccctcccccaacccccgccccgtcgcccgccaaatacagcagatggagctaagagagagaaaactatattttgtttatccttacaagccaaaagcttgatgttgcaagagttggagtagtttggaaaaaatggcagtaatcctgaatgaaatccaactatctaatattccttttcctcaataaaaaattagtgatttttagcccctttttccagcggcagtgttaaaaagggattgttttcagggctttttttattcccacgagtacaaagttgagtataatatattccaaaagtttgttaacctaccacctgtgcccagatggcaaagtgatattatcctcaacctaatatttaagaataacgtggagtttttactaaaacacttggagtaactgacagaagtaaaatttctaccttacaaattcaacccaaatttattccttaaatatttattaagcatttaccttgcatcccagatctgctatgaggggacaaagttcctctctactcccattgtgcatacatttttcgagaagagaaacaatggtgactaagacaagaaaaaattagatactagtaagcgctctgcagagaacacagggtagaataactttacaggaggggtgatgagaaggtgacatctaatctaaatgacatggaagacatgtaggaaactaggagaactggtgttccatgcagatggaacagcatagcacagatctagggcaaagcttggcctttttcaggaattgagagcccagtggctggataccatcagagaagtgggctgaagccagatgatagtgctttgtactccagtaagaagtttgaattgtattctaagtatggtaaaaagcccctggaggactttgagcagaagataacctgagtggtttacatatttaaggaattctgtatggaatggagaatggtttataagtgggcatgactgcatgcaggaaggtgagttaagtatatcagggttgagtgctgcaggcaaaaatcacaaggagttaggtgtatacaacatcagtggaagaactgggagaagagtcagggcaactaccactggactgtggagttagaggacacctcacagtggttagctcaggaagcctgctaccattgccactgtagctcatgcccacgacgctggccagactctggaatgccaggccccattgctgcaacctctccaaacagaacacttccatctcttctccaattagggggtaaaattggcacttgagagagtcaatctactgggtctgagaaggctgttgtagtaatgaaggtaagggatggtggtggcttgccttagggtggtaaaagcagaaatagaagtggaaagattcagaataggttttagacatgacagtgaccacttattgattgattggatttgaaagggtaactcttacatttttagcttaagcaactggatagatgatactactggaaaaatagcagtgctgctgataataatgtaaagccaatgtagatcctgatgtcaacatgaccgaagagcagttggatataagtctagagttcagaatgctggcctggctggagatcagatttgagagttcactggcatagagatgctattaaaagccatgggatggggttgcttaggaagagtctgttgatagagaagagagcctaaacagcccgtaggctccaacactagaggtcaagccaagcaaagaaaccagcaaaggagatgggaaagtattgggcactgaggaaggaaaaccaggagagtggcaggggagcccattaaagaaggaactattcaaatttatcaattgctgctaagaattcagttgagaatagcagtggccctgcagtctaagtggagtggtgggaacagaagtaagattaagttgaggaggtcaggagggcctatgaggtctagctaaagatttatccattttgttgatctttttaaagaagaacatttggttttgttgattctctattttgtttatttccactctaatcgtatttccttctgcttgctttgggtttaatttgcatttctttttctagttccttaatgtggaaacttatgtaattgctttgtgagttttttttttctttttttttttgagatggagtctcgctctgttgcccaggctggagtgcagtagtgcaatctcagctcactgcaacctccgcctcctgggttcaagcgattctcctgcctcagcctcccaagtagctggaactacaggcacctgtcaccacgcctggctagtttttgtatttttagtagagacagggttttgccatattggccaggctggtcttgaactcctcacctcaggtgatcagctcgcctcggcctcccaaagtgctgggattccaggcgtgagcgactgtgtccggccattttctttttttttttttttaatgtaggcatttacagctctgagtttccctccgagcattattttcactgtatcccataggttgaggtatgttgtgtttttgttttcatgtgtctcaatatattttctaatttcctttgtgatttcttccttcacccattggttgtttaagtgtttaatttccacatattgtgaattttccaaatgtccttctgttactgatttctaatatcattcccctatacttagagaacatactttgtatgattttgatcttttaaaatttaacaagacttttcatggcctaacttatagtctatcctggagaatattctttgtgcactggagaagaatttaaattctgctgttattgggtggagtgttctgcgtgtatgtctattaggtctagttggtttgtagtgttgtttgaatcttctgtttccttgtttacattctgtccagttgctctattattgaatgtgaagtattgaatgctccctctcttttgttaaattgtctattcttttcttcaattctctttagcttcatctattttgctgccctgttgtaaggtgtgtatatgtttataattgttatagcttcttgctagcttctttaacattataatgtccttctttgtctcttgtaacagtttttgtcttaaagtctattttgtctggtattactgtagccacttcaccctctatttacatggaatatcttttttttttttttttgagtcagggtgtcactccggggccccaggctggagtgcagtggcaagatcatagcttactgcctcaatctcccaggctcaagcgatcctcccaccttagcctcctgagtagctgggaccacaggtgtgcgacctcacacctagctaatttttgtatttttgtagagatgaggtctcactctattgcccaggctggtctcaaactcctgggctcaagctatctgcctgccttggtctcccaaagtgttaggattacagcccggccgaatttcttttaccatcctctttctatttatttctgtcctgaatccaaaatgtgtcttttataggtagtatgtaatggattatgttttcaattcattatgccagcctctgccttttaattgaagagtttaagccattgacatataattactgacaagcacttaattctgccattttgctatttgatttctatatatatatatatgtattttttttttttttttttttttttttttttttgagacggagtctcgctctgtcacccaggctggagcgcagtggtgcaatctcagctcactgcaacctccacctcccaggttcaggcgattctcgtgcttcaacctcacgagtagctagggctacaggtgtgcaccaccacacctgactaatttttgtaattttagtggagatggggttttgccatgttggccaggctggtctcgaactcctgacctcaggtaatctgcctgccttggcctcccgaagtgctgggattacaggcgtgagctaccatgcccagcattgtcatctcttttaatatatatttttgaatttttttttagtgatttcccctgagggtacaattaacatatatttataacattctagttctgattaataccaccttagtttttgtttgtttgttttaagatggagtctcactctgtcccccaggctggagcacagtggcatgatctcagctcactgcagcctccccctcccgggttcaggccgttcttgtgcctcagcctccctagtagctgggattacaggcgggagccactgtgcctggccactaccactttagtttgaatagtatacaaaactttgctccacataactccattctccaccatttaagttgttattgtcacaaattacatctgtatatattgtgtacccatcaacatagatttattactattgctttatgcagttgtattttaaatcagataggagaaaaaggagtagcaaacaacaaatacatttatactgtcttttaatatttaactattgtattagtttcctagggctgcaaggtactgcaaattgagtggcttaaagcaaaagaaacttagcctcccaaagttctagatgctagaagtctgaaatcaaggtgttggcagagttggtgccttatggaggcactaagcgagaatctgttccattccacctagcttctggtgacagctgacaagccaggccattgcttgggtcataaatgcgtgactccaatttctacttctgtcttcacatggcattttttcctgtgtgtctatgtcttcacaaggctattttatgagcacaccagtcatattagaggaagggcctaccctaaaccagtatgatctcaactaactacatctgcagtgattctatttccaaataaggttgcactctgatgtactgggaattaggatgcagcatatctttggggtgggggggatacatatttcaacccataacaccaagaatgtcagagcttttcaaagcccttgttcaccaaagcatcactagccttttctgtcaagcgttttggttagactgctgttggctccagctgttttccattgttccagggttgtgattaatacatttgcctttaacttttcatcaaaggaccctggtagctgcctcagaactggcagagttccaagttaggcaagataatagtaagcccattcagctaaggagccaccagatacgttgctatggacttaatcgtgttcccacaaattcatatattgaggccctagctaagccccaatgtgactatatttggagataaggcctttgggaggcaatgaagattaaatgagttaataagggtgggccctaatccaatggattggtggccttataaaaggaggaggagacaccagagaactctccaccatgtgaggacacactgagaaggtggcatctacaagccaggaggagccttcactaaaagccaaatctgccagaaccttgatcttggactttgagcttccagaactgtaagagaatacatttctgtcgtttaagccacccagtctgtagcattttgttacagcagcccaagcagacaaacgcacagctcaaaacgaatgaccacaattctttgtgaatgagatccattattctgctccctctggcattcttacctgtgctagaaacctgggctcttaccttcaaggccatcatcactgagcacaggagtgggagttagaaggagggtaacttaaatcaccacagagcttcctgagcttttgctgagattcaggtagttttgtaattgcccagctgggttcttcttgcccactgcccagaaaagctaatgcactaagagcagcaagagtgttgcagcaaataatttcattatcacagggcccaccaagcagatggacgggaaataattctcaaatccacctccctgagaattcggggactagggtttttcaaggatagtttggtgggcaggaggctagggaatgagtaatgctgatgggttgggtcaaggatgaaatcatagggggttgctattcttttgctgagttgatatctgggtgcaactttttttaatgggtggtgccagttggtccatacgaaattcaaatctgaaaaatatctcaaacatcagtcttaggttttataacagtgatgttatccacaggggcatttgggggaagttacaaatcttgtgaccagtggctatgtgacttctgagtagtaaagagttttttttttttttttagatggagtctcactctatagcccaggctggagtgctgtggtgccatctcggctcactgcaaccttcacctcccaggttcaagcaattctctgcctcagcctcccgagtagctgggattacaggcacccacaaccacacccggctaatttttttgtatttttagtagagatggggtttcaccatcttggccaggctggttttgaactcctgacctcgtgatccacccacctcagcttcccaaagtgctgggattataggcatgagccaccgtgccgggccaagtagttttaaacagtcaagttataaaacaatgactggttagagtttaactctgcctacatcttagcagaagaaacaatggctgattagagtttgtgcctacatcttagcagaattcagggccctatcacatttctaagcttgaggcctttggttagttttacaaaagcagttttggtcctgagcaaggagggggttagttatgagaaggaactattttcatttttgttttaacattaaactataaattcgtaggccaggcacggtggctcacacctgtaatcccagcactttgggaggccaaggtgggaggatcactcaagaccaggagttcaagaccagcctgggtaatatgatgaaaccccatctatcaaaacaaaagaaaacaaaacaaaaattagctgggcatggtggttatgtgcctgtagtcccagctactcaggaggctgagacagtaggattgcttgaggttgggaggtcgaagctgcagtgagccatgagtgtgtcactgcactccagcctgggtgacagagtgaaaccctgtctcaaaaaataaaaataaaagtaaatacaaaattcctcctatagttagcctggaatgagcaaagacagcttgtgaggttagaaggaagatggagtcagttatgttagatttccctcactcataatttttgcaaaagtagttagtctttcttgattaagtcctcctggttgctgtaagcttttgcttaggttctagaattctaaaaaagttgattctggcagtttttgccagtttatttattgcttttttggagggacttttgatgttccttattcttccctgttcatggatgtcacccctacatgcttttcttacaatgtgacttttgcagtcctctcaccaagaggtggggcctatgttccattctatgagactgggtgggacttacgactgctccaaccaaacaaggacaacagaggccatggtttgtaactttctaagctaggttatgatacagcttctagctgactcacttttttcaagagctggggttagacaattgctctggggaagtcagctaccacactgtgagaagcccagattcacccatatggagaaaaactaaggcctcaagctgacagccagccttgacctccagacacaagaataggctggtcttcagatgcttccagcgtccagccttcaagctctctagtagagaccccagacttcagagaaaagctgtccctgctgtgccctgtctgaattcctgacccacagaatctgtgagtataataaatggtggctttatgccactacattttgtgataatctgtttggcagccaacgtgaatcaaatagtactaagcagtggacaggatttttcatccgtttcagcacagcgaggcttttaaaaggcctctgctggggtatgcagttaggaacatcgagattgtctcatcattcccccgtctccttccaagtggtggcatctcttatcttcctacattttgcaagtgtccccatcttcccagtcatacaggcttgaaccttcagaatgtctttgacgctttcttccccttcaccctcctccacaggcagcaagtcacacctgttgtcttttgcacagtgcctctcaaattcgttttcttcccattcctagcagcctgtgcttgaagctccagtagttattcctacaaaataaaatgccacaatagaaaaagactgctgataataagcatagtgctttcaggctttatactagaaaagggtactgcttaaagccttccaagggcaagtaatgataatgcttatggatacgataaggaagtcaaatgtattttgagaaagctctctcctaggacaatgcaaaaagcaaatcaccagctggtctctatctggagtacttctagtcactgaatccacttgttgctgtgtttagtctaagccctttccccccagtgctcttaattatctctggctacaaatctaaatatagtttacaaaaatctggtcatcttagatgttattctaatattgactggtaaataaatctcttagttctgcttt

SEQ ID NO: 38256 - DNA, 40740 bp, Homo sapiens
gaagtcggcgtcttgagtcataggagtgagccacgcccgggctgtgggaataagatggcggggaagaagaatgttctgtcgtctctcgcagtttacgcggaagattcagagcccgagtctgatggcgaggctggaatcgaggcggtgggcagcgcggctggtaaggcccaagtgcgaagctggaagggggaatcgggtgtctgcccggaatgctgtaccctcgctgggcgggagggaacaagatggtcattgtgctccaagcaccggaccccgaagaatggtccagggtccggggtgagatagagcattagagactgtggactaagaatgaagaatctccttcccgttatttcgattaatttgcctaaacttactgaaagactccgtgccggctatagtgatagacagagggatggacgaagagggagcggctgctcagccactgcctgtttcccctgggctcgttgtttgatgagggagagcgataagtaaaacatacgtggaagatggtaaagattgtgttcgttaactttataacttttagttaggaatgtgccctaaacacatcttggagcttttaaaaacaaacgtatctgatgcccaaagtgagagaacctaattcggtagaactggggtaggatgtgggcatttgtgaactttttaaggatcccaggtgatttttcttattttgtgagtttttaaagcctaacggtgatgttctcctcctcaggttgagaagcacaatgttagataatggaaacagattcctttgggagaataaagaacaagttacctaacaacatatcaggaccttagcttcctcatctggaaagtgaaggggattggattaggttaggtacttccatgttttgtgattttgtgtggtctcttccagtcagaaagttctctgatggtttcctataaacactttagtgtttatctagtgtttatagcattagaaacagaatttagtactcggttttgttccctgaccttttaatgattttattcagtaaatgctggccttctcagagagccgaatctgggcctattgtaacttaacatgagatttaggttccctttgtatcttcagagatagtcttggccactcaaatctctggacattttttcttacattgtaactcttgttttttttttcttgctttttgtttgtttgtttgttttttaacctttcagaggagaaaggcggattggtatctgatgcctatggggaggatgacttttctcgtctagggggtgatgaagatggttatgaagaagaagaagatgagaacagtagacagtcggtaggtaaatctcccagatccagagctactgaaagcacaatttcatttgtcagattttggaactgtgccaacagtgttccatttcatggttagctccatcccttgctctcccgttttgttttagtattagtggaagaaactggattggatatcagatctgtttgaaaatgtattttcacatggatcattttttattaatctttgaattgaaatttgggggaaaagatagtggattattttatttaacccagatatcaatgggtgttttatgttgatttttccctgtttaaatgatttactccatttatagcaggcattcatcctaactggtgtatcatttatatctacagtcaactctgcattatttttaatcttggttggggctcatttaagtcttctcagtttattaacaagataagaaaggaaaattcgttttcacctgctttttcttttcttttttttttttgagatagggtctcactctgctgtccagattggagtgcagtggtgtgatcatagatagttcactacagtcttgaactcctgggcgcaagtgatcctcccacctcagcctacccagtagctgggactacaggtgggcgccaccatgcctagctaacctattattatttttttttgtcggaatcttgctctgtcgcccatgctggagtgcagtggtgcgatctctgctcactgcaacctccacctcccaggttcaagcaattctcctgccctcagcctcctgagtagctgggattacagacacctgccatcacgcctggctaatttttgtatttttcacagagacggtttcaccatgttggccattctggtctctaactcctgacctcaggtgatccacccgcctcatccttccaaagtgctgggattacaggcgtgagccactgctcctggccgatttttaaaatttaaaaaaaaattttttgtagagacgttgtttcactatgtttcccagtctggtttcaaacttctggcctcaagcaattcccctgcctcaccctcccaaagtgctgggattacaggtatgagccaccatccctggccttcttaacttctttcttgacattttatttggcactttttataatggtgcccttagttcttgatcacaaatcttgcctgaagttcagtaggtgctggagaaaggagaacctgtgctattattaacaagaaagtctttagacacataatcacctgagcaacatgagccagaatttaagtttgcagaaaacgcaaggaaattgaagttggtgcttagcataagacaggcagagttgagtctagatgtcaaatctgactgcttagcaagttttaattaaatcacttaaaatatattatttgtttgaaatttttgttacatgttggtatgtaaatgttagcattaaaattctttccagccaagcacggtggctcatgcctgtaatcccagcactttgggaggctgaggtgggcggatcacaaggtcaggagatcaagaccatcttggccaacatggtgaaaccccatctctactaaaaatacaataattagcagggcatggtggtacgcacctgtagtcccacctactcgggaggctgaggcaggagaatcgcttgaacccgggaggcggaggttgcagtgagccgagatcacgccactgcactccagcctgggcaacagagccagactccatcttaaaaaaaaaaaaaattatttccacaacaaacagaaatgcgttttgtacatgatgcattttgggagatactttcatgcctttagccccatccattaatattgataattcagagttgactgaaattattcagaaaagttttgcaagttgttttctgacttttctgaagtacacacattctggcttaatattcataactcttttctttagtacgtttgcataatgtgtttttgaagtgttatttcatatttgctttgcttagaattttcatcatgtttaagcttcatttcatattttagtaaaatcctctcatcagatcttgttgtagagattctgaaatgtgattgtatttgtctgagctccatctctgtttatttggcatgactgatttcattttaaggagattatggagattgcatttaaagccttggactcactggtaccttacaggacagttaagtctccaaatcatgagtctagtttgttcaagtctctcgagtggtatttatattaatatatggagtgctgtgtaatgtttgggctgaaatgtagctttgttgaaaatagtagtttcaaatgaaaccattttttcctgggtatttagttaaaggcttctgtgcattgggagtgttctgggtagtggaggtgacatggatttagccagctaataaggtagctggtccagcatctgctcctgatctttgaccttcatagcatcagcgttagcgttcagtggaatggcgggctcgctttggagaatgccttaccgtgtgtgatcctttgtgtcaggctgacctcatctggataaggaacaggactgggtagaatggatcactggcagttctgtgagcacttaggtggaggcagagcccactcaactgggactcctgaaaggttgggcattgccctttagtcctgcctttcccaggtcacttgctcaggtagtttgatgcctgccttcctgtgttgatgtttgtgcaaatgccggttgaggtgctgcgatacagctgtgtgtaagccttggcacttggtgttggacactgttagagtaggtccgagtctgatgtacatgtgtatatgaaaaggaaagaaggctcataatcctgatttgaaataactgatacttcagtggaaacacgatgcctgttttattgtgtggcctgatcttactctttcctaaaacatattgcaagctttctccatttttatgtatgtgactttgaactcgggcatcttcattgatgtggactgtctcaccactaaagtaacttgactttgagctgctgatgcttttttgttttttgtttttttcccctccagaatatctctttttccccttatttttctctggttctgagttatatggtaggggagggattcttggtgggatgaccccagctgggtaaatgggctgtttgctccggcccctagttatgcatgtgagactcctcaggcccgctcctttaagcttaatcctctaaattctttgtcttgtaggaagatgacgattcagagactgaaaaacctgaggctgatgacccaaaggtatttggtgttggctgtggtgggtggctggatgcaaacaaggtgtttgaacactgtggctcagttcgtatgtttggtcaagatctgtcccactgacaaactgtgcaactgtgtggacattttctgggataaaataagctttataaagaaagaacctggagacaactcaggaatgaacaaatcctgagacacattggatttccagcctttcagattgtgccatatctcctgactagaaaggcgagaggcctggctgaggccaacaacccacttgcattctgcatcccagatggggctttaagtgtcactgccctgcaggtggattagtctgtttctagacccaggaaggtgtaagggccgcctcgcgtgctttgggttctctttagtcatctagaagtgaacaagaggctataagaaggtcagaccaaaatgaggcctctccccagctctcagggatggtgggtctaatgctcattttcctgggggtgtgtccatccacttttgggcaagctgtacagaatggtctttttcggaacaacataactattctcatagtgtcatcctagtagcagccaagagtaatttgtagcaattcctatcacattccataatgatctgttgtgaaggttaagacacccttgtgttggttaagctgctgtgctgtgcattggccattagaaatgtgtacttgctgaagagtcattttttatgaggaaaaacttcccccctgtacccccaaagaaaaagacttaattatatcactctagacccggggaataaggacccattttgcagttaaaaactgctttgaggccagccgcagtagctcacgcctgtaatcccagcactttgggaggctgaggcgggaggatcacttgaggtcaggagttcaagaccagcctggccagtatggtgaaaccccgtctctactaaaaatacaaaaattaactggtgagactggtgggtggtgcacacctgtgatcccagctactggggaagctgaggcaggggaattacttgaacctgggaggcagaggttgcagtgagccatgatctgccaatgcactccaacctgggcaacagaatgagaatctgtctcaaaaaaaaaaacaaaaaaaaactgcttggaaaccagctgtaactttcaagatgacctagtaaaatttaggaaatttatgcccaattaaaatctaaaacagtaatattcttgaaaatatagtgtgagctgttccatatttgagctgattctgtgattggatagaactgtatgtagccactaaaatcttgagacgttgtgagtgagaaagataagagtgtgttttaccaggaaagaaagttttggcgccagcatgcaggagggaaaaaaaagaacccctgaaaactgtaaatgcaacctgctttctatgctgagtgaaaaacctggaacccaggcctgagaactcgccctgcctgagaactggcaagatggtatgggcagacccatggccccatagttcaaagtcagtcacagctctcctcgggcttgcagaacaaaacactcagtagtgataatcttctctgcctagtatttagggtatgtgggacttggagcctgcacgtaaaacaagcccagggagccgttaagtgtttgggtttcagttgtggagggaagggaggatctgggtcctagagtctttctgggtacagttgcagccttttcttagggctggaaggcttcctggggaagttggctggagaggagggtacataacacttaacggtcaccccttctaaaatactgtaatccaggcaacaaatccttgggagatgacagggctttgtgagtcagggtgggggtcacatgaaaaacaaaacagactttactgctgtccagtagcagtcactaaagagcggggtgggagggacccaaaaaaggtgaagctgggaagattgtggaaatgccttttgtgctcaggctccccttctcagccctacatcacggctgacagcctcgtcattcctgcctgctccttgactgatgtgcttcgctgttcctcattcactcatgtgcatttcaagttttactgtggaatgaaaagttttcatggaataatttctgttcctcttgaggagccctcagaaatcagaacacaaaatccaaccctcaaagtcacttgatatagttcttttggagggtgatggagaagggtttagataaagcttgccagcttcaatgttctgcaatccccagtggctgccaggcctttaggagtcctcgtggcatctccaaggactacaaatgatccccagcatgagtcttctgtgatactcttatcttagtcctggccctgtcatccttctgcttgagctggcctcagactctcttccacatagcaacatgtacctcaaatccagaactttctggcacatttacattttatttttatttatttattttatttatttttttgagacagagtcttgctctgtcgctcaggctggagtgcagtgctgtgatctcggctcagtgcaacctccgcctcctgggttcaagcgattctcctgtctcagtttcccgagtagctgggattacaggtgtgagccaccatgcccagctaattttttgtatttttaatagagacagggtttcaccatgttggccaggctggtcttgaactcatggcctcaagtgataggcccgcctctgcctcccaaagtgctgggattacaggcataagccactgtgcccagcccacatttttttaaattgatgtgtaacaatattttttatattcaaaacccttaattttggacattctgctttaagcatatgaagtttttttgtttgttttttgttttttttttttttttttttttttttttgaggtggagtctcctctgtcgcctggagtgcagtggtgccatcataacttactgcagccacaacctccctggctcaattaatcctcccacctcagcctcccaaacagctgggactacaggtgtgtgcatcacacctagcaattttttttaatttttttgtagaggaaaggttttgccatattgccccggctggtcttgaactcctgggctcaagtaatctgcccacattggcttcccaaagggctgggattagagctgtgagccaccaggcccagtgcacatgaacataggaagtttctaacaatagaatatgttacaagtgtggatctttgttagaagtgttgtttaacaattagattactgtcataattgtcatctccactaggtggcattctcctttctactttggttttttgttgtttttttgttttgttttgtttttgagtaggagtttcgctcttgttgcccaagctggagtgcaatggcgcaatctcagctcactgcaacctctgcctcccgcattcaagccattctcctgcctcagcctcccgagtagctgggattacaggcacatgccatgtcgcccagctaatttttgtatttttagtagagacggggtttcaccatgttggccaggatggtcttgatctcctgacctcgttatctgcccacctcagcctcccaaagtgctgggattacaggtgtgagccacctcgcccggcctctactatggttttttaagatcttttaatttttttcagtagttctcaaaacatttaggtttctttacacaattaaaaattgaggatctcagagttttcattttggttttatctattgatgtttactattttataagttaaaactgagaaaattttaaattacttattttaaaataacaaacctgatccggccacagtgacttgtgcctgtaatcccagcactttgggaggccgaggtgggcagattggttgagcccaggagtttgagaccaacctggacaacgtgataaaaccccatttctataaaaaaaatacaaaaattagccgggtgtggcggcgcatgcctctagtcccagctactcgagaggctgaggtgggagaatcacttgagcctgggaggtagaggttgcagtgagctgtgatcttgtcactgcactccagcctgggtgacagactgaaaccttgtctcaaacaaacaaacctattacatattaacataaataacatttttagaaaaaataagtatttccaaaaaaatgttaatgcaaagagtggcactgtgtcaccactttacaaatctctttaatgtctggcttaatagaatatggctgggtacatataactgcttttgcattcaggtaattataggtattcttctttgatacttcatcaaaactcaacaggtgatagtttccttgaaaggttagttacatcatggaatgcaaagccttaccagtgaactctgcattctgcttccctaaaatccactggtctgtcttgccctttgaatggatcttttacccatacatgatttgatatcgtcaggctctggtgatttgaaaattgctgatgtactgagttacacagatctaaatgttgacacattttgttctgtcgtatcaaaaaagtagtatttattagtgacatcactaatctcatcagaaaatcattaaatgttagaaaccttttagcaagcccacaataaggagcaatacattttttaagataatgtgtttctaataatttttgtttgaaagcatgaatttatcattttcaatatgtgctatcagagctttccttgaagtaacaggctttggtcttgagaaaatgtctgccaaatacccaagtccagataactagtttgtcattatttcaaataaaaatggtgtttcctgaagaaaactgtcagttcaactggtgactcaaataatcacaaacggtagtccatccttttccgtggcttcagtaacctgaggtcagctgcagtctgaatatattacatgcagtaagctattttgagagagagttcacattcgcatagcttttattacagtatataattctaattgttgttaatctcttactagtttataaattaaactttatcataggtatgtatgtataggaaaaagacatagtatgtataggtctcagtactatcagaggttcaaggcatctactgggaatcttggaacgtataccccacggataagggggcattgctatgtgtgcttttccctgagacatttgtctgactttgttatgcagcagaagtatttatgcatgcctctcatgtcattgcccaaaatattaaagagatgtatattcaaatgtcaagatgtcataaaactaatcatttttactgtcctggcagaaaactttttttttttttttttttttgagacactcactctgttgcccaagctggagtgcagtggcacaatctcggctcactgcaacctctgccttccaggttcaagtaattctcctgcctcagcttcctgagtagctgggatacaggcacgcgccaccatggccggctaatttttgtgtttttagtagagacagggtttcaccatattggccaggctggtctcgaactcctgaccttgtgatctgcccgcctcagcctcccaaagtgctgggattacagatgtgagccaccacgcccggcctatggctgaccattcttaagtgaaactggctttttttttttttttttggaaacgaagtctcgctctgtcacccaggctggagtgcagtggcgcaatctcagctcactgcagccttcacctcccagttcaagcgattctcctgcctcagcctcccgagtagctgggattacagatgtgaaccaccgtgcctgactaatttttgtatttttttttttttttttttggtagagttggggtttcaccatgttggtgaggcaggtctcaaattcctgacctcaagtgatccacccacctcagccttccatagtgctgggattacaggcatgggaatcccatgggattacacccagccctttttttttttttttttttttaaatcaaacggctacagtttggtgctgccacctcaatttgttctaaaggctagcagtttacccaccattgcttgtgcaaaggtcaacacgatgaaaaagacaatgacttaaaacggttttgactttgcagaccccttagaaaaactactattattctaaaacagaaatcatgggtcagtgattcagtagttgtttgagaactgtttttattgctctgaaaatgtccgttaagttgttagccttatggggtcttgagccatgttgagggtgggttagtattcagagtaagatgattcagccctggcatggtggggaggagttcaagctctggaatgagactggggttttcttggggaagtcctttaacctcagtttttctcatcgcgaaaataatcatcataataaaatctgtctcatttattttaaggttcaactaagtaaaaataaaatgcagttgtccctcactatctgtggggatcccaggaccccctcctcagatgctcaaggttctgatataaaatggtgtagcatttgcatttagccttgggaatccttctggatactttaaatcatcttatgatacttgatacaatgtaaatggctgtgtaactagttgttagactgtgttgtttagggaataatgacaagcaaaaaagtctgacacgttcaacacagacacaatttaaaacacacacacacacacacacacacacacacaattggaggtgagttctggccatggattcagaaccacagatccagagggccggctgtactcgactcagtatgtctggtgtgtgtttgttcagtagcattggctgaactgaccatcacttccagttccacctgtgcacacttcccaggctggtcataccatgttgtcggccggttttggaagagcagattccatgttttaaactggagtgctctcagaagagcagtcataaaggtgaggggactcaaaagcacatcacctgagggaaaggtagagctggaagacagaagactcgggaagagccggggttgcgctctggtgtttgaaggtctgctgagggaaaggctaaggcagcctgaggcagacctgaagccgcgcgcagaattccacagaagtttaccttcatataacgaaggaccttttgtgatctccggccacaagtgggttgagctgtttcataaggtagtgagctccctgtttctagaggtttttcaggcaagttttttttttttttttttttgagacggagtctcgttctgtcgcccaggctggagtgcagtggctccatctcagctcactgcaagctccgcctcccaggttcacgccattctcctgcctcagcctcccgagtagtacctgggactacaggcgcccgccaccacacctggctaattttttgtatttttagtagagacagggtttcaccatgttagccaggatggtctcgatctcctgacctcgtgatctgcctgcctcggcctcccaaagtgctgggattacaggtgtgaaccaccatgcccggccttcaggcaagttgtaagaaacgacttgtcatcaacatcataaaatctgttggtagaggttggattaaactccagggagttccctgggaaccccctaggaaaggacttgggcattatacataagcaaagttgagtattctctaactttgttatctgatgactttaaaatatgcacagactggaattgccctggtttttattgctctgatgtttggggttacctgtgagcacagagtcccatgtttgggagcgtgagtaagaactaactctggcccacctgggcagagagacttggtcctgtcctttaggttggggcagcagggattgggctctgcaggtgctgagtttgccccaaactagcgaacaggagattggagaaggaggctgggcgttgcataggaaacaagctttgtttcctgtgttccattattttttcgtctctaacttcaagtttctgatcttgtctcttcggtaagcagcaaattaacaggaggtggcactgctgttctggaaaaagagcagacgtgacagtcctggggccagcacctcactccgggaaaggagtgcctggtggctgaagtgcttcctccccctgtttacctttggcacccgaacatccctttcgccactctcctttgtccatttttacctcgtttgctctggacggtttcccttgtttatttttttctccactcctacagttcctgtggatgaagctgtttccattcactcactgtccctgacacacccttcctttgaaaacaaacatgggggttgagagcctggagcaagaaagatggagcagcctattgccagctgactgggagggactgggatcgccggcctccctgaggtgctgatctaggaaaagatctagatctcacgctctgatctaggaaaagaatcctcccagcccaggagtgtacatctgtgaaaacaaaattccgtcttctgggtcaaggaggtggcatcaggtgggggttggggggaattgttctggcattttttaaaaaggcgtgtataaccccagttaagagaagacatttttaaaattctaagatccctaaagtagtactaaaatgtggagctcacaaacaatttagagccggtctggtggacttgtggtccgaagacctgggttgtgccctggcctggcttccctctggctgtggaaccacaggcctgtaacttaagcttcactcggctccatttgggcagtcagggccgtgagaccccctttgcaaggtggttgtgactgcggcgtgagagaatgtacatgaaggtgcttttcgcagtatacaatgcacttgttagcagtgcttggccttttcagtgtaactaagtctgattatacgcccttatcctgtaggttagaaggcgccacgatttctcggctcactgcccttcatgtctccatagtttttcacagacctctggaacaaaaagaaatgcctaatggctgagtgtggtagctcaagcctgtaatcccagcacttggggatgcccgaggcaggagaattgcttgagcacaggagtttgagaccagcctgggcaacatggtgaaacccgtctctacagaaactacaaaagttagccaggcatggtagtgtgtgcctgtagtcccaggtacttgggaggctgagatgggaggatcatttgatcctgggaggcagaggttgctgtgagccgagatctgtaccactgcactccagcctgggcagcaaaccaagaccctgtctgaaaaaaagaagaaaaaatgcctaacgaatggttctgtttcttatgtcattagcttcagacactaagtattactgtcctcacaattcagtagctgcttaaaaaaataatatgtgtaagtgtgtgtggtatgtgacatgtggagtaaggctgtgtttcctgtaacagttttgttaaatatcctgtggcacctttgtgagtttgctgggttaccccaggtagtagtctgggaactgtggcagtagattgtcttaagagttccagagtgggggccttgacaagtcctcacttagcctcctctggaggcccagccgggtgagtggttctctgcctcagtggctattcatacccatcctgaagaagaccaggtctcccagttgacgggagttactgactcacagtctagatgaggatttgtattgggcagagctgactcggtaattccctcacccactctcctctcaactccttcccactgtccttgcattactcctgatcttttgaagtaccagaatcaaatatctgaaaactgcctaaggggctaatctcccaggaatttgttgttgactgctgattataggaagaactttgaggagcctgccagcaattgcatgcaggcagcactgcaggttgaaatcttatattctttttattgaacacagacccagaacacgggcagcttctgcaggattgctgcagagcacaagtgtttcccatctgggctcctggtatattcgctgcccttccaagactctgggatctgaaaggaagatgctgtggcttttcataaacaagcagcaaagggttgcattcctcctgatattgaaggatatttaggagggtatgtgatgtggtatgagataggagccccgagtccttttgcagcattgcaaacaggttgtttgtgtgcctttgttgatgcgctgctggcgagccctgacaactgagaattactctgcagaacgaaagagcaaacttgagctctcagagcttaagcttggactttttttttaatggacagagttatttttttataaaaatataaaatgtttttatattgtgtttatttttatttttgtcaaattattgtagcaagattgagtattttgcaaaaggaaaaaaaatcacctaatctcatgatgctaaccatacgaccatttttttttttttgagacggagtttcactcttgttgcccaggctggagtgcagtggcgtgatctcagctcactgcagtctccacctccttggttcaagcgattctcctgcctcagcctctcgagtagctgggattacaggtgtgcaccaccacacccggctaattttgtatttttcagtagagatggggtttctccatgttggtcaggctggtcttgaactcctgacctcaggtgatacacctgcctcggcctcccaaagtgctgggattacaagcgtgagctgggattacgggtgcaagccactgcacccggcctcatacagccatttttattcttcttttatgtttgcctataataacatatgttttgcatccagctttgtctctatctatatataaacattttcaatgttgctgtactgtataattataatagcaatatgacacaaatgaacagttaaaaacaaacactgaagaattgtatggcatatgaggctgggcgcagtggctcatgcctgtaatcccagcactttgggaggccaaggcgggcgaatcacgaggtcaggatatcaagaccatcctggccaacatagtgaaacccccatctctactaaaaatacaaaaattagccagacatggtggcacgtgcctgtaatcccagctactcaggaggctgaggcaggagaatcacttgaagcagggagtcggaggttgcggtgagctgagatcacgccactgcactctagcctggtgacacggtgagacttcgtctcaaaaaaaaaaaaaaaaaagaattgtatggtataggagttatatctcaataaagctgctgtaagaaaaatttattttatttatttatttatttattttttttgagacagagtctcactctgtcgcccaggctggagtgcagtggtgcgatctcagctcactgcaacctccctcctggggttcaagcaattcttctgcctcagcctccccaatagctgggactacaggtgcacaccaccacgcctggccaatttttgtattttttttagtagagctgggatttcaccatgttggccaagctggtctcggactcctgacctcaaatgatctgcctgcctcagcctcccaaagtgctgggattacaagcatgaaccatggtgcttggtaaaaaataataataataataataattttttaaatattccaaatggagatttttttaaaaacccattgagatctaccaacttttgttctagtagtgacaccagtccttagccccacagattttcacatcatttccctcattctcatattttcttcagctatataagttaaatccagaaataagcacgttacactagcaaaatctgaataggtttttataattgaatgctatgtctgcagtttccctctaatgaagttctctggtgaacaggaaatgggccatgtgctttacttgggtcagaaggaataactcgttctttaagctcgtgttcttattggaagtccacatggttgttcccccaggaagggagaagagctgggtagagttcaggatttggtagcattttttctgtgagtccccaggaagtctctaggctaaggacagggaggtagcacccacggtttgtgtgattaagcctgcaggaccaaccctttcaaacaagttaactcagatgtgactcactggggccccatggactctagagctgtttcccctgatcgtcataggtgaaagataataattctggctgtcttcccttaagtccagggttttaatacctgcttcactctgacctgctagagaatcattcctggaggggtgcttttccttcttggtcttcactgttggcttacccagtggttgaaccaacagcttcctagaaaccgctaccctttgcagcctcttagtctagagggagaaggtgggaagttgggaataactggataactgggcttttgagccaaacagatttggccttgaatttcaacattgccatttattgggtgagctgcttcattgtgttttacctcagtttactcgtgtgcaaaatggaaataataatgtctacctcatagggttattgtgagacttgaatagtgtaggttagcttgtagtgggttctacgtttagggtgtcatgtggggtgctatgtgagtgggagagtatatgcttcatccttccatcctgttttattagtccacctgcccctgtgttctatctcccataccctgtaatcttttgagtgctgattagaagggaacaaaattacagtatgactcacccaggaccagagaaggaaatggcccttgaccattgctggtttgtgagccatccaccacccttctcttggaagttgtaatgtgggccttgaactattgagaatgcccaagcctacgtagcattcggcacttccctgcgctcaacacgatggatggtcttctttaggcttttcctcaacaacactagggttgccttgcacagctgggagacatggaatttccagaagctcgtggagtggctgtgctgggaagaacctaccccagcctgaggtctagggttctgggggttctaggggcctgctgggtgataaccggatctgagcaggagtcagaaaggcaggcaggccatgaaagtcactcttcaattgtcgcaagggaaggaaatccaagcctgctttggctttgtcctgccaccttccaaggaaggcctcactacatcataagctgaacactgctggtagaagcgctggtagttgttggaagttgtgatctcatgcaaaggggaacaatgaccattattctccctctgacccctccttggctccattgcactgccagaggggccttcttgatggcagttgatccaagtaacctgaagctgagactcccagaagccccacctcactcctgtggttccacagcccacagggagccaccgcgtgtctggtacaccctcccatcagccgtgcaagccccaacatacctccttcccttcgggccagatgccatggattgctaactgaggtgtggctgggcccctccttccccatctgggactcatttctttgaaattatatgatacagaggactgcctgtccttagggatccagcacttccgaccttcgttctgtattttcatccatgtctcctgaaatgctgctgtgtgatttctgggttcaataggattttgctcatttctattcctaactttggagttaggtaaatattttctgggctgtgcttcaaagatgcttgccttctttttggccctctaagtaactcagtccccttcctaccggtgtcgatgatgaccagtttgcatttctgtcaccctgactttcagggactgcgagtatatttgcctgagatgttgatgtaactaactcctcagcttgtcggccagcctctcagatggaatgcttttgtaatttggtagccatgtagagttgtgtgccttccagacttgcattctcaacctcacaaagctgtctcttttgtccttgtctgtctccaggctccccccaaccccccaaatatatcaacctaaagcacagagatactgttcttgtgggaagccttgaagggaaaaagcctgtcctggcctcaccaccaagagcttgactcagatccttggtgtgaggcaaactctggacctagatacacccgttcctgacactctggggataagacaaaaagggaatggccctctctgaccatcttctgtaactttcaagaaaccaaaaatcttgaagtgtcttgaatcaaatgtagattgtacttggaatagtcggataacaaaagtcccccttggaaatagctccctgcatttacattgaagtctagttggttgtaacatgttccatgtaacaacatcaggagccgtgctgagtcacgtgggctttgtaaatttagccagatttttcaaatagagaaactgtttcccttcctcctccctaccttgtcttcagtctacaaggccaattctatagccggcttaataagtcttggcaaactcctgtttcacccattcctatagaaaccttctgtggttggggccgggcgcagtggctcacgcctgtaatctcagcactttgggaggctgaggcaggcagatcacgaggtcaggagatcgagaccatcctggctaacgaggtgaaaccccgtctctactaaaaatacaaaaattagccaggcgtggtggcgggcgcctatagtcccagctactctggaggttgaggaaggagaatggcgtgaaccctggaggcggagcttgcagtgagccgagattgcgccactgcactccagcctgggcaacagagcgggactccatctcaggaaaaagaaaaaaaaaaagaaagaaaaaaagaaaccttctgtggttgggagcagagccttcccatcagcaagtggtctaagcaaaggcaaccccagcgtgtcccagagggccccaccaacttccgcccatttttctgataaattgagtgtttccattcccaggcaggcagtgtgcccacggcagtggctcagtcctggccgacaggatacaactaaaggaaatgtgctagcaatgggctttctccagggctctccagtgggggtggctggcatctggcctctggggtgggatgttcccatgcagcattgggtttggaggctttgctgagctgttgacagctctcactcctagcccccaaccatgtctctgtcaaaccaacatcattttattctggaacttggaggtattttataaaggtaatccagcattgttgctttcttggcaacctgaagtgactcacattgatctcagaaaaccttgttttgactattactttgatgcctccacaagagggtttctggaggatggcatagcagttgttctgaagcagctgtattgcctgatggttaagagcacagtttcatgggactgttgtgaaaaatgagattcttaattgaagagcttagcataatacctaaacttattcccctagattgagttttcatattttatcctcaatgcttggcccattgcttggtgtataaatcatgctcaataaattatctgtggaaaaaataaatgaattaactatacagtaattatttttgtcttaggatttaggagcattaggcccagtgttcggaaagaggatgcagggccagatgtggtggctcacacctgtaatcccagcattttgggaggctgtggcaggaggattgcttgagcctacgagttcaagagcagcctgggcaacatagtgagaccccatctctacaaaaaatttaaaaattagccagccatggtggtgcatgcctgtaatcccagctacttgggaggctgaggcaagagaattgcttgagcccaggaggtcaaggctgcaatgagctatgattgcgccagtgtactccagcctgtgtgacagagtgagaccctgtctcaggaaaaaaaaaaaaaaaaagatgatgcagaaagatgaacaaagaattgggtttgaaatttttttgtaattcagcgttggtgtcccctccccaccttctcctgccccttggcagacttttattgcaagcctagcccttttgttagctgctcttctgctgcctgtccgtctgacatttctagtgaatctacacatgaaactcactgtggagttgaccaggctgggagtctgaagttaaaacataacagctgaaggtaggtgtggaacctaaacttgacagaagacaaactgacagtgtttggggtgtgtgtgtgtgtgtgtgtgtgtgtgtgtgtgtgtgtgagagagacagagagaggtcagtgcttgagcaccttctgtggaccaggctgactattagacttggtgatttttgtgagtacacagagtagagtagtttgtcttcatcggccaggtgagcatgagggtagaggaaggcttccctgggctgggctgaggcctacacggggctttctaggcaggagtggggagaaggtgatttcagggagcaggcattgcaaagatcctgggtgcagaaaggggaggaagaggctgaaatgggcagcagggaatcctcaaggctcgtgggccacagtgaggatctgtttttaaggagctattgtgctcgtgaagtgagatctcatcaggccatgggctgtcccaggtctgagagaataaaggtttgaaaggagtcattttactaatctgcctccctagctgccacgtacttgtaagatgcaagattacattgcccaacaggaaacccccagtctgtagcattcttgcctgtggcctcggggctggctgccctgtgcccctgttcagagtgctttctctgtgcccgctactcccgaagctggaaagaaaacatgacgtttagatttggtgggatctagatgctggcggctgcctttgtggaactcaagtttgacactggagctttgtggggccggttccaggaaggattgaggaagcattgttggctgtaaataaacctccattctcttactcaggacttggtacttctctgctgagtaaatcctcccagctcaaatggcagcttgtccagtttcgtgggtctatattgttgttacttccttcctgcgctccagtcagcttcatcaatggctggacttttgtattctctgcaggaggaaccatattccaggttctgtaattcttgagaaccaggcccctgccactgacctacagttgcatcttccaagtctcagtcacagttggttaagaaaccaaattggcaggttgagatcactattcttctccagggacagcgcccagtgtgccgcagccgcctcctgctctggttgttgggcctttagtctcaggtggggtctgggtggatgaggggtgcaggcagaggaggagacctcggctcagattggtgtcctccaccagctcagcgtttaaaccatacttcctctttcctcctttctgttttctaacttggcttttgtttttgtcttttcgtttttccttgtatcttttttttttttttttggagacaatcttgctctttcaggctggagtgcagtggcgcaatctcggctcactgcaacctccacctctcaagtagctgggattacaggcatgcaccaccatgcccggctaatttttgtatttttagtggagaggaggttttaccatgttgtccaggctggtcccaaactcctggcctcaagtgatctgcgcacctcagcctcccaactcccccagcctgtttttccttgtgtcttgattggaattgaatgagggggctgaagaggtgggcctagtcttttctcccaggagcagccttcctttcctaggtgaggtgctttgttttcaccttccttaggaactgggtgaaaagccctcagcctgttctggctgtgtgttgttgctcatgtctctgggctgcgggttccatgccctctggctgatgtagacagatgcctggtgactagacatccaggatgagctcattactttaaccaactgagaatttctacctgaaggccagtgggtggattcatacgagtcaagacaggtgtttcctgtgcatttcaaaacgctgctggcggggaagagatgaacagtgctttcttgttgctttttgcttgtatcctcacagcccttctttccgcttcctgcctctttaagggcatagtgagaatctcccccagagcaggtggtttaacaccagtgccttgaacgactggcagtttaataatcgagcctttcttccgtctccttaattctgtcatttaaaatatttcagtgggcgagaggtgacttctatcaattaaaagatttcaatgggagggaggtgaggaatgaaaaattacctaccgggtacagtgttcactttctgggtgatgggtacactgggagcccaaaccttacttatcattacacaataatatatccatgtaacagacctgcacatataccaccaaatctaaaataaaatacttttttttaaattataaaataaatcgttcatcacatgttttttctgacacatggctggcttccatgataactgtcatgggtgcttggtccatttttcatactaaatacctcctatctgagacatgactggtaagagggcatctctttaggcctgtcctccctgtggtggaggtcgttatagaggcatatcattactgtttgaatagaggtcacttttattggatgaaacttgattcagtggatggttgtgtgtaaatggtactaaaaagcagctctggggtatttcagggtctccctgtgtcacccaggctggagtgcagtggcatgatcatagctcactgcagctttgacctcccagactcaggtgatctctcctcagcctcccaagtagctaggactacaggctggtctcaaactcctggactcaagcagtcaggcccacctcagcctctcaaagtgctgggattacaggcgtgagccactgcgcctgaccaagcgagcactttaggatccagagaacttaggttgttgtctttcttctttaggagaagctcggcacagtgacagaggcacccagggctcagcaagctcatggcccagcttgttggactcagagggcagaagaatcacattctaaacatgataaggtatagccagcaggaggcagattcccagattgattctccagagccttgtaggtcccaagggtgcctatgacaccaatgggaatctgaaccaacacagacagcacagtcttcttaggagaccctagtgcagcagcgctggcctcctcctgagcgtgcacgcttatatggcttctgagctggccaggctacttcatgcatttggtttaatgggtcctcgtaaggcaggagaatcttcttgaacttggagttgggtctgtggtccattggtcagtactttgttcagaggcactgagggtgggaaggctcatggagctggattctgctgctgggaagctgggtgggccttgtttgtgggcctcaggttcaggactgaatgagagtcctcttgttgcgagttgagggtgtactctgggcatgccatgccctttttttgtactaagagggtagaaaagcaaagaccagactagttggcaaattggaacccaactacccagtttatttatttcttaggcgtagaaggaataatttagggggaactgaagagccaacctaaaggaaaaaaataaaataaagggataaaatacttcctgtgattttgccccatcatctcttttcttccagagacgtgactcaacaacctcagctgagcctggcagcacacacaccccacactcctttccatctccaggttcacaaaagccacaagaagccacggggaggctcctggcctcttactttacctaaggaggccctgaagtggcaagtgtgtttccccttgaagagccattgcatgtttggtgactaacttcctgtggctttggggtagacatggtagactccttgtgtggggattgggcctctgcagttgagtccatgagaaggggtgggtgtggtatggtgcggagccttggggaagggtgagtgggggctggagggagagttaacgaatggtcagtccctgtatgatcagccagctggcgggtgagggaggagctgatgttttcctacaatcagcacccagaaagctgttctctagagggaaaatgtgagggcattttacagtcccatgtattgttactaacactcttgaacactggtttcctgagagtcactgctacaaagggattgttggtcccctgagagactggcagtctctatagggctgctgatttatgactgcggcagtctctatagagccgctgatttatgactgcaacctgaagttggtgtggcagtcctccaggcgcgcctccctgcctgctcccagcctcctctttgcccacctgattggcagggggcagtggctcgaagagatgggttgctaagcagcctggcctggacgtggtgccctgccaggttgaatgaatagctgcagtgttctgaggaatggggaatttggcctgtcccagcatcaggagggactttctggaaagggggctaagactgagtctaggttcagtgtggggaactgggtggccttcctggcaccttccttttggagccgtggcgtggtgtgccatgtctgtgtaagtggagcctgcggagctctgcacctgtcctcgaaaaggtcttgttgcagggtcttcctgtctcatctcctccctcactcatcagcaggaaaagacatggcgtccagcaactttctgtgaactctgcctctgctgttttgatgatgagcacgtgtggcccttgagattgttgatctaactggctttgaggggctgggtgtcagcaacccagaaatgggggaaacaggtgtgttcttgccattttacacttgagacaatggaggcaagggaagacttgtgacggagggcttggaccgtggctttctcagcattgattttggtttagatgaaacatttactacagaacagtgaaatccagaaaacgtctaagaagcctttgctctcaggtttctgcaggacatgtggatgtagctgtcatgggacactgtttgcattagggattggaggaagcttttctttggagggagtataaagccagtgtaaagggagctgagagccagagagaggcttccttgagcctggggcctctctgggatccccattctgccacttattaaaggtttgctgcatgcttgctctgaggttccatgagctgcccctttatcctcatgatgaagcctcccttctttgaactaaaaataagaagagtatcttgggagcagctagtctgcattttcatctcgggagtctgctgttacaaagcagtcacctcttgcttccttggtaccagcggtagaggtggtgatgtctgggctggccgggcccttgagctctgcactccattcaggcaagcttcctcagacccaggggagagcaacaggcagggtatacgttgcccagttggctgcagcaggcttgctggcttgtgttctcctcagcgatggtgggtttggtcactgaaaaggcatggaggagagaccggcgtggggctcgggagcatccggctgctgcgatgcgggaagaagagggttcggaggctcgggggtgccagaggcccctgaagcatcagcttacccttagtgttcctggcagtgcttttactttttctccttccttaaaaatcctgagtggtctcagtagagagtagctggttcaggagccccagtcttacctcctcgtatttgtttgtcttttgcaggataatacagaagcagaaaagcgagacccccaggaactcgtgggtgagtattgggggatcctgggggcacgtttctcagccttgctcctagcagcctggcttccagccatgccaggcctgccgccccacagggcttctgtctgctgtgagcactgttgtccctttggctccctctcagggctttggcatttcctaggatgcccgggtgagacgtccagggaacagttcttctttggaaatcatatttgtggtgtgttttaatgggctttggtcggttgccagcgctgtcaagagggaattcagggcactcagctgggagcgtgtcttggtctctgcttcccctagtgccctgggcttgtcctctgtctttgcaacccctcctccccctctccgctggcatatgcatgctgctcagggagtcagcatgtggcctctgctggcactttgctctgtccccaggcaggaacatgcctcacagccctggagtctggggctctttgtgatttgggaggagcagggacactatgtttctggaaaacagcatacatcatccaagtcctgtgctagccccagccttttaatccttttagaaagccccccagctcctttcacgtggctcccaaagcccgaccggggggcagttcccggcatctgagtcagagctcttggtggggttggccctccctctctgtggcaaccattaccagctctcctgtccgtcctgctgatcttcacaaacaggctcctgcctcctgcggtcttgcctcggtggctcactgactccagccctgggggttctgagcccagggaccacctggaagcgctgccccagtagtcagtccttcccacccaggcttcctcccagtagggcctttctgctgggagttctgctacaaagcctgttctccttttccagaactaaaggagctaggaatcgttcattctatttgtcttttgaagaaggattgggtgggaacacggtaacgctgagcagcccagaccctcagcaggagggccttaatccctggcctctctgatggagtttcagtctttcaaatcctataaaaaccaagattttcctaaaacctagagtttcttctttagaaagtgacgccttaggggtgcaacatttggctttgagggcagaggaagcagagtgtgcatctgctgggaagccgatggccggcccaagggggcgatccacgggtcgggcgtggacgggagccttggcctcttatccccgccatcacccgagccgaccctgctgtttactgtgagaaactacacggctggggatcagagagcagcctgtcacgtgccaacgcagagatgcccttgctcttgctagtagtgctgggcaggcagtggaatgtgtgtgggcatcagccatctcagcccccagttgcttccagagccaacttgtcactttttctccctgtgccactttttggaaatagctttattgaggtataatttacatagagtaagacttgccaattttacgtgtgccattttatgaattttgacaaatgtgtatagttgtgttagccccaccacaattgtgatacagaacgcacccatcactccgaaatgttcccttgtgccccgaccgtgttacaggtgattccctccctcagcctcaggcaagctgtgatctacactctcctcactatagctttgcctttctttagaatttcctataaatcaggatctccccaccctggccctactgacacttagggctggatgagtctttgttgtggggctgtcctgtgctttgcagggtgtttagcagtgtccttggtctctacccactacgtgccagaggcactctcccttccccagatgtgacagtgatcaatgtctccagacattgccaaatgtccccttggggcagaatcacccctagttaagaaccagggatagaaagggaactagtgtttttgtctggcttctttcactcagcacggtgcttgcaagactcatccatgtagttgggcatgtccagagtttctttttgtagccaagtaatatttcactgtagggatacaccacagtttgtttactgattcacccatgaggacacaaatggatctttaagcggcatcgttttgattactcaccattcctcattgacgagtagctagtttagttcctcttactgaagacgtaattagttgaaggacagtggcttccattcatgatgcagtgcctgtcagcccctctacctaagcttttgtccactctggtgtcaggactcaggttgcttaccaggtatgggaagtgtgtccatgcatgtagacagccccagcttttagagaacaagcaggagagcagagaagccaaaccacaggcatctgcagcactgcagccccttgacagagccgagcatgcacaccctgtctgtgccctccagggcctcgcagatgcccacggctgagcctggagcagtggtgctggtgtggcagtgcacgtgggttctctctgtcactcaggagctggagatactccaccgtcccctggggccccccagctcgctcactccctgccatcccataagcccgtccaactagctgttcctgcacagatccctccctggcagctgtgggtactctgggtgttttctgacttgggcacgcaccagggcaagtcacgctgacagctggcttctcaagtcctaagtgcggctgcctctgagaacacacccatcagacccaggcagcagccacagacccagcgctgcttccaagagactgtggacacatcgctttactggcttgaggctctgtctgcttacaagaaatgtggggctcagctggtcgcagtggctcatgcctgtcatcccagcacttggggaggctgaggcgggcagatcacgaggttgggagttcaaaagcagcctggccagcgtggtgaaaccccatttctactaaaaatccaaaaaaaaaaaaaaaattagccaggcatggtggtacttgcctatagtccaagctacccgggaggctgaggcaagagaactgcttgaacctggcaggtggaggttgcagtgagccgagataacaccattgcactccagtctgggcgacatagcgagactccatctcaattaaaaaaaaaaaaaagaaaagaaacagaaatgtggggttcaagtcttccacattagattcattccaggactcagaagggagaggaccactgaaagattgcttccaaactctgtgttgtacacttctatctagttttcccgaatgtgttcctttatttgccagttacttcctaggaattatcttgtttcaagccctggactgaggaggggctcccctcctctttttttttttttttttttggagacggggtctggctttgtcacccaggctggaggggctggagtgcagtggtgcaatctcggctcactgtaagctccgcctcctgggttcacaccattctcctgcctcagcctcccgagtagctgggactacaggcgcccaccaccacacttggctaaatttttgtatttttagtagggatggggtttcactgttttagccaggatgatctcgatctcctgaccttgtgatccgcccgcctcggcctcccaaagtgctgggattacaggtgtgagccaccgcgcccggcccctcctcttacactgtacaccatgtgagccccagagtgtggctgggttgctgtggcaacagggtcacaccctgtttttccaaaggctttcctggcaaatgccaaagggcactctttgtctctctgtcacaagcacagataggttctctccagcccagggaagaagttaaccctgcttgtttatgtgcctagcgcctgccaaggccctccttgcttttgttgttgctgcttgtgagataggaccagctccccccagctgattccactctccaccagcttctgcaacctcagccttggcactttcacctattccagggctgggaagaaggaggaagttagaggagacttgaattccagccatatctgggtttcacctttgcttgaggagtcaggagaccaaaggaaggtgctgggcaaagagaagcacctcgtctcctgctcttgggctgcactggcatctggggcccacagcaggacctctgatcaatgtatcacccagtctctgtcctcttgccgtcacctaaaatggcagattagtgctctgttcttggggcgcttccagtgagaatccactgacaacagtgaaaatcaacacatgaagtcatgtttttaggatggccccaggctcgactcctgtctcagtgtatttgcagtcggcataggcttatcctgcagcagctggactggcagagtctgggagccttgtccccagccctccttggcactgtgttctttacagtaactgaaactccaggcagagatcaaagcaccttgtctactaagcaaacattaacccagcatggggagaggagaaggggctggctgtgcgaagccagccgggcagctcagcagtgggttagctggggcctgcacacagtaggtgctcagtaagtgcttgctgagtgttactggtgttttgttcattctttctcttcatcctgccccaccctgccctggctgctctttgctcattgtatgatccttttcatgagagagtgttttgaagagcgcagacagaatcttaacaaatagcgcattgtcccagcgatccaaagcaggactgcagtgccggggtggcccaaggctgcggggaagaggctggagagagcaaggcctgccggacagtggcagatctctaaggaaattgtcccctgggggttgtggttcttcccatcagaatcaggccttttgttctcaggaatgaggtgggctaagagagagttgattggtttatttttaaaagatcctcagctgataatggtaaaaagtatcatttatacacaaggccattttgtttactttgggacccaaaacttagggaaccctgaattctgtttctcctgtagcctaggcaggtcagccttagacgagacgggtggccccaagcacctctgagtttccaaaatcttgcaagtattttagagacatatgcagtggtggctggagctggtttacagacatatgcagtggtggctggagctggtttacagacatatgcagtggtggctggagctggtttacagacatatgcagtggtggctggagctggtttacagacatatgcagtggtggctggagctggtttacagacatatgcagtggtggctggagctggctcatgttgtgagcctattgtgtacatctcttcccagccttgagttcagtgacttcaccttggtagcttgaaattggccatggcaggagaatttacaccacaagaaatggcaaatgccacagatcatggcgcctccctgcttccccatccccacgcccagctggtcattaaacatttaccagcacactgctgactctttccttaaaagttaaccattgtgggccaggcacagtggctcatacccataatcccagcactttaggaggctgaggctggaggatggcttgatccaacagttcaagaccagcctgggcaacataacgagaccccatctttacaaaaacttttaagattagtcaggcatggtggcatgcacctgtagtcctagctactcaggaggctgagacaggagttcgaggttgcagtgagatatgattgtaccactacgctctagcctgggttacagagtaaaacccccatctctttgttttatttttttatttcattttatgtattttattttcctttttgagacaagagtcttactttgtcacccaggctggagtatagtggcgtgatcttggctcactgcagccaccaccttcgggttcaagcaattctagttcctcaatagctgggtttacaggcatgcatcaccatgccagttgcttttgtatttttagtagagacggggtttcgccatgttggccaagctggtctagaactcctgacctcaaatgatctgcctaccttggcttcccaaaatgttgggagtataggcgtgagccaccgcacccagctgaccccgtctctttaaaaaaaaaaaaaaaaacggaaaagttaactgctgtatacatttattccctctgcctgaacttttcttctcccaagctggcacatggcccaccccttccggtcattcagtctcagctcagatgacacctcagagaggccacatccgaacactcagttgtactgttttcatagtgtttatccctacctgataacattttatgtgcttatgtttttttgtccatgtctgtcccttgttctaatccccacctacagaatttttccttcttctctcaacagcctccttttctgaaagagttcggaacatgtcgcctgatgaaatcaagatcccgccagaaccccctggcagatgttcaaatcacttgcaagtaagcatgagactcggctactgaggtcggatagattagatagcctgggttacgtgtttggtttggtcttaatcttaagagaccatggcagggaaagggactgaggcttctataaaagaaactgacaggtgggaaggatcccacagtccactttacctcctgttagcctcatctcaggagttggctcctacacccaccgccatgtcccgtggtgctgctccagcagggcggccctgtcttgccttcagtgaagtcctaagcagagacagagaaaagaacgtaaccttttctgtgcagccctactgggccagtggtagcttctcagaaagagctttgctaagaaactgaggaaccctcagaatgtaaaataaattacagaaatgaaaaagtcacaggcattatatgtatacattttctatcctaatctatttctaaaatgctgattcagtagcttcttccctgacagaatgtgcagccctgactggaggttttgaaatcccaaggagtcgaggcttttgtgcagttacactccctggggggacagctagggttcagcccgtggctctccttgtccctctgtgggttcccttgtgatgaacaatagaacaggcacccaaggctgcacaatcatggctcctggaccacctgcttcacctttgatcctggagctcccactgggtgcctctggctacacagcaagcccgtgacaccgccctaacggatggatgactaatgggacctgaggctaaggaatgcagcaagctaggggagggccagagcaggactgggggtgcagcacagattcccttcccttcccggaagtctcctcccattgctgggtcgtctccccaccaccgccctccagaatcacgtcaccctccgtgccagacaaccagacaacaagctccagcctgtaaggacgactccagcaacccgccaggcagagacaaacggcgcacagcatacagtgccaattgtgcctcctctttagaccctcctgatggtggaaaccatgacattcgagcaaacattttagttcatcttgagtagtagaactgatcttatggcccaggagacacagccaagtcatctgtatgacatgggttctcctcaagttgccaagccttctgtatatggctccctccatgaccctggaggagacagcttggaggacagaggttcttcagtctcggctgaagtcacagacctctctctgcagttcagctctgctctggccagtcttggtagaaagatttggcctctaacaaggggagtggatcacccctcctgacgtgtcctaaatgttgtcatgtgggccctccaggcctgcccacctgcttttgccggcacagtgcctcagatgtttcccttctggagaatctatatttaacccccactgcagggggaggctgcaggtagatcttgccctgggccagtgcccgccttccttgctaagactgctctttctagaggtggctctgccatgacactctggtgtcttggccctcttcattggcactgggtcatgctgatgccgtctactttgggcatcatgtccatgggctgggcaggacccccttcctgaggacgcctgtggcactggccacagtaggtaagcctggatcccccgaggtggttctccactctcccatcgaaagccagggcagtgacctgtgggggagtttgggtgagagataagcagttaacccttgatgccctcgataaaccagcgcggaccagccacctgtgagcctccccataaaagacacattctaaaaagtttgcaagaccgaatccaaaaaactctattcccgcctcccgttaaaaggacatagcccttccgaagtctcctgtggctcacagttctgctgaggacttgatctcatgttaaaattgaaaaccaggatttagtccctgcgtatcaacaccaacccctaaaccctacttcggatgattctggaactgattaaccagttggggctttgttcattattttctctatggctcctctgctgtgtgatcttttcactgctcactatactgtcatccagagagcgtcaggaaacctcagcagtgaaagcagcctggtctcggtttatcttacttgtgtgcagttctgggcaaaggcagggtggagaaagagaatagattaattttttgttttgttttgtcgagacagtctcactgcatcaccaggctggagtgcagtggcatgatctcagctcactgcaacctccacctcccaggttcaagctattcttctgccttagcttcccaagtagctgggactacaggcttgccccaccacacccagctaattttgtttgtatttttagtagagatggggtttcaacatgtgggccaggatggtctcaatctctggacctcgtgatccacccgcctcagcctcccaaagttctgggattacaggcgtgagccaccgtgcctggctgaggataggttaaattttaacatgaggtcaagttgggctttgcctgactggagcctcatgttcatgctgcacatgtagctggtgaccaggggctgggacggtggaggggtgggcttctgtcatacacccccccaccccctctgctcctcttcacaggacaagatccagaagctttatgaacgaaagataaaggagggaatggatatgaactacattatccaaaggaagaaagaatttcggaaccctaggtaagtttcccttgagcctgcagagtttattgagttattaatgttggactaaggactaagacgtccccaaggaggtggtgaggaaaagcccagagcccaaaccatcacccagacttgtcattacactgagtgcctgctggacatggcggactgtgctaacccagccagaggcttgccatttaagatccagaaaaaacacaaagcaattcataccgagacctagacggggatgagggagacctggctgagttctcgtccctgctctgagcctaaagcacatgacctctcaagtcccctgtcctcatggaaggaattggactagacaattactgtaggttcatcttccaactctaaaaagctgatttttgcatataggtgagaggtcttaggaccagagcgatgtctggtcttcctccattgaatgttcaagctagtgacatacagggaaaagagcatggcccttgtgtgggtctgagtgtggtaagcccaatccagctgtgcagactgaaggtcagtgagacaaaactcagccgtcaccttgaccctgtgctcctcccggcccctagctaacaggtccatctccctgggagagtggagggccatcaggaagcttgcttagagcagctgagctggatttaaaagttgtgaaggttttgtgtcagccccaggagctggatggttcaggtcccatgcagggacgtggacttgtgcctgctcagcgccggcactgttctttcagcatctacgagaagctgatccagttctgtgccattgacgagcttggcaccaactacccaaaggtgcgtctggcacacggggctggagggtgatggggacacccagggtcctttgcttgttccatgggatttgacctgcagccacagaaaggtccacgtggtggcacggctcgttgaaagcacagtccctgtctcttttgtttgagtccctattgttctgaaatagtccaataaagagattccggtggccggcctggtgcctggcccctgactggtggggacatgtgtggacctgctgctcctggggttcgctggatgggggcttcgtgctcccatgttcttcagcacttgccagccgccccttggctaaagaccaaagatgacagccgagccccgggtaaggggaccccagaccaagaagctctatgggaagacttgggccaggaacttgggtttctgagtcatttgtcatctgagtcattcgccttttcctttgcaggatatgtttgatccccatggctggtctgaggactcctactatgaggcattaggtagcctttcgtccctcctcccatataccttgtccgcccacccgactgtccctttatccagtcagttggttatccaggtgacacatatttcagggtctactctatgtcaggccatgttcaagggggctgggtacaggcctgaatgagacagacccacccctgccttaagaggcttatgccacagcaaagaagatggaacgtcacgccagtaacgccagcatcgatgagtgttggtgatgacggagttgctgggtacaggggagctttggcaagcagggtcatctaatctggccaaagggatgggaaggcctcactgacaaaactgtgttcaagctgaggtttgaagaggcagaggggccaggcaggtgtaggcagaatgttctgaggccagtgagaggatggctttttcttaagataccagtttgggagcactgggagaaatgtcaaagggcccaaacccctagaccataggtcttaagcctgcagcccatggcccagatcttggcctgtagaggtgctttgtttggccttcatgaattttgtcatcttttaatttgaattcattgccaacattttatataatctctgattccagcttctctccatcagtaggagggtagtccccattgggcctgtattcccgtgtgtggcagtccacaggagctcaggagtagctgacccttccgggcacacacagggcatgcagcccgccagtctggagctgaaggcccctgccctatgccgaccaagggctggcttcattttgccaagcacaaagaacactgagcccatgaaggcctttagcccgctgaaaagaacgcagggatcagagtaggctccctcagcccagagctgctcgggggccacctttgtaacagcttctcttgtcttcatagccaaggcccagaaaattgagatggacaaattggaaaaggccaaaaaggagcgaacaaaagtaagtgatggcagacctcctagatgaaaaaggcacatgtggagtgcatgggtcctgctggctgagcccagaaggtgtccaggctgcccccaaccctggccccgtgtcatcacccggcgatgctctgagcctctcagcagggcctgtgtgctgagcagacctgctgggttcacggcgctcgtctgctgcttttgccctcggagacttgtttgctacattgtgcccccctttcctccccgccaattgcagagccttggggggctttgtccgttttgggtcatgggggccctttgtagcctgaagggagggaaatagttccctaagagagtgccaggcccagcttgcgctgctcggtgagtgtcttggcctccagagctgccctcagtggctcgcctgggtgctacctattaggtcccacgttagggccctgagcaccacttgttccctggcagtgtggtctgggttcttcagggagcatcagtttggctgggagaccaaactgttatctctgggccttgttccctttgtgaccagtctcagagccgggcatcaggacaccagctcctcccacttctggctcggcctgaccatcctcaagcagctgcggcctccagaccgcttccctcaccccaagcagaggggctgtggggcctgggcatgctggtggccctctggaggtgctggctgctgggccaggaacgtgggagctggtgcaaggggatagttggggtttctcattcttaacccttgattgaatctcccttctctctctttccctctcccttccaaaccccaggcttgttgcagggacgtgtctgcagcgcctggggaccggagctgtccttcccctgtgcgggcgggcaccgcctcctcctgggtgtgaggaggaggggcctggccaaacggttctgggcatgtgaggtggggcggtgggcggggggtgccgggcatgtgcagagacctggtgatgccgggagggatacagtactgtttggaaagttcttttaagagtgaaaagcccctttgggttcttcttagacatctcgccctaccccagatgggcagagcagagttcatttccaatgcctcttttgtgtagtgccaagctcctgtcccccaggagctgacggatggcaaaaagctgtggacacccagctttgcctggtcttattctcttccctctccctctccagattgagtttgtgacgggcaccaaaaaaggcaccacgaccaacgccacgtccaccaccactaccactgccagcacagctgttgcaggtagattgcagagctgccctgcctcctgccacacacatggagccagggtctccctggcttgtttgggcgacagacagcacgtggatctgggcctgggctcagccttgctactttgagaagcacctttggagtctggggtgggccacttcggggtctgctccctagactcccgctggcctgcagggggaagggaaagagggcaccgctcattggtggatcgtgatcctgatttctgctttatctccagatgctcagaagagaaagagcaagtgggattcggctatcccagtgacaacgatagcccagcccaccatcctcaccaccacagccaccctgccagctgttgtcacggtcaccaccagcgccagcggctccaagaccaccgtcatctctgctgtgggcaccattgtgaagaaggccaagcagtgacctgaggggccaccctaggacttgaaaggaccgtgcagcccagtgaccactgcccagtgggaggcgccactttgtatatttcaggactgggacctactccccagatgccacctgagaggagcttctgtttggcattccagatggaaggacaggcagcacgggagccaggcgctgtggacagggtctgtccacgcaccacctggggtctgccgcctattaaaagtgccgtattcttacctcttggcatctcagatgcactggcctctcctgcattctgtttgcaggcaaatgcttcagctcacatgtcccccaagactcaatagtcttggttgggactattgcctcagggttgacaacagggtgatggaggcctgggacgctgttcagaggggtgacccaagaagtcaccgttgttatccgtgtatgcctctgggcatggacaggcgggagtccccgagccccacgtatgccccatctgccgccttgatcccaaaacccagccagttctcgggtgatggtggagctgtgctcccttgagtgcacttgagcactccccagaccagatcactttttggacacacccaggaaggcttttgaagtcaagccagtttccagaagggctggggtgagatcctgacctgtgcagagagtggggaggcgtcagcgcctggccagggctgccccagtcctttggtgcccggtgagcgcagccagcaggagctgagcagcgggggagatgaatcacctcctgccttggcgaggcggcagctcattgtttacaggcaagccctgctcctgggagggctcctgccaccccacccttcctctgtgtgttatctctgccccacagcagcccctgggcagcaccagtggccactgggctccccccggggttgaaacgggtttcccagaccaggggttcagaggagactatttacccttcatgatctttggcgattctccactggagcggaagggctgtgtgtcaaaagaaggaagccaggctgtgaagggccgtgttgctttcagtgggtgggcagaggtttagaaaggtggttctgaaatggcacctggtactcttgtgggacctggggaatataaggaactctgtgcatgaggtttcaaaaataaaaattgagtccactctccccgtacacacacactcgggcacttcaggaggtcagttctcaccccttcctcgatggggctttaaagctctggggagaagagctgctccccactcatgccccagagggactgtgaaaaggcttcctgtgacctccgatggcggcccctcattggccaagggcactgtggatgttttgtgggaggcagcatggcaccgtggaaagggcagtagacgtggagccggcacctctggtctggattccacttaaaaccagttgagtggtctcaagcccttaacctctgtaagcctgtttcttctctgaaatcacagtaataaagcgtcgtaagatggttgggaagaaccagaggtgacttatgcaaaagctttataaactgtaaagttcctgcc

SEQ ID NO: 38257 - DNA, 183520 bp, Homo sapiens
gccggcccacggatcatcagaaggcgcggacctggaggaggcgccccagaaggcgacgcctcttgcctcctgtctctcgcctctcgaaggaagtttgctcttaatttcagagccgggttcgccgtcggatcaacctccaggagctagcagcgggcgcggaccgggcagtttccgcgctcagcacaggcagctcgcggtcatgggcggctcagcctccagccagctggacgagggcaagtgcgcttacatccgaggtacgcccgcccgcccgggggcctggggagcaccctgacccgtgcaccaggctggctgccgcggtcggggccccaaggggcgcgccccgggccctctccctgtagcgcgcggggatccccgaccgcagcccgcccgcgcgagtcgggtttcctgccccagccggcgcgctccggcgcgggtgtggaccggggaccgggagggcttgggagcgaggcaggtgcaggatgcgggtggggacgccggcgccttcgccgctcccgccgcctcggggtcagtgccgcccccgcccggcgcacttcgccctccagtacctgccctggactgagttctgagcggtttctgaactggccgccaagagagcagcggggatatcccgcgtttctagagatacccctggggattcccggcagctaaagcagaatttccctcttagtaatgttggcctggctttggaaagcgcggcgttggccgcagcttcgctcgcacttcatcctagcacttgcaggatgatttcatcagcggcaaaaaggacaatgtcatgccgttcccttcccgccccggagaggggcgaagcaaaagaggaacactggcgtgctttgtaactgcccgaaagttacagatggggagaaactcatttagggagaccctcagagatgtggggactcagtagagagcgtgaggctgcaaaacaaacaaaacaaaacccaaaccgaactgaaactgcaggaagtcctgactcgttatctcctttatttcctgggcgtatttggcctcccctcttctcaccccccaccccaaacttgccttcaaccgctacctaacatttggttatcttaccaatttactgtctttcccccgccccgccgccagatcccccaccctcggcttcagaaatatcttccagactatgtattaaactctaggtttatttggcccttgaatcctttcctaagaggaaatcatttatttggtgttcttattccacatttgttttcagtcaccacaacatttaagaccgttttaaaaagatatcaaatcagggtacgtgaagagcaacggagctgattttacagattcctgctctggtgcttttggaggtaaaagatcctcaacaacctgtactgtcaggggataacacttggtcaagtatctctttgcttttgtttgttaaaggggaaaagacggatgatttatttatattagtaaaagagctgaactaagcttaaaagaaataaatgaagcctgccttagtcttaaaaatgtggctacatgcttgtgttaccagtgtatagggactgaaagggcaatcaacagaacgtagtgagaaagggcttgcatttgaatgttagcaaagttgtgtttaaggcatttatataagactttatttcactggaaagcttaggagcacctaatgtggacgcatggccaagtacactaatcatttgaagttaagcaatgtgaaggattaacatgcttaaagaagacttcctggccgtgccatttgttgctattgatgcaaacattgtactcagataataagaaaatgctattaatttctttattctgaaagctattaaattattacatatacaaaagtacgagggagttagggcagatgaagaacttgtaatgcaagtgtttgaatgagtaaacctatagcatatggtgtgacagtcattacatttcccagtcttgttcagctttctctcttcattctatattcaggagggcacttgcaaggtatgtgtagtgggagagggaagagaagagttaaagttagaatacctccagggaaaaagactcatcacttcatgtgagaatgctagtcttgccaaaagagaaaagaaccttggaaaaatgcatggtgttgtacattgttagtgcatgagcaaatgagggtcacagggctgtgatttcctgatggttttgaagcccaggttcctgagtaaaatcatagccctatctttacctctttgcccattttttagcctataaatattctcaagctttgattcaattgtaagcaaaacgattggaagtatgacagtaaagtttaaatatacttttatgacctgtttctcataaagtagccatcagtgaaatatagatttgaaagctcctgaagctgagacaataactttcttttaagcttgataaactttgctaacaaggagagtagctagtcaatatattttgagtgacttttgttaactttattttgtatgcatcataaaccgctgtatgctactgacgctgaatcagcctttactttaagacaaatcatttaacagctgccattccttgtgtgcctcaaaacatctgtgtcatatggatgttttgaaaatacattgtttcttaggatttagttaatcttcaggtaaagatatatcatctacgttaaggagttacttcatttctaaagatgttagtttgggaaattacggcaatgctcatgtttcttacaacagaataaatttttaggattgtttctagaagcctttcagtagtgtcccttgataagatgtttctattaataaataatactgagaccaacttgtgatcacatgagctgtgtcatatgttagtcttaagtgatgcttttagcactgacctaaaatgatcctttttttttgagacagagtctcactctgtcaccaagctggagtgtagtggcacgatctcggatcactgcaacctctgactccctggtccaagtgattctcctgcctcagcctcccgaatagctaggattacagccacgcaccaccatgcccagctaatttttgtatttttagtagagacggggtttcaccatgtgggccaggatggcttcgatctcctgaccttgtgatctgcctgcctcggcctcccaaagtgctgggattataggcatgagataccgtgcccagccaatcttttttttaatgaggaagaaagctcatagattccaggcatcagtgatcagtttgggtgctcttctctctttatgccatgttttcttttcttttctttttttagttttctgagatagggtctcactctgttacgcaggctgagtgcagtggtacaatcactgtgagccttgacctcccctggctcaggtgatcctcccacctcagcctcctgagtagctgaaactgcaggtgtgtgccaccacgcccagctaattgtattttttgtagagatgggattttgccatgttgcccaggcaggtctcaaacttctgggctcaagcagtcttcccgccttggcctcccaaagtgctgggattacaggcatgagtcaccatgcccggcctctttttctgtaaagcttttggtatgcatgaaattaaactatagcttaaaaaaaaaccccaaaacaaaaccaaaaaaccccccacactgtgttttcctgtttatgcaataattttatttccttctaaaaattacccttgaatttttaacgaatcaaaaagaaagcaaacctgaaagatctcccacataagaagtcctgtggagggtcagaaaagtactggacagtcagtgccgcagctgaaaaccatgggataaacagatcctagtgggcacttgcaggcctgccagcagcaaataccagttaggaaaactgttttcccccactggatttattattgcatagtcagttacataatatataaagggcccagtggcttcctccaaaagcttctcaatgatctgatgcttataaaataagaaatgagtttcagctttaaaatagcacatatttttctcagggaagttccctcttatttatacaagggttaacttaggtggctagatacaaagtttaaagtgatgtgtctagaatgaagtctccatgggcaaggtggaggatggggagagctgtacacatctgtagtctacttagtgtggatgtgtcgtactagtccacacatttgcttcttcggtcataatttgttggtgggagatgggcataagaactggtctgacttaacctgaatatttttggtagtgtgatcttagagtccaagttggctagtaatggcaatatactatgatgagaaagttaggaaatgcattatggtagacaccgtggtatgtcaacccaacatctttttcccactcctccattttttttttttttttttttgagacagggtctcactctgtcacccagactagagtgcagtgggacagtcatggctcactgcagcctcgacctccctgggctcaagcgatcctcccacctcaccctccttagtagctgggggtacaggcatgtgccaccatgcccaggtagtttttttgtatttttttgtagagacggggtttcgccatgtttcccaggctaatctcaaactcctgagctcaagtgagccacctgccttggcctcctaaagttctgggattacaggcatgagcctctgtgcccagcccccattcctttttctaacagaactccagttttgttcaggcattaaaactcctggccaggtttggtggctcacacctgtaatcccggcactttgggaggctgaagcagtaggattgcctgagcccagaagtttgagaccagcctgggcaacatgacaagaccttgtctctctctttaaaaaaaaaaaaaaaagaaagaaactcctgatattgccctctgtttcagagacactagccccatttaaggtccctgaaaggtggctgctgattggtctgtacctgttgtggtggtgtggtctccttgccagtgattatagtaggcatgggattatgttgccagctggtcagtgatgcttgaggggaagtttgccacctgcttctaggcgacttttcttcccttttaaaaaggaggcaaagtgaagggcacttcttctccatcttttgactttgttgcatctgaatgtgatgcctgcaactgctgtttttatcttgatgagcaggaggggagctagcctaaagacaaagccaatacttggagcactgcaaagctgaggtgtctcagagaaaagaagctagagccctgacaaactttgctgatagccactatatactaaccctgcataattcgtattgtgagagccactaaatcccctttgaattggaatagtgaagattgctagttatccacaatagcattctcccattatgtttaatgatagaatccccaaattttagctgtccacatgaactcccataataaagatatttcccaaactcctttgcaactaaatgggagtatgtagctgagttatggccaatgggatgtagatagaagtgctgttctagaaagtgacattaaaggggaagggtatgaccatcttcgtccaagtctccacactgctggctggattgtaaccatggctggacagctgtcatggaccatgaggtgtcctttcaagaaggagcacatgtagggcagagtaactggacaaaaggaggctaagttcctgtggtttcatagagaagaacctccataccagccctggaccatttacctctggaccttaaaaagaaagaaagaaagaaagaaacttccatctctttaagccagtgttattgtggttttattgttgtccatagacaaacctcattctatctaatacagttatcttctttttacgtgcggcccaaagcatcctaaccagtatactaaatgctgccttattgggtcccctttcagaaaaagtaatccaaagaaagtagaaagtgggtaaagattatagtatttgtctcagctctaaatttgtagacatgaataggcttttgtaagaagtgagaaattgcagctcctccagagtagtggggatggaggaaacaggagaaagagggtccactatgaatagtgcacaaatgcatattgatcactttatattttaagtgaaaaaaaatgccttcaagcatgccagactaccaaggaagctagcaggagtttcaaataagtaaaactactgcaaattaggagttgctagtatcaataattactttctatttcctttggtctttgtgaattgaaaccaatactttagaaatgggaagctctttaggaaaccaaatctcatgttgcaaagccatgaaggattttgtgagttgtgatttctttttttttttttttttttgagacggagtctcgctctgtcgcccaggccggactgcggactgcagtggcgcaatctcggctcactgcaagctccgcttcccgggttcacgccattctcctgcctcagcctccccagtagctgggactacaggcccccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgtgagttgtgatttctaagagtcaaccacaaagacagaaaagacagtagactgagacagattaacattttctcctgtacttgtggaacaaagagtgactttccctcttgtggcttctaatacaagccttgataaatcccatggagttagatgatgaatcaagccctggtcttgatgaaaaacttctttttactatggacgttggctgtaagagggccacatcatcaaaggtgctctagtaatagtaactactaggatgacaatagtaatttttattatcttttactgtgaactactgagctttttactttattgtaatctctgggaaggtttgaactgggttcacaggtagaaagtgcaatagcaggagcccaatttgtaaaggtagtttctaatttcattaatataaatgtactgtgaacgttttacaaaatatgcagtgtgaatcatggcagtgaactttaatctcctaatcagaaattttaattttttttagtatagctgggtaactctaagaaataaggtacatataacaatttgcactgtgaaatgggaaatgaagtcagaagtgaagataaaagcataatggaaaggaagacaggagaataaaagcacaattcatctgctacagtctgtttaaggcactttcccaacagttcaaaactaacacacatatgtacacacacacacacacacacacacagagagagagagagagggagggaaagagagagaaagagatttaacagaaccccaaatgcaatacagattttctcctttgaaactggaaaattcattttaaaaacagactagcaagttgctgccaatgcgaaaatgcatgccagcttttaaaaagtgccccctaccttggtactgtatgttttttctcacttagaaaagagaataaacgctttagaggtatgaaagcaattaattcacttttgcaaattgcaggttctaggacctaaggaagtttgtatttctatgcttgatgttgtatggaatgagtctataggattaaaataaattaatagtttttactaggagccccaaagtgacttttaaaaggtccatggtctcaaggaattttggaagaagggtaaatgtctctatgccaaaccatgtggttttttttctttttcctttttaaaaactatttttattttaaaagaaaacataggcccagacagccacacaaaacaaatgcatagcttagtgaatcattataaggcaaatacttagtagccactacgcaggtcaagacatagaaagagcttcactagtcatcaaaggaggcttctgtgtgccccgtcccagttctagacctctttgtttctccaaaaatgaccactattttcagttatctatttataactacctcaaagatcctgactcttaaaacaggtatttatttgctcacaattctgctgaactgggtccaggctgggtggttctactttttatttttgctggtggtcattcctgtggatgcatgcatctggtggatcagctggtggctggacttagctgacaaggctttctttctctccaggtggcctttctacatgacctctccaataggatactgaactgtttaaatggtgggtcaggatcttacattgctagagtgtaaaagcatgtagaagcttctaggacttcttgtggcttaggcctggaatggcgccacattactctgccacattttgttggttaaagctggtctcagagccagcccagattcaagagaggactacacacaggcatgaacacctatgcaagggctaccctggtaacagactaccacctcactaatcctagcttttataataatgtctgcctctatttccttatggtttcatcacccaactatgtatttgtaaacattatagtcttactcacttaaaaagatgtctcttttaatctacacatttcccttacatcttttactcgcagattatctgttgaaagacttgagctgtttgatatgcagagtttttcacagtctggagtttactcatggtgcagttccacacatttctcctgtattttctacaaattgacagagatagtgagacttgatcagtctcagaatcaatccttttttttaacttttattttaagttcaggggaagatgtgcagcgcgtgcaggtttgttacatagggaaacgaagcgccgtgggggcttgttgtacagattatttcatcacccaggtattaagcctagtatccattagttatttttcctgatcctccctctcccctccaccgttcaccctctgatagggctcagtgtctattgttcccttctatgtgtccatgtgtacttacctatcatttagcgctcactcagcagtgagaataaatggcatttggttttctgttcctgcgttagtttgctaagaataatgacctccagctccatccatgttcctgcaaaggactgcatgcatgtattcattgcagcactattcacagtagcaaagatatggaatcaacctaaatgcccatcaataaagaaaatgtggtacatatacaccttggaatactatgccgccacagaaaagaatcaatccttttgtgaagactataggtggtggtgtgtattcttctcttttttttttttgagatggagtctcactctgttgcccaggctggagtgcagtggcgcgatctcggctcactgcaagctccaattcccgggttcacgccattctcctgcgtcagcctctcgagtagctgggactacaggcgcccaccaccacacctggctaattttttgtatttttagtagagacggggtttcaccgtgtcagccaggatgttctcgatctcctgacttcgtgatccgcccgcctcggcatcccaaagtgctgggattacaggcgtgagccgccgcgcccggccctgtgttcttcatctggaggcacataacagctggctgcctctctttttgtgatgttagtagctgttccattgatacttatagctgagacccattaattcactgggggttgaactgtctccgctttagaggaacttgaaattcaatgagaaatagaattaaagtttttgaacggtgaaataataaaggcaacatatattaggtacttcaaaatcatctctaccctcttggaaatgccaccatgaatttcagtattctctgattcggcccatgagcaacactggccaggacagacctctctttcctctccgccaaccttccctcttgtcttcccctagaaagctgccatggagtcttcgttgaacccttaccatgggacagacactgagctaagagcattgcatgcatgagctcacataatcctcacaacaccaaatggagatatcattagctccgtttcacagaagaagcaatcaaggtttacagagaatagagaacctggccaaagtcatccagccagtatgtagtagaagaaggtttgaacttaaatactttctgcctccaaagtccttgctgttaaccgagctgtgctgcctcccagatggtcacagtcattgctcctttcatctgaatttcctcttctctgtgcatgctttttctcacatgagtaagtatcagaaacttttcctgttcttggattttaagccttctggttttctttagagcactcggaaaatcctatcttttgctagaagtcctgactgaagggagctctgtgaaaaactccccatctgcatcctaggcaaactcgttgtcccttccactcctcagcagtcactcaggcattaaacacttacaggattctcattcctgcaaactattaccatcaatggtagaactgaactgaactcattgactggaaatgtatggctcttggttccttttttttttttttagcttatttagtccagtcccttggtttatttgtctaatctctgtgctggtataacaccgatttagttattattgctctatgataaatcttaataaccaaagggcaagaccctctttcttcttactcattgtcagaaggtgtaggctatccttccatatttgttaaactgttaatttcatgaaaaaccattttgtaattttattgaaattgcatgaaatctacagatgaatttaggaagaagtgacatctgtatgatattgagtctttcaaaccttagtatggcacatctcttccataatacatgcttttctttcatccttaaagttgtatagttttctacataacaattttacaaaaatgtttaataagtttatttattggtgcctttcactttttcttactattgggattgtgttcttcttttctattgtattttccatctggttattttaagagcaccagaaagctattttgtttttgcatgttgatctttgtatcctacaaacatctcaaggcctcttattagttgtaataatttgttcattcactctgattttttgtgtgcatgtattatctgcaaatttgacagttttcaattcttttaaatctttatacctcattttttattgaatttactaggacctccagcacaatattcagcaataagaatgacagcaaacatccttatcctgttcctacttgaaaagggatgttccccattttgctattaagtgtgatgttaaccatagatttatggtttagcttaaggatactccccccttttcgttaagttgcttaaaatttttaatcataaatatatactgaattttattaaagacttgattttttctaataatattttaatgtggtcattagaatttcaatatttaaaatattgttccattgctaagatataccctacttggtcacagtgaaatgtctttaaaaaatttttatttttctattacatggaattttgatttgcttatgtatttttttcttactttaccacttgcattaataaaagtcatacaaaatgaaaaaaaatttattgggggttgaaaaatggtgatattctaatatgtcattttgttttcatttattagctgggataattttatagagcaatacttcccatatctatcatttggttacctagtatgatagttcaaaagcaggaaaaaaacattattttttccttttatttaccagtgtttaatataagttactggtttcttgacatcccttaaagatgatcaattgactataaaaatcattatgaactcacaaatcccattgtaattcttattttattgaagctccaatttcccatcattggccaatgaaaaactcttcaagttggctcctgaatcttttggaaattaccccagtagtatttgatagcttccttgccatctggtatgtcaagatgttttaggttcatcctgtttctttcctgtcccatacagggagtaagcaaaatctataagaacctctgatttcttttagtgggaaataatatttcaatattacaatttgaatctagctatgtttactgctacaactgggttggccattatttctggacttttttagtttatagaactagggaaaatatatctttttaatattatatttatacatatccttttccacactgagaatcatggttctcaaaggcactaggcaatgatagaattaaatatacacaaattctcatttgctttatcataccaaatacacacaacagtctcagaataataatacaaatactgccatcatcaattatgattatggaaagctgttgaacaaactgtttttaaaatcagagacaaactttttgtatatgctaatccaattcttccccacgtttattttatgattttactacattaaaccatataatcattatattctattctcttttctcattcactctttgtttcacaatgaagtgttatttaatgcatcagtccttatgttgatgtctctctctggtgtttagagctcatcccagtagattcctcaagaagagctcatgggaacgtaacaaagaagtatgaagataggattaattaagtggctcagtgatatcaccaaaagccagcttatttcttcctactgtctgtggcccaggtctcttatgcttgaaaggtggctgcagcagtaaatagtattaaattcttacgcacagcaatgtcctagaggctaaaaagagatctgtctattctttgagtctccttataagagcaaagaagcctttcccagatgccttactagcagactttcccttacatcccactgatcaaaatggggtcacacattccttcctaagccatcactggcaagagtatggaattatcatgatttggttagaccaatcaagattcacccctgaactggggttagagccatttctctgaagcacatggttatagggagggtcatggatacccaaacagaatcaggttcagtttagcaagaaggaagcatgatggctattaagtaggtaaccaacattacagattttgataagtgtcacgaagggattaaaaacagcactgagatagaaaactgatggtggcaattgggcaaggagatgagatagacttggctgtggtattcagaaggataataagttgctatctgtgtgaagaaccgggggagtatattttggttagaaagaacagcatgtaggctgggcgcggtggctcactactgtaatcccagcactttgggaggccgaggcgggtggatcacgaggtcaggagacccagaccatcctggctaatacggtaaaaccccgtctctactaaaaatacaaaaaaattagccaggcgtggcggcaggcgcctgtagtcccagctactcaggaggctgaagcaggagaatggcgtgaacccaggaggcggagcttgcagtgagccgagatcgcgccactgcactccagcctgggcgacagagcaagactccgtctgaaaaaaaaaaaaaaaaaaaaaaaaaaaaagaacggcatatagaagggggaggagggggaagtacttgaaggaattgaagaaagggtgttatgttgggagtgtagtgagcaagagggaggtttgatgggaggggatgcctattaatattttgttgcctggctgagcgtggtggcttacgcctgtaatcccagcactttgggagtccgaggcaggtggatcacctgaggtcaggagttcgagaccagcctggtcaacatgttgaaaccctgtctctactaaaaatacaaaattagccgggtgtggtggcacacgtgcctatagtcccagctactttggaggctgagacaggagaatcacttgaacctgcagtgtggaggctgcagtgagccgagactgtgccactgcactccagtctgggcaagatagagtagactccgtctcaacaacaacaacaacaacaacattttgttgttgttgttggtgttgtctgtctgccaccactagaatgtaagctgtatgaaagcagggtctttgtcttgattcattgttatgaaatgaatagcaccctcagcaaatagatcagtgtttggttcacagttcctgacagataaatatttgcttaatgcatgaatgaaaggagaagaaaaaattttaaactgtaatgaatatcttagaaaataagagaagtatttcatttgtaaaacaagttcaggatgtgatgaagaaacaataatagaataagaaagagctcttggaaattaaaaatctggtgatcaacattttagaaaatacaattggtgccttggaaaataaagttgaggggatcttgcatctaaattctaagatctaaaattcttatttaaatttaaacagtacatttcaattattgttattaatttaattcttctctctaaaaaatcattttaagcatgtatatgtcagatattacacatttgccatagttgcttataaaacttgtctttattttaactttaagcctctgtctgctttgcttagacaatagagtacaaagattaacagatggaaaatagaagaggcaatataaaaaaaattaaagggtcaatccaaaaatttcaatatctgactaacagaagtcccagaaaacaagagaacaaagaaaatgaacgggagaaaattattaaacaagtaaaagcttattttctagaacagaagatcatgtgtctctgatttatagggccaaagaattcctggacttcactcagagctggaaatagttcatgcttccatcatccaaagtagaaaggccttatgatagatatgagttagagtcttcagcagtagtgagcagaaattagccctagactagaaggctgctctggacctgctctaataaaaatttaaaagcaaacctcaaacagatcaaactgatcccaagtaacttaactgcctgcttgaataaagtgcaaattctttataagaatgcaacaaaatacccatacaacaatgtaaaattcacaatatctaatatccatcatccagttaaaaactatcacagtaggcagaagaagaagcaggaaaatatccacaagtataaagaaaataaatcaatagaaatagactcaggaattatagacatggcgaaattagcagacaaagatggtaaagcagtcattatatgctccatgtgcgaacacagaggcaaacgtgaacatgatgagaaaaatggaagatataaaaaaatcttcctagtctccagtcttcaggcaagagcaatatgactactgtgtttctgtagcctgctggaacatctaggcagaatgtagctgtactgccctgctaccaacattctccatggagttgggagaggaacgaagtagcctgcagagaactgaatgtacactgggagctgctgagatgtggctggtctggggccagacagctgagcaggatcagttcagaaatgagggaaaactgtggatgttcctttaaaaagcacatcattattggtggccttgtgcccttaattctggttcgcacacagaacaagtgacaatttccatgattagctaaaaagaattcagagattttccaaatttggattgaatgcgtttgtttaaaggattatttcctgtgtaactcattcaacacaagttatacaggaaaaattgcctaagcaaagcagatgcaggcttagagttaaaataaagccaaattttatgagcaacaatggcaaatgtgtaatatctggagtataaatatttaaaatggttttgttagagaggagaattaaattagtaacaataattgaaatgtatggtttacatttaaagtaagtaagaattttagagcatgactaagacctgagcatgtcaagtgagatatcagttcctaactaaaaatgctaactcctggcctgagaaatgataatcactgtagtaaaagctaacatttattgagtgcctactatgtgccaggcaagtaaatatcttagacgaaaggtaacagggtatcaaatgctcttccagaaattctaagtgtttcttttagaaattccaagtatacatagctttttctttaatgaaaaggagtatcagcgtgataggatttgaacgctcagctgctttagctaccttaaatgagctaagtggaaacatttactaaacttttgattcaatatcttaattctaaattatttggctatttgtgtgtgtgtgtgtgtgtgtgtgtgtgtgtgtgtgtgactcctctgtcacacaagctggagtgcagtggtgtgatcttggctctctgcaacctctgccttccagcttcaagcgattctcatgcctcagcctcctgagtagctgggactacaggctcctaccaccacagttggctattttttattgttttgtatttttagtagagatggggtttcactatgttggccaggctggtcttgaactcctgacctcaagtgatccacctgccttggcctcccaaaatgctgggattacaggcgtgagtcactgtgccaggcctttggctactttttgaagtggatattttcagtgggtgagatggtagattataaatagcttaatccagaaattaaaagtcacctaaatgttagcaacacctaatatggaatttatgaatagcccaaagcagcctttgcagccactttaagctaactttaaataaaatgatacctttatgcaacttcttcattatcaaataaaatatttatatttgggaagtaaggcatacaataaaaaataaataaatggagctttcacctttggaaaacaggcacgataatttcctgaggactcgctgaatctgaagttggattctctggagattttggacttgtcaactggctgccttcagtttctcctatgaaaatgaggacagtagtaatgcccagtgagaaaaggagggtcagaaatgaataatataatgtaataaatgtgatataattctcacatttcccagtcctaccattatgttaatcaatttgttttactatcagtaatggcatcaggcctttgcagagtaaatgattggctttcacatactgctgaataatacctagcccacacatttgttctgcagactaattaatgtttcagagtgtttaaacacaatgcctctacagaagcaatggcattataatgtgttgggacactctagtgttgtaattagtactaattaggttcttttcaacagcttgttgaatttacaaattactgcctgtgaggtattctgctttatttattcattatgaaagagtcggacgcagggtttaaataggcacctttaaacaactattctcaaggtcctacacatactcctcccctcaaaccagggaaggacaataggaagacacccttctcggaatggttgtgagggagagcaaccccagtgctgtgctaggagccagctcacactggctggcaacagctgaatccaggcatcttttcctaactgtgagctcagtgatatcacattgatagcttgaaaccagcgatggtgggagtctttttgtgttgttgttggtttttgagacccagtttaccagcacatcactgctggtgtcttctcttcaatgcagggaagctggtggcaatgttaaccagtggcagtggcctgaagccatgtttcagttgtacattaattagaatggtctaactgctgaaacagacatcaacgctcagtggcttatagtgatttgtatctcactcatcacactatccagggtgatttggtggggggctaatgaagggcagtgggcttgtgtgtggacccagactcttttcatctagtgcatggtaccatggacacctttggtggtttgttaaagcctatggacccctttttagagtaacatttttaaatgaaaaaaatatagagaggatgataaaagaaaccaattttattgaactgtagttatcaaaatatttttaaaatctgtgatatggtaatatatgtgctctttattaatgcattcaatgacaaggtctcatggagggtttaataactactgtcattttgaagaagtgctattctaagatatgcagcaacttaaatgtgctacgaaaacatctgtgagctctattggtgacaaagtcacaagtactgctaaattacactgttttgttgcctacattcagggttggagaagtgctgaatttgagttgaaggttaataaaacacaggtgttcttttcctccattcagtgtttggatggcctgaattctatccacagagcccatgagggtctacaggctccagatcaataatctctgacctggctgggcatattccagcaccttagaaggcccaaggcaagaggatcgcttgagaccaggagtttgaggccagcctgggcaacatagtgagacctcgtctctacaaaaaacaaaaatgagccaaatgtagtggcgcatgcttgtagtcctagctgctaaggaggctgaggtaggaagatcgctggaacccaggatcaagagatgctgcagtgagctgtgattgcacaactgcattccggcctaggcaagagtgagaatttggctctaaaaaaaaaaaacaaacaaaaagaaaaaataatccctgacctaatggctagtggcttcatgattcttagggccacaaagacactaagtggacactgtgcatacatctgcagataagggcagatagacagtggaggattatgtgggtagattttgtgctccaggcctggaggtggcatacattatttctgcccaaccttctcatctctacatgacacaccttgcctttgtatctttccattggcaattcctgtcaaaagtcctatcccttgtttttattgtcactttttcctttatatcaccctcaacatgttgaacctaacatttcaatgaatacattttctactttaagtggattctaattttgaaggcagggtataggcttcatattctttatgtaagaaaagttgagtctgggctctgtggctcacgcctgtaatcccagcactttgggaggctgaggcaggcagatcacgaggtcaggagattgagaccatcctggccaacatggtgaaaccccgtctctactaaaatacaaaaatttagccgggcgtggtggtgcgcacctgtagtcccagctactcgggaggctgaggcaggggaatggcttgatcctgggagacagaggttgcacactccagcctggtgacagagcaagtctccatctcaaaaacaaaacaaaaaagaaaaggaaaggaaaggaaaggaaaggaaaggaaaggaaaggaaaggaaaggaaaagaaaagaaaagattgaagccttttatatctatttgtccattgcagcagccattagggacatataactaatgagcacttgaaatgtggctagtccaaattaagatatgatgcaagtttaaaatacacaccaattttgaagttttagtacaaagaaaataatgtaaaataattaatattatttaatacaaaactgctatttaatagcaattacatattgaagtaatacaattttggccctatgattgggctaaataacatatattaaaactaatgtaatcagtttttaaaaaattttaatgtggctactggaagaccaaataacatttgaggcttacatctatggctcacatggcatttcttttagacagctgttctcgaataaagattcatagaagattcatagagctgcaaggaaacttagagataagcatctaatccaactcttttattgtaatctcagaagctgaatgagctgttctcatctgcctagctagtaaagcacacataggcttggaattcaggtctccacactcctggtgcagagctcttttcataatccatggtatccaaccaaaccaaaccaaacatttccaagatttaagtttccagttcaaaccagaatatactctgattctgagttacacataagcatcccgaaaatgacaagccttttttccaatctgatgtattttcaaccctagacttaaaacttaagtataatttgccctgcccctgaagaactgcaggcacaagcagccagccagacaggctcgtgcttgactccctcattaacccagataaaagaggccctgaggtcatttgcctttgccctggtcttctgcatttcccttagctgaatggttaaactcacaaggaaatgctaagattttcttatctcttctgaattttctcttaaagggatggaaagatatgaaaacctagtatttcacatgactacccctttttcctagccaggaggtggcaccgtggatagcagttaagggaaataacagatgagtttcattctcttttgtctcattttctgttcttggcttccactctagacctataaccaaattcccaaggtctggaatattttctgaactttttgtcctagaatagtccaaggtttcccccatccaacttactctccctctctaactcaccgatttccataaaatcacatttgagccgttgtgtatgtagataatgtttcagataagggcttagatgtttaaaaagtttcttatcttaaacaatgtagtaccaatacataatctttcccccttaggaattttgagtaatgaagtgctccttgaatcatataatttgcagttgaaattgaaataacataattaccttatccagtgttctttggaaaacaccgtcactagactctgaggttgtctcattttctctgaactttctcacctttttcagtgatttctggaatgttaagttctgagaagccataagatatgtctcctgacccatgacaactttagtgactaacccacttactcacacatttcatgtttcagcatttcctcccttcggtatcattatttggcacttccacgagaaactcctgaggcgtactatagctaactactttgtttatttcagatcatcactgctattgacatcagtggatgtctgagaaagggagcacaaaccttcatgtctccacatgtttttaatgaaaatatttgatgccttaaggtgtgctgataaccaaactcagcatttctccagggatatgtttaaatttctgcattgttcattctaaggagaaatatacacatatgatgtattttgcaaatgagcataagtttcactaagatatgtaaaagacgctttcaaaatgatatttataatatgtctcatttttagaagagtggacaaaataaaatgaacttacagagcaactaaacccttaagaaacatttaccataaaatgttaactgtgtagctttcttgattcagtagggcattggctgtggaggtagagcacccaagtacagataatggccccatctcttgctagctgtgctaccttctgcaagttatctagcctcctctaaccttggtttcttccactacaaagtggggataatagtacctccgaaggctgttgtaaagactcattgcactaatcctcgtaaagcacttaacactgtgatagggacatggactctcaacaactggttttatcacttataatagtataccttctgcaacctaaagtcaaagattttaaataaactgtacatcaaataaaatacttttcttcaaaatccttagtcaaccattcctggagccagttggaatcagaactgaatttctatatattttctataatttatggagttgagacttcagtatgcttcagacttaatagacagcataaacttgaggggcaagtacatgaacttggtgtagaagaacttgtttgaatcctggttctggcacataccatgtgactttgggcttgtctttaggcctcggttttctcattagtgaaacaagttgtttaattgattgattaagtcttttcaaaaaaacttacttaggatgaacttataaaccttaatttgcagcatttagtttagtccaagcttgtgcaatccatggcctgtgggctgcatgtggcccgggaaggctttgaatgtggcccaacacaaatttgtaaactttcctaaaacattatgagatttttttgtgtgcaattttcttttttagctcattagctatccttagtgttagcatattttatgtatggcccaagacaattcttcttcttccaatgtggcccggggaatcccaaagactggacacccctggtttagcccttaaaacctcaaacgtcatggaacacatctatttctttttctttttctttttttgagacagggtcttgctctgtcgcccaggctggagtgtagtggtgcgatggctcactgcaacctctgtctgctggactcaagctatcctctcacctcagcctcctgagtagctgggactgtaggcatgtgccaccacacctggcttattttttcaattttcttttgtagagatgaggtcttgctatgttgcccaggctgatcttaaactcttggactcaagcacttgcccaccttggcttcccaaagtgctgggattataggcgtaagccatcatgcctggcctatctatttcttataataatgaagcattcattgtgtgtctttccttctagtcatcaaatagaaatatgccctgttctgtgaaacgggatgaacaaagcagactaaatccctgctctcatgggacttacatcatagaggtggtggtagggagaaataaaactaagaaataataagatggtatcattaccaaggatgatgaagcagggaggtcagtgtggttacggaggaatgagcaatgggaactgtgagcagagacagggcagcaaggtaggtgggatcacatctcagggggacttataggccattggaaggacttgggcttttactctgtgtaagaagagaagccatggggagtttcgaggagaggaacgccatagtctgaattatctgactgttgtgtagagaatagactgtaggggggacaagggaggaagcaagccaaacaggaagaagctggagctgtgatccgggccagggattatggtggtgtggactagggggtagctggaggtagggagacatggttgggttataaatacattttggaggtagagctgacaggatttgctgatgaagtatgtggaatatgaggggaaaaaaagtggcttcaaggatgactccacaatttctgacctgaacaaaagaaagaatggagttgctgcttattgaaagaaggaagactgggggaacacatttgatggagaaaatgaagagttcacttttggacaggctaagattgaggttcaagtggagatgtcagctaagcagatggatgtctcatctgataatcactgtcatttgttaagtggcatccttaattacctgccaggcactagggtaagaacattacacgtgttacctcatctaaattctcataataaccctccaagataggtactgttatcatttgcagatggtgagactgaagcccagggagactgtggcaaaggccacacagctaatatttaatgcacatggtcctccttgaagccaatgcctcactcttgcatacaatgtcactcactacatagccatgagaggaggcggctgggtgtcagaaaaactgagctgagttcatgctcccatgaggagtttgctgtatggcttatatccattgcctcaacctctttctgtcttaattctcatggataccttgaaggttattgaattcaagtcagaaatatcacttactatttaagagcagaaagatgctgatgatatatgctcacaatatattttacttctgaggattacaagtaattttcagcaccaaatactgtaattcaagggagcggtaagaactgtcatgtaatgaaattattgtttcccaaggaaatcaggttggatgctgttctatgtcgattattgtcttcttttatagctgaattaggcatgtggccatgaattttcatttctagcataacctaatcgaaaaccagcttcttatttgtgatgctactgagcaagtgaagtttttcaatctatatttcacgatagcctttagatgaacaagcagaagtataatcatgatgttctcatttgcataagcatcttcttgacaggtcatcagatatctttattgttcttgggtacatttcatgggctgctgaaagcgtgcataatgatctctagcaattcatctttttacctagcttaatggcccttgttacatattaggagaatgatggagtgaaaagacaaagtgtctggggcctgcctgcctaagaatgtggagaaaattacattggggaataaattatattaactccttctcatcattcacttaccttttgtaaatttcatctcactatgctaaacaatcctggatggcctgggaaaaaagtcgtgcaccttctcactaacaggctcagattccttgttcatcgttaagataatagagaccattatattatctcatgagattatctgcatctaaattaacagactcctctgcactagtgaacagggtgaatgcattcatttgggttggggttgggtggggttcttacctttataactcttgttttttttaaaatgattttggagataaagcaaataaaaaatcattatcttgatagagtagttttaaataaacatttgatggaattatctttttattgtttcattcttggcatccattcaataataatgatggtggtagtgatggtgatgactgttgattgcctgggggtgcaagagccttacctatggctggtctgtgacagagcagggaccccaacccagtactgcataattttctgtggatattgtcatccccaatttccccattagaaactgagacctaaattctagtctgagattcttcacttgattatgtgccccttagcataatcctagttcagttttaatagtcactctgaaggaaaactttttcacaggactaatgactcctctgctttcaaagggaagtgcagtgtgctatctcttactcttatttaaacttatagttagttggacaagcaggagaaaaacttgggtagccatgtgactcaatggaaagagtggaagaaggattggggcagcccatgtttgggtcctctttgcgcaagttatataactgagcctcagttcctttgtatgtgaaatgggataataacaactaatttacattttgttgtgagaattaggttatgcgtgtactgtgttcataagggctcaataagtggtggttattcttattactataagccagtttatttgaacaatattccactttcatttatttatttatttattttttgagacggagtctcgctctgtcgcccaggctgtagtgcagtggtgcaatctcggcttactgcaaggtctgcctcccgggttcatgccattctcctgcctcagcctcccacgtagctgggactataggcgcccgccaccacgcctggctaattttttgtatttttttcttagtagagatggggtttcaccgtgttagccaggatggtctctatcttctgacctcatgatccgcccgcctcggcctcccaaagtgctgaatattccactttcaaagaaaagaaaatctctcaccaaatgtcagagtatagcaaatccaaaagataaatccaaaagattttagaacaaaaattagggaaaaatattaaaagccattatttttatttaaatattttaagtaacaattctgattctaaattactacataaaacatgaagaaaaatagaaaaaaataaattatccatgatccttcaatctgttgttaagtaatataagtatctatttcctttctcttctttctctttctcttttcaatgtttcatataaacatatccacacacataaaaaacaaaatttgggtcatattttgtacaaatcggtatactgccactccacattatattgtaaacatttcccttatcattaaatagtctccgaaatcttaagttttattggctgtggaggatgctggctgtcgtatatcctgtaatttatttaaccattctcttcttgttggacatttaggtcattttaaaattttcattattataaataatattttagtgaacatcctaatgcataaatatttatatgaatctctgatcactttcttagaattatttcttaggtgtcaaaatgtgaataattttttaaaattacagttttaaaaagaaaggccatcatagatgcataatatatcagccacactgaatttctaacctcttggaacacagtaactagtctggactcctggtagcagaagttttatcttattcattttcctaccctttttgtgttccaggatatctgtcctattaaggtcaacttgcttgtggcatgaatgaataaatgaatacatatatgctttgaacaggagttaattgagtctagacctgtttcagatagaaatgtgctggaattagctctttctaagtaccatatatatctaagaaactcttgaaaacaaattcataagcttatataatgactataattcttattcctaaggattttttttttatttcctatttttgaatatcccaatatgcttatctgggagtaggttgaataaataatttgagagttctttttctccattatttttccattttgctggaagtggaacatttgggggacatttctgtatgtcttatagtttaaggagattatggtaaaggaataaacatcacgtgcttgctcttttggaagggaatttaaaggtcattaaagataacttcatgcttgaatgcccttaccaagggggtaagcagctttcaatacctccagtaataagaaactcactatctcctgaagccagtcaattcatatttggacagttattttgttagtgaattgtgccaggactgaattcttcctaatttctgcaccaccccttggctcacacttagctcctgtgccaagtcctctgccacttcctcttgcctaggcccagccagctctctctggcctctggcccctggtcagcacaaggctcctgtctgtataggaaggggggttcaatatacaggaatctgggcttcaaacccaggattatttggtcaaagccaggccttttaagaaattattgctggaaaatatacatatttatcatgttaaacattggcaacttgcaattcagcagcattaactatattcacaatattgtataaccgtcaccactatctactcccaaaatgttttcatcatcgccaacataaactttgtgctcattaaataactccccattccttctcctcccagaccctggtaacctctatttcactttccatctatgaatttgcctgctctgtgtacctcataccgctaaataatacattatttgttcttctgtgtctgaagccaaacccctttttactacagcaccctaccttcatagcatcgctttctatcactaatgcaatttgtctacttaaccttcttaaagtcatttgagtacaagagctgtcatacttttacaaagatctcaaagacttggactacatgtcatttgatccaacagaaagcaaggtaggagaaacaatgcatttcttttcttttcttttctttttgagatggagttttgctcttgttgcccaggctggagtgcaatggcgcggtcttggctcaccacaacctctacctcctgggttcaagagattctcttgcctcagcctcctgagtagctgggattataggcatgcaccaccacgcccagctaattttgtatttttagtagagacaaggtttctccatgttggtcaggctggtctcaaactcccgacctcaggtgatccatccgccttggcctcccgaaacaatgcatttctttgttttgaaccatgtactccttttaaggcagctttttcttcctgttgttccagatttctttttatgaaaatatgaagagtggagaatgtggccttccactcccaatagcaggtattctagtttttattctgctttttaaaagaaaatatctctattatttctccaataaatttgatagcaacttttagtttagaaacagttactatttatgatctaattttttatcatgaaatttcaagacttcccattactgtcaactccataatctttcctggtattacagttaagctccaaggcgtaaataaatctgcatacatttccattcatccttcctctttcctctttttgagaatcagatctacaattgtccattcaactcttccagcactcccacaggttaacaatagtttagcattcttatttgtaaattttctcagcatgctggattgttgttattttatagcatctcaaggctcactttaaatctctttactaatcctcagcttcctttttctgtaaccatatttagtctactattttaagtctgaaaatcactattcttggaagagaagtaattgcgaaagtaataggggagcagttctcctttcactttgttattccagcaacatgatgtcattggtgccaaacatctggcttatttctcccttgtgttccttttgtgcctaacataaccattagaatgcttcttgttgttcttacaaattataggtctcaatctatctgtccctgtttttggagagacccaaaactctcttgcatttgttcttgaggagcccctctttcttttttttttttaatcccagcgctttgaaatcaggtcataatagaactatgtaggaacctccatccttccttccttggtggaatcaccatctgtgactatacagacaaaattgtccatagtctgcggacagatggatgctatttgactctcattcagaacgctcttcccacagagtcatgatgctgtttctgctgattcttttgaaatctgccttcttgaagtccatgctttcttgtcatattttcagcgactctctatctggctatcagaaatgtcagggtaaatgtcttttgtctattgctgttggaatggagtgggacaattaaccaaaagaccgttaaagtagcaaatcattaaaagatacacatatcttgaatcttttaacttaaaatatgttaatgaaacaaatatattcactcgctactctttgacctagggctaaggtctttttttaaagattgcttgcagttccatattgtcatttttgcatcatctataattttcagtcttaatttcttttaagttgggcaagaccttgtaaagaaatctgatgacagaatccatctagatctgtatttatagttgttttacctacatgtaatttaacagtaattatttttagaaactctttatcaaaactttctaaagcatattttacagagtgaaaagccttggatgagtggagggtggttaagagggtttctgccatgttctctcatgacatcattgatttcacccaaggttcattatttcacttcactagctggtatctctccaagtagcagttcccctggttacttcctctctctgtaaagaaaaattcagtgcaggcagtaacttgccagactttctgcttttagtttagtctccaatcaaacgcagtagaagtttcccatcataactgtttcgtgcctctgtgccagcattgtatactaaattaggaacatatctctcatttcttccatttggccagatagtttgttaatatctatttcatcaataatatgatttcttttcctcttatttaattctttttcgaatgcctctgtgtcctcattaccatctaggtgcatggattttcacacaggtgaggggtatttctttacctcctttccttacagatatttctctggaatacactaaatcccagtaattattatgagattgtatttaccaccttattctcaagttcccatgctctggcctgggcctatacaactaaaagacccttgagagtattactttgggaacattttccagttgttttctgtaggaatctcatggctcctctcccactattctttttcccatgacattactgcagacctttatgacaactggtttcatggttttatataagcattgctttctttactgtcctatactaagtttagagactgcttaatagtctccaagatgttcttgtcctcatgacatgtactccaaccctacccaaagtccattcctgcattacctaaaggcatcaaacagaaaatatcctattcaccacgtacctcttcatagttagctgttcactttcccaatattctctctttttcaaagtcctaaccattgagaggaagaagctacaagaacgccacctgtgtggctgggtcttctagtcttcagcttgtgacttcttagatgccaatgctgcttctctgtcttctagcagtgtggtcattcccataaagacccaagtactgaatcatggactagtgggcttagtatgtctcagcagactattataatctagaactagtcaccagaaagatggacaacaagcttgactgaccatatcttatctgcacagagcctttcactatcaccaatgagtggtgaccatcatccatcctctacctcccagggcagcagtgggtttcctttcactagtggtacttggatatcttctggatatgacttcttgatgctccatgtacacaaagacagcaatcagcaacgtccgtagaggtaattgtatagctgttgctgtacaatgtgtcagggacaaatgtagtgtatgatttttccatatgtctttttgcaagatcatcctatccatcttaccctgtttttgtgataagcttaaaatcctgagctttattttttccctttcggttgtactcttccatagtgaactatatactgttatatcacctcggtgtctagtgcagtgtgttagaaaacttagaacttaataaagatttttaagttaattcacataagctaaaattccacttatatgagcaaagattttgggagtcatttttaaaaattttatttatttattattattattatttgcttctctttgataaccttggtactaagatttttgggggtcatttttgaacaataatttgcagttgctgagttattagtctatgacttgctacattgcattccttagcaagttgcaaatattcaagcagcaagatatgtggtcaacttctaaataatatggttgttgctgtttttttcctgtgtcattcagcattaacattatcctctgaaccccaaatacaacctctttgcttctatcaggaaaatagaaattcttctctaagaaatggcattggtgcattgggagactaaagttgcagtgatcggatgcctatattaatcccaaagagtcatcatttgaaaaattgaatttaagtctgaaataaaacatccataaaattgaactgtagtctcttttctttactttctcaggctaaaccccttgtttttccatttgttggccaatgaaggcttctcatggaactcattctgatcaaattttgtaactgaaaatattaggcttgctagttttagaagggttcttcacagacatctaaatcgaagtgtcttgacttgaggtcagggaatgggaagcagcagaattttatgtctactatgtttttctggtatccaaagctttcagcagatcattaaaggggcctatgacccaaagctaatcatttttatagacaaattataagaagagatatcactttccaaaacagcaaaatgctaagctctcattccgccactgatgttcttctctttgcctattactttttcctcttcttggaaagaataattgaggatttttatggaacatcctgattttcgagtcacttggaggtcccttttctcatattcgatgtcacaaaccatagggctggctgcgttgtcagtgcagagttacaaggtgagtgtgagactgctcctaccagccattgcctcagagctgagtgtggccagttaggtaggcacatcagcaggcagcgtccaggaggaacctgattcttttttttttttttttttttttgagacggagtctcgctctgtcgcccaggccggagtgcagtggggcaatctgggctcagtgcaagctccgcctcccgggttcacgccattctcctgcctcagcctcccaagtagctgggactacaggcgcccgccatcacgcccagctaatttttttgtatttttagtagagacggggtttcaccatgttagccaggatggtctcgatctcctgacctcgtgatccgccagcttcggcctcccagagtgctgggattacaggcgtgagccaccgcgccccgcggcatctgtcagtttcatttgtgttcttcctactatgctagagatgtggtccaaagctgtttttgtattttataacccacagattgcatctcttttaaattgaaaacaactaaatggactaaaaaagtataactttaatgcacacagcaagtggaaagatacggtacttaccaagttctttttctgatagtttattattgtgtttcttggcctgtataactttcattatgatctctatcagctccctgagaaattattcttcagatcaataatttgtgtgtatttgagtaaatgataactcaaagacttcaataaactttaaattgtctacttaatttgtttttttaaaaaactgtaggcacaattatgatactatgcattgtcttaaggtagtttctgttattgggttattaggtatgggaagttgagtcaagattactcagagagtcgcagaatgagtggccgaaaaatttgttacaaattagggcaaatatggtctcctctgtctgagcagctgatctgctactgaaccccggttgtagctgcatctctgagaatactgcagcaacatgaccacagacatcaatctgtgttattacttagcatgggacacagggaaacacttctgactggcatttagtaaacagagtaaaacaactatcattgtaaaatacatgtgttatgcttccccatctcacacccccaggtatctaaattcagatctatgggatctttcccaggtttttttttttttttttttgagacagggtcttgctttgttaaagcccaggctggagtgcagtggtgcgatcttagctaactgcagccttgatcccccaggctcaagtgaccttcccacctgagcctcctgagcagctgggactacaagcaggtgccaccatgcctggctagtttttgtattttttgtagagacagggtttttccatgttgctcaggctggtctcaaattcatgagctcaagcaatctacctgcctcggcctcctaaagtgctaggattataggtgtgaaccactgcacccggctctcccacattctttaaatgaaagtgttgacattttaggtgtttaactttcctaatttagggtgttcaattaggaaaagaggaagtcaaattgtccctgtttgcagatgacatgattgtatatctagaaaacccctaatttagaataagacttagagttgagagggaaaggattgccaaatagtttcaattgctttagtttactttccttaatttcttctgtcttcaaactcttctcctttctttttcctccttcttccatttgtcaaaactgtaagtgctttgggtactgtcctaagtgatgttcagagtcaatgcaatgtatatcaaattttcccataatgtgaactggaaaataattggaatataagaaaggatagactgacgtgtgtccggatgccttctctgttgtacctgtttgcggcacattgcccgcttaacccgctaggagatgtaggaagtcaacctgttcaacacatctcaagcagatcgaatgatgaaatgttgatgatttcaccataccttttccactaagaaatggaatgatcctcctcatatttttgcagcggttatctatttcatctattaactgagaatgcagagtgtgcctgagcatttttactcacagaactaatgaaaaaagttaaaaaatttttatgcaagtggtttgcttgactttcttgcaaaatgctcataggaagttaataggaatcatattattatcagaaggttttaagacaacactagttctccccctagcccactaccaaaatacactgtggtatactaatttacacaaattaggttactatatacttgttactatgctttcatcacaaaagtatttaaaaccaacacatcatagattgttttctttcctatattttaaagccactcaaagctgagtggtatgggagaagtctgtggtattatacaatttgaggaattcaaaaagttccacattactgccaggcctgctaaagtaatttggaggaatttatttactatcatgcttccttgctaccatttacaatcactgatttgttaaaactagatgttttgcagtggaagtggagattgtatttagcctctgaggtccagccacggttctgctggtgccggcaatccaggggttttggctcctggggtctcttgtcaacatcatctctgggtagccagttacccccaatgtcctttttcagggcacagggtgtctggccagaatccccacttagcccaggacctggccccttcacctattccctcttattctgcatctggagacattgccttctcactggttttgtctcatcccagaaacagtctaaagtctttcaaattcagaatcaccatctgcttattggatattttctcctgaagatattctgagacactcccggaaccagatatttgtcactgaaaattttaatttattccatattttccaaatgccataatggagtgtggagatacaaagatgaataggatttacccctacccaccagaggtgtgcaatctagtgtgggacacagcgctctaagtatggaatagtgatagcagctagcacctattgagccctgaccttggtaggtacggcagtaagcccttgacataacttactccttgtaatcctagccagttctgtaggtatcagtatctccatttcctaaatgaggaaagcaaagcacaggaaagttagataacttgcccacagtttttctggtgacaagtggcaaagcagagacttaaaaccaggcaatccaggggctttaagtgattcttaaatattaagtgataaatgcatttaaaatgtgtccggaatgggctttgtgaattccagaaagggaactaaattctgcttaaaaagagaaggcttctcaaagggagtaatgtttgacttgagacccagagaaggagaaaggaaggaagcttgcagaggagccttggtgacaagaggcatgctctattgtggggacagtaggaataggggagaagccttggccttgtcactttctgctttttggtttatgcagttgtctctgcctaagatttttttctacctttgtttctgcctccagttactccccctggaagtgtcactctcttttaaattcagagagccttgtttatggcactgatgtggtgcccagtgcattctgctttgtactaaatatgctgtatctcacctttgtgtcagcaccaaactgtgttctttataattctgcagcttctagtacatttgtgcatagtagcaactcaatgcacatttgttgaatgttgaatgaatgctagtcaaggcaagacaagcaaaattctcaaataagtcaaaataatccctaattatttccagatggaatggtaatcaatttgcttcaggaataaattagccaatggatgtttgataacataaccgaccctaagtaactcgatttagctgctgaagccagcttttaaagatgcagtttatccactggccatgggatatcggccatgattactggagcaagccctagtaatacaatctttatataataaatataatcttactaaatgtcagtgagaattatctttatataataaatacagtctttaaaattgtatttatatttggcatttatgcctctcagcactatgtaatttcttattagaagtacactttaacttgagaattccattagaatcattaaattttctgaatagaaagcttaacagtgtttaaaaataaatttttagtggcttcatgatgtcaaaacaatcacttgaaagctgaaaaatatgttaaacctacttttgtatttatgtcccagtttgcttttttcaattcacaaaaaaagatttgacttgattacaaagaagaaaacacagaaagagcaaaaaagaaaagaaagatgaaaggaaggaagaaagggagacaaaaaaagaaacaaaaagaaaaaaagagaaagactgattatctagttgttttgtgattaggtagacataactcgagaatcttggagccatccttatctcttccctctccattacctgccacaaacaaccccccactaaatagtaaattcttactccaaaatgtctttgatattccttctttcttattcatttccatgtcactgcctgacttcaagcttttatgaagcttgaagttatatatcaaattgtaactgatctcctaattctcattttgtgtgtgcattccccaaatcattcttgacatatctgtgcaaatctcagcatgtcactttcccagtagtaggtatccatcagctccctgttaatctccatgaccagagattctgtccacctctccagcctcatcttgtgagcttctttccaatcacctcatcctttgcctccttagcttttgcctcggctggcctgataaacctctacctgcctgccaagtttcagttcaagccttagctctctgtcaagctcccgcagtccctcacccggactcacatgctccttgcacctgcagtgggtcagctgctttacatatattgtactctttacttctcacgtagctgtttaaggtgggtggtctttgtctccactttgcaggtgagaaaagtgaagctcagagagcttaagtaatttgctgacagtcacacagtaagaaaatcagtggcaaactgaaatacaaagaacctgagctcactcctcaacatgttgctccttggctttagctttgcccacacctgcttttattttgttacgacgtttgtcacatttactgtgtttgcaattctccatttctgctacactcgttgaaagcatcagccccacctttcatctttatgtctccaaagacctgcacagtgtctggctcatgagaggtagttaagaaatatttattaaggtgatgaatgaaccaagcaatatacaaacaatatacatattcttttctttgtggtggtgtggagaagaaagggagaagtaataagttccactttctggagtggaagggttctagtgggacaatagaagattgtatgacctccagaaccatcttaagagtgattttaggattagctactaagggccaggcacaatggcacacacctatagtcccagctagttagaggctgaggcaggagcattgcttgaacccagaagttaaaggttgtagtacactgtgattgcatctatgaatagccactgcactccacctgggcaacatagcaagaacctgtctctcaaaaaaaaaaaaaaaaaaaaaaagaatccagctattaacagaagtcagcaatgaataccaaggtcctcagtattacataatatttattgcttccttggatgaacttattaatttcttataaagaaatgcgcccgtataaggaagaaaggagcataggaggaaagggataggatggagaagagtcttgtagtgtgacttcatataagtccctcagtttctttacttgaaaacatctttatattaatcatggggatgagttttattaatgtggggtagtgggctgaagaatgctccccaaagatgtcaggtcctaatccctggaacttgtaaatgttaccttatttggaaaaaagtgtctttgaggatgtgattaagttaaagaacttgagattaggggattaaatgcaatcacatatatctttataagagaaaagcagagggaggttacacacacacacgcacacacacacgcacgcacgcagtgtgaagactgaagcaatatggagtgatgcagccacaagcccaggagtcccagtagctaccaaagctggaataggcaaggagtggagcctctgaagggaatggccctgccagagggcaggtgggcctgctaactccttgatttcatcccagtgatactgacttagacttctagcctccaggactgcagaggaagtttctgttctttttaagcaatgaagtttatggtaatttcgtatagcagtggcagaaaactcaccaggaggcaacaatacaggaacatgagaaatatgaggcctgacagagagctcctttggatggctgttcctccccacttcccttggaaagcttgctccttcactctccaggggatcaaaacctgggagactgtctgctgctgaaactacactcccggaatctgtgagttctcctgttgttctttttccctcaggatcctccatttccagcatctatcatagtccaagcagagcacataagcactcttttggagtacatatggctttcatggtctggtgatggaatctgggaacacagttatgtttggatgaggtcagttctgagtggcaagctcatgttacttaattagtttagcataagtgtaaacctttcaatagacgcttagtttcccctgtttttttttttttttcatctatcacaaaaataggttgggttagatatagctgtggttcgtcagctctgaaatcctgcaactctctcactagtctgcatttgccttcacctgtgagcctgtctcccgtttgtcccagggaaactcttctaacatgaaatccaagttgagctctctcagctatgtaggttcctggaaaaggattggttttcattctggattttaagtcaaaacttaaaaaaaaaaaaaccctaactcttgacttagttggtgtccctagattcagaccttgaaatttacccaactaggctttctttttcccaggtacctatgttgtactcagaactgtgaacaaagcttgatcaagccagtctgaatttttgcaaattttcatcccccttttattttcacatttaaaaaaatatatatatttctatgtattaaatgttgcttgctttagaccttccaagctcaatcagatcaacgttagattattgcccctttcttttatttgctggatcttattatttttaagacagggtctcactctatcaccctggctggagggcagtggcacaatcatggcccactgcagcctcaacctcctgggctcaagtgatcttcgcaccttggccttctgagtagctgggactacaggtgcttgccactgtgcccagcttttttatttttattttttgtatagacagggtctcactgcattgcccaggctggtctcgaactgctgggactcaagtgattctcccacctcagcctcccaaagtgctgggtgaaccacgattcccagcctcggatcttattttttatttccctctgaaaatctctacctcacagacagaagctttgattgtatgacagctgtagtatgtgacatttgctaaaacttaaaaaaaaaatgtctgctattaaatgatggtctaaaaataaatttcaaattgattttcctttttttgagacagattcttgctctgttacccaagccggagtgcagtggtgtgaccacggctcattgcagccttgagctccccggcttaagtgatcctcctgtctcagcctcctgggtagctggcactgcaggtgcatgccaccatgcccggctaatttttatttatttatttatttattttttgagatggagtctctctgtctcccatgctggagtgcagtggcatgatcttggctcactgcaaccgctgcctcccagattcaagcgattctcctgcctcagcctcctaagtatctgggactacagtcatgcgccaccatgcccggctaacttgtgtatttttagtagagacagggttttaccatattggccaggctggtctcaaactcctgacctcgtgatccacccgcctcagcctcccaaagtgctgggattacaggcgtgagccactgctagtggccatttatttatttttgtagagatggagtcttactgtgttgtccaggctggtcttgaactcctggcctcaagtgatcctcctaccttggcctcccaaagtgctgcgattacaggtgtgagcccctgagccaggtcaatttcaactcttattttggattcaaggggtagatgtgcaggtttgttacatggtatattgcataatactgagatttggggtacaattgatcccatcacccagagagtaagcatagtatccaatagtttttttaacacttgccctcctcccttccttctccctctagtagtttccaatgtctattgttgccatctttatgtccatgagtactcaatgtttacttcccacttataagtaagaatatgtggtatttggttttctgttcctgcattaattcgcttaggataatggcttctagctgcaattatgttgctgcaaaggacataattttgttactttttatggctgcatagtattccatagtgtatatgtaccacattttatccaatccactgttgatgggcacctaggttgattccattcttttattgcctctttcttgaacccatgatttcccatatgcattctgagatccctcacagctctcatcttcctcttccaacttccagtaaaggttcggtatgttcctgcttcacacaatgtcagggaggtcagttggttctcagacccccatcattgtgaaccagcattggcattcaccagaatacttggaacacaactttcttatgaaacattctttgagtagctgctataaaccaggcatttctatagcgagtgttgaaacttatgttagactgtataagattcaattcttgttttaaaatgtcattgtaatagagaaagtaagataaccacacaaataataataagatgaagtgggtgctgctgtaatattgatggaaatagccgcagatacaaaagttgataaaactacatttcatttcctaacaaggcatttgccatggatgtgaacttatgaacatcagttttcttacatgcccaggggtctatggaggccttatttgtgtatgaagatgtggtgtggagtaaatgatataaatgcatgtgaaagtgcccagcactatccctgattcatagtaggggattggtcagagattcttaaataccagagaaggggtttaaaaggaagaagagatcacaggtggtttggcagatccaaaagggctttgcggaaaatgtagcaattaagataggtcagactggtggctcctcagggcagggaccttctgaattacttttcctgtccttagtattttataaatagactgtagtggatatatgttgagtgaatggaccttaaaggatggacaggattctgaaaggttgaactggactttgagaaagggcactgcagcaggggcatagcagggatggtaaggtgtaggtcatgctgtcagaatggcagtctactttggtgggagtgtagggaagtagtagaagtaagagtgaaatgtaagttgggaatattctgtgagtattgaaagtgctttcattgttagactgagagcttgcactttatctaattactctttaatttttgtgtctctagtcaaatttaggaggaggagatttttgttatgctttctgcattattgagagtttaccattataattgccatctgtcgtgtttctcttttttgtcagaagggttgtaggcaatctttggctgggataaacagatagtttttctactcactaaagaaaatagatgcagagagactggcactaacaaggaatagagaaggagatagttttttctttgcttatgcctaaatcttgtctttgttaaatattatgttatacattattcataacttttaagcttttaaaaaatcaaaatttaagtcaaataagtcaaatatacaaaagaaaagaatatgtgagcctatgactttccatgtgttctagaccaggagttcccaaccgccaggccatggaccagtaccgtctgtggccagttaggaaccaggcctcatagcaggaggtgagcagcagatgagcaagcgaagcttcatctgtatttacagccgctccccattacttgcattaccacctgagctccacctcctgtcaggtcagcggcagcattagattcttataggagcacgaactctactgtgaactgtgcatgcaggggatctaagttcatgatccttatgagaatctaactaatgtctgacaatctatcattgtctcccatcacccccagatgggaccgtctagttgcaggaaaacaagctcagggcttccactaattgtacattatggtgagttgcaaaattacttcattatatattacaatgtaataataatagaaataaagtacacaataagtgtaatacacttgaatcatcccaaaaccatctgccaccccaaccctggtccatggaaaaattgtcttctatgaaacttgttcctggtgccaagaggttggggaccactattctagatcatctcaaggaacatttttacagcttgaaccagccttgtacataactcgttttataattagatgctatgtttcaaatattagtagccctgggaggggtaacactaatattcagaaatagctgggcagtatatgagatatctggaggaagggagaacatggagagggtgctaaagacaaacttgactatagtatttgatgtgaacatgacctcagttgaaagtacaccactattttatgtacctttaagaaaaaagtgctgtcaatgatgtttaatgattgtgctgcgctacacatgagttggtcatactggcttcttattgctttgacatttcctgcctttcttctgggatatttggcacttttgcctgccttcttgtatggcttggcataagatagacaattctttgcacatgtctgtgtagcaaaatgcaactcaacttcatttaccttttgttatagatcctgtaagacaactgattgctgtttgcaataaaatacagaattgtggtcattcttccaaagaaaaatatgtattccactaatatcaaatttatcctccaacttcatttctatgcttttctacttatacaataactttttgtttcaatgttgagttacatgtaaagacatataaaatggaaatgaaatttaacactataagtaaatcttagctaaagcgacaataatattaatgtgtatgaccaagattgtacacgtgcaactacatcatgatagcaactagtggaagccagttataagactgcattgattaaagacatactcacaatatagagaggttaaaatgagggctgggtgcggtggctcacgcctgtaatcccagcactttgggaggccgaggtgggtggatcacctgaggtcaggagttcgagaccagcctggccaacatggtgaaaccccgtctctactaaaaatataaaaactagccgggtagggtagtgggtgccagtaatcccagctacttgagaggctgaggcaggagaattgcttgaacccagaagatggaggttgcagtgagccgacacagtgccactgcactccagcctgggtgacagagtgagactcagtctcaaaaaaaaaaaaaaaaaaaagaagaagaaaaagtgcacttagaaacaatgaaacacgctctttttaaaatgtgcctgcagactcatctacctcatgctgaagtattttatctagcacttaagactaattggttgaaccacatccctttatggctctggttttatgatgtacactaatgtgtcataaaaccataatgtacatttggtgaccacaatcatcttatcaaagggctctgctggaagtgaggctgatgcatgagcatccataccttaagctctgttttccaagttggtggttgtatgattatatatagaagcgtcatggtcatatttgcccttgctcccttctacccactacgtgtaccagttaggagtttatttaatgggtgtcgtatgattttcttgtctggtttacctcttgatggtccacatttcataaatcatatctcctcatatatacaggaaagcatatgttgaaatcactgaaattacataacttgctcccctttgaatcagtttccttcttatcactttgaacatgctcatttcaggcatctctacgctacggagtgtgccctacaaatagaaatgtgggaaacctgccaggagaaattaaactgtcagtctcctcctcttccagatgagggttgatagatacatctctctatgttgtggcagccttcaatctgaattgagcagatttcaaacatttctctcagctgtgtacctagagtttaatctctgaagacttatttcattgccgatcatttgcaaaatggatagatttgagtcgtaccctatccatttttctcctgtcacttactggtaaaataaacactgagtaggaagttgtgaaagaggataaaggaaagctcggcaaactggatggtcctgaaaagtctgtaagagacacatggaaggtaaacaagctggttgcttttgttctgccagctgaggtcattggagcatgaacagggaaacttcaacttggagctgatgtcctgatcctttggaagctcttttgggatggaagggttctcgattcctgtttttggtcttactcttgttactgtctaagagggctgtctctgttctaatctgctagttgcaggcttacagttggttagatgatgaaatgtgatgtttacagcatcaagcacaatgttcagtagaagttttgacaaatcctcctgctagaacttcatgataatttgatctatcagatacattttaacaacccttttgaccacacgttagtggagctgatgcaattagctagttcttgttttattgttacattaagaaaaaaaccaaaatttaaatttaaatatacaactcatgtggtggaggaaaaaagacatactttcagagggaaaatcttacaagtgagttttatgcttaaaaactgaatgccttaaaatttatatatcttcttttttggaggtgaaaaaaatcttctaggaagttgctatttataaaaaaaaagtggcatagaccttcctttcaaactttagaaaaaactagacttattaaatctcacatggtcaaaggacaacaccatttagaagcatttaaaacattatgattttggggtacttgaacatttgaataggaataaaagcaatttttttagatggcctgaattgtttttttaagattgggtttttggtgtgataaaaatattttatttcatgattgtgtggtagttgtacaattataaatacgtgtcaaactcattgaattttactcttaaacttggtgaaatttttgtctgtaaattatactttaataacactgacaagaaaaataaagtattttgggatttagaaaaggactggctgggatttcaaggaagggagtttctgtggacacgcaatatgacactaaaatcatggataggaacagaaattattttaatcaaaagccaaatgtaatgaaactattaagaaaaatgatttagtgactgtattttacatgtttattatacttctcattacattggggttatttccccacttacattcatttgtatgtgtgcaggtagagtagggtggggacaaggggatgggagagtgggtgtgcatcacgtgaaaatgaagaggacttggggcagagcaagatggcctaatagaagcctccagcgattttcctccctgcaggaacaccaaattgtacaactattcacacagaaaatcacctttataagaaccaaaaatcaggtgatcacagtacctagttttaacttcctatcactgaaagaggcaccaaagagggtgggagaggcagtcttgaattgcctataccacccagtcttccattccctggcagtggtcgcatggcacagagacagaatctgtatgcttgggggagggagagcacaggaactttgcactggaactcagtgctgccctgtcacagtggaaagcaatgccaggaagaactcagctggcacccatggagggagtatttaaacaagccctagccagaggggaatcacgcatcccagtggtcagaacctgagtgctggcaagctaaagtactttggggtcctaaatacacttgaaaggcagtctagaccacaaagactgtaattcctaggcaagtcctggtgctgtgctggccttggagccagtggagttgggggacatgtgacccagtaacacaccagctggggtggccaagggagtgcttgcatcaccattcccctaaccccaggctgcacagcttgcatctcctggaaagactccttccttctgcttcaggagagggaagagtaaagaggactttgtctcacaccttggataccagctcagccacagtagaataggggaccaggcaaagtcctgaggcccccattccagcccctagttcccaaaggacatttctaaacacaccctgtgccagaagggaacttgctaccttgaagggaaggccccagttctggctggattcatcacctgctggctaaagagcccttgggtctcgaataaacatcagcagtacccaggcagtacttgccatgggcattgagtgagactcagagctgtgctggattcaggtgagacccagtacattcccagctgtgggggccacagagagagactcttctgcttgtggaaaggagagggaagagtgtaaaagatttggtcttgtggcttgggtgccagctcagctgcagtagaatagagcaccaggtagattcctaaggtttctgactctaggtcctggctccaggatggcatctctagacctgctcagggcctggggggaactcaccattctgaaaataaggacacaagccaagctcatcttgctatctgctaattgtagggccctaaggccttgagcaaacataggtcgtaggcaggcagtggttatcacaggccttgggtgagtcctagtgctgtgcctggcttccggtctgaccaagtatagtcccagtggtggtggtcactgggtgcttgtgtcaccccttccccagctccaggcagctcaacacagagaaagagactccatttgttttggagaaagcaggggacgagaacaagactctgcctggtaatccaggaaatttttctggatcttatccaagaccaccaaggtggtatctctatgaatctacaagagccacagcattacctaatgcagatatggcagaagtgaccaaaaacttagactacaacacttaagtccctttgaatacctggaaagccttcctaagaaagaagggtacaaacaagcccagactgagaacatgacaataaatacctaactcttcaatgcccagacactgatgaacatccacaagcatcaagaccatccaggaaaacttgacctcaccaaagctaagtaagacaccagggaccaatcttggagagacagagatatttgacctttcagacagagaattaaaaatagctgttttgaggaaattcaacaaaattcaagataacacagaggaggaattcagaatcctatcagataaatttaacaaagatatttaaataagtaaaaagaattaagcagaaattctggagttgaaaaatgtaatcgacatactgaagaatgcatcaaagtcccttaataacagaattgatcaagcaggagaaagaattagcgaacttgaagacaggctgtttgaaaatacacaatcagaggagatcaaagaaaaaagaatgaagcatgcctagaagatctagaaaatagcctcaaaagggcaagtctgagttattggccttaaagaggaggtagacagacagataggggtagaaagtttattcaaaggaataataaggctttccaaacctcaagaaatatataaatattcaagtacaagaaggttatagaacacctaacttgggttataggtttaacccaaataatactatctcaagacatccaataattaaactctgatagtcaaggataaagaaaggatcctaaaagaagcaagagaaaagaaacaaataacatacaacagaggctgggtgtggtggctcatgtctgtaatcccagcactctgggaggccaaggtggacagatcacttgaggtcaggagttcaagaccagcctggccaacatggtgaagccccgtctctacgaaacacacaaaaattagctgggcttggtagtgcatgcctgtaaccccaactactctggagtctgagacaggagaatcacttgaacccgggaggtggaggttgcagtgagcagagattgcaccactgcactccagcctgggcgatagagtgagtctcgtcttaaaaacaaaaacaaacagacaaataaaaaacatacgatggagctccaatatgtctggcagcagacttcttagtggaaaccttgtaggccagaagaaagtagcatgacatatttcaagtaccgaaggaaaaaaaaaataccttgtatcctagaatagtatatccagcaaaaatacccttcaaacatgaaagataaataagaactttcttagacaagctaaaggattacatcaatgccagacctgtcctaccagaaatgctaaagggagtccttcaatctgaaagtaaagggcgttaatgagcaagaataaagcattgggaggttcaaaactcactagttacagtaagtacacagaaaaagccagaatattataacactgtaattgtggtgtgtaaactactcacgtcttgagtagaaagactaaaagatggactgatcaaaaataataactacaagttttcaacacatagacaatacaataagctataaatataacaacagaaagttaaaaagtggattaacagaaagttaaaaaaatgaagttaatgtatagagtttttttttgttttctctttgcttatttgtttatgcaatcagtgttaagttgtcatcagtttaaaataatgggttataagatattatttgcaagcctcatggtagcctcaaataaaaaaatcatataacaaacaaaaaaataaaaataaagaaattaaaaacaccactggagaaaaatcatcttcactaataaaatggcaggaaggcagaaaagaaggaagagaagaccaaaaagcaatcagaaaactaataacaaaatagcaggagtaagcccttacttatcaataataacattgaatgtaagtgaactaaactctccaatcaaaagacatagaatggctgaatggataaaacacaagacccaatgattggttgcctataggaaatacacttcacctataatgacacacataggctgaaaataaagggatggaaaaagatgttccatacaaatgaaaaccaaaaaagagcaggagtaaactatacctatatcagataaaatagatttcaaaataaaaactataaaaagagacaaaaggggtcattttagaatgataaaggggtcaattcagcaagaggttataacaattgtaaatatatatgcacccaacactagagcacccagatattataataagcagctaataacaagcaaattaataataaagattggagcagaaataaatgaaatggaaatgaaaaaacaatacaaaagatcaatgaaacaaaaagtggggtttttgaaaagataagtaaaattgacaaactttagtcagactaagaaaaaaagacaagacccaaataaaattagacctgaaaatggaaacattacaaccaatgctgcagaaattcaaaggattattagtggccactatggctaactatatgtcaataagttggaaaacctaagagaaatggataattcctggatacctacaacctaccaatattgaatcatgaagaaattcaaaacttgaacagaccaataacaagtaatgagatcaaagctgtaataaatatatagcaaagaaaagcccagggcctgatagcttcactgctgtattttaccaaacatttaaagaactaataccaatcctacccaaactattctgaaaaacaaaggagaagcaaatagttccaaatcattcaatgaggccagtattacctgacaccaaaaacaaagacacatcaaaaaaagaaaactacaggccaatattgttgatggatgttgatgcaaaaatcgtcaacaaaatactagtaaattgaattcaacaaaacattaaaaagatcatttatcgtgatgaagtgggatttatcccagggatgcaaggatgattccatatatgtaaatcaatcaatgtgatacatcatatcaacagaattaaggacaaaaaccatatgatcatttcaattgatgctgaaaagcatttgataaaattcgacatccctttgtgacaaaagccctcaaaaactgggtataaaagagacatacctcaacaccataaaagccatatatgacaggtccacatgaaatcctttcctctaagatctgaaacacaacaaggacacccacttcataactgttactcaacatagtactggacatcccagctagagcaatcagacaagagaaagaaataaaaggcacctaaactggaaaggaagacatcaaattattcttgtttgtagatgacatgatcttatctttagaaaaatatgaagactctaccaaaaaaaaaaaaaactattagaactgataaacaaattcagtaaagttgcaggatacaaaatcaatatacaaaaatcagtagcatttctatatgccagcagtgaacaatctgaaaatgaaatcaagaaagtaatcccacttataatagatgctaataaaattaaatacctagaaattaaccaaaagaagtgaaagatctctacaatgataactataaaacactgatgaaagaaattgcagatggcacacacaaaaaggaaagatattccatgttcatgggttggaattattaatattgttaaaatatccataccacccaacccaaagcaatctacagattcaatgcaatccttatcaaaataccaatgacattcttcacagaaatagaaaagacaatcctaaaatttatatggaaccacaaaagacccaggatagccaaagctatcatgaacaaaaagaacaaaactggaggaatcacattacctgacttcaaattgtagtacagagctatagtaaccaaaacagcatggtgttggcataaaaccaaacacatacaccaatggaacagaatagagaacccagaataaatctatatatctacagtgaacttatatcccacaaaggtaacaagagcatactttggagaagggacagtctcttcagtaaatggtgctaggaaagctggaggtccatacgcagaagaatgaaactagacccctacctcttgccatatacaaaaaccaaatcaaaatagattaaagacttaaatctaagatgtcaaagtatgaaactactaaaataaaacattagggaaactctctaggacattggacggagcaaaggtttcttgagtaatgtcccataagcatgggcaacaaaagcaaaaatggacaaatgggatcccatcaagttagaaggcttctgcacagcaaatgaaacaatcaacaaagtgaagagacaactgacagaatgggagaaaatatttgcaaactatccatctgacaggggctgataaccagaatgtataagaagcttaaacaactctataagaaacaatctaagttaaatcaggcgtgatttaactcacgtctgtaatcccagcagtttgggaggccgaaacaggtggatcacctgaggtcaggagttcgagaccagccagacccacatggtgaaaccctgtctctactaaaaatacaaaaatcagctgggtgtcatggcaggtgcctgtaatcccagctacttgggaggctgaggcaggagaatcacttgaacctaggaggcagaggttgcagtaagctgagattgtgccattgcactgcagcctgggtgaaagagtgagactccaactcaaaacaacaaaacaaacaaacaaaaacaaaaaaacaaaacaaaagggacaaaagatctgaatagatatttctcaaaagaagacaaccaaatagcagacaggtacatgaaaaggtgcccaaagtgagacctttgtatgttctcacttgtttgtgggagctaaaaattaaaacaattgaactcacggaggtagagagtagaacagtagttaccagaggctggaaagagtagtgggtgaggtgaagggggttgattaataggtaaaaaaatgtagttagatagaatgaataagatctagtatttgatagtataacagggagactacagtcaacaataatttattgtacatttaaaaataactaagtataaatggattgtttgtaacacaaagaaaggataaatgcttgatgtgatggctaccctatttatactgatgtgattattacacattttatgccttatcaaaatatgtcatgtatcccataaatacatatacctactatggacccacaaaaattaaaaattaaaaaaaatgaaggagatgtgaaaggtaattggtgagggtgtagttgtggggagagtaattccttctactctcatcaacttaattatgtgcgtgtaattcacatttgtatttcaaaggacttgtgtgttataatataatacaaaaagcatttgcttttatagagaaacagataagccccaattggtattattgatattattatacaattactgcttctttaaagttgagcctacgtgctgaaaataaccagagcacagaatcatagtttagctaaattgccttattagaaccatttgaatgttcctgaaaataatggcagaattgatgctaatttggaggttactattgattgactgctcctcttgaaattattgaattgataatgctgtgctttggcagctgatggccacccatttgccttgatgttacatactaacttaatgatatgtactagttttagttgggcaaatattgtgtgctttctaagcagcctattactttgtactgtttctttggagaaaatttctttcttatccactcaaaaatgaaatatgtcttaaaagcacagccctttgtaaagacggaaggaaaaatttgtatctatgggcctactacccagtgataatcacttatcattttggtatattttcttccagtctttcttctctgctcagctggttctgtttcttttacttttttgtgatcgctgtctctataaaagtctgtattcacttttttgttgttttcgcttaccttaggatgtctttttatatgttagatatgttttacaaattttttttttgagacagagtttcacccttgttgcccaggctggagtgcaatggcgcaatctcggctcagtgccacctccgcctcccgggttcaagtgattctcctgcctcagtctcccaagtagttgggattacagccatgtgccaccacgcccggctaatttttttttttttttttttgagacagagccttgctctgtcacccaggctggagtgcagtggtgcaatattggctcactgcaacctctgcctccctgattcaagcgattctcctgcctcagcctcctgagtagctgggactacaggcgcctgccaccacacccggctaattttgtatttttagtagagacggggtttcaccatgctggtcaggtctcgaactcctgacctcaggtgatccacctgccttggccttccaaggtgcttggattacaggcgtgagccaccgtgcctgcctacaaatatatttttaatggttgcattcattttaaaatatagaatgccttacttccctgagtttaccattttcttgtatttcattatacataattagatcagaaaatacatttctttttggtaggagaaaattattgtttgcttcgacttttataattttaaagcagttgatagactaccaaatttaataataattaagatatttaataaatattgcatgttcttactcatgtggaagcttaaaaaagttcatctcatagaagtggagagtagagtagtggttactaatagtggttagaagctgggaagggtgaagggaatagggagaggttggttaaaggatgtcaaattataaccaggaagaataaattctggtgttctatagcactgtagggtgagtatagttaacaataatttgttatttattttcaaatagctagaagagaggattttttaatgttcccaacacaaagaaatgataaatgtttgaggtgatgagtatggtaattaccctgatttgatcattacacattgcaaatatcaaaatatcacactctgtatcccataaatctgtacaaccattgtgtcaattattatgtcttatgatcgcttcaaatagccataaacgttaattggttgtatttcatatctttccgataatttagtcatgggctctgagtttctttcttaagatgagagccttgattttccatttttacacgtcttgtaggtttcctcctcctcaatgtcctccagttggaggctcaaacccacttcctctttaaagtttgctgcatttcctgtccattcatttccctgactttggtgtcaggtcttatttatttaaaattataacaactataagttttttctttctatccctgggtaatgaattgcaacaagacttttcatccccaacacctccccctcccccagcccctgaaaaaaggaaatttcttctgcttgaaggtacttttgattgcctgtgattaaaaacaatttttttttgttatctggagattattaaagagccaatgactcatagaaggcattgtatatttacgtatatattatactcattacctaggatgtttacagaatttcccccttgggagttaatatgcagctgcgttttattcctcacctgttaccattaccctaatagagacaagtccaaagtaccacggaaacccttcaggagaaacagcaaaacagatgacaaagcagctcatttcttttcttcttaatggtctctttttttaaaattatttccaaagcaaatttgagtgtgttttgattttccaggaagtaaataacttctgatattaagaccgtttaaacgtggttattttcccctttgcactgaatcggattaagccaaccaagtattttgtgccatataaacatggtcttaatctaaatattcacctcaaaactttctttgtaaacatgtagttttgatgccttggcttccagcagaatggtaagcttcacatgggatttggagaaaaggaatcaaacactccagcgctccctttgggaactccttccctggaatccaaggctgcttcaggcaggtcaccttgattcacctataggtcaggacaggccagtttgtaccagatatttacatgcttaaattactgatctttttttgtttgtttgttttcaatgtgtctcacactaaatcactgcatagctaaacatattactttaggatgagtctttctgacaacttaaaatttatttgtagtctttctggttctctaatgaaggaataataaactcacagtatgtaagaaaaagaatagttttggaatggagttttctaaagaattttagaggtttttttttacaagtttaaatgttggtgtaaatgttccatttgtgtggcaaattaattttccatgtgcattccctttattccaatggtggaggatgttgggagggtggacagggaaaatacactcactatacagctaatatcaattctgtgcctgctactgaccactctaggctctcaggaacaaagatgagcaatgcactttcaatgagctgctatactggagagagagggcatgtaaataaatcactatattacattatggtgtagacattggagaaatgggggttcaggtaaaagactgggtaaatatagaaaagggaacaattaattctgaccaaggcgttaggtaaggagaattcaggagaagcttcaaggtagacttgcaatttgactttgcagatgaataggaatttatctgggtctataggttctaggaagggtgaacagtacaggcagttataatgtgctatgcttaaccactgtggggaacgtgccatagccagcatatacaacgctctgtggatagaggagaagctggacaggtgggttgggaccaacttgagaagagcctggaagaacccaaggtggcttttatcaggggaaggacctgatcagttatgtgttttctaatgttacctttgccgtgatgtgaagagtgggtttgaaaggggagcagttagaggcaaagttaggagctcattgcagtcattatttttgtaagagacgagggcctgaaccagtcgttggtggcaagattgcttttgagagagatccccaaagcccaaagggcagggtttgctgactgtggcacctagaggaggagatccaaaaggatgattctgaggtttctactgcaggcacccaggtgatggtgaatctgttaaccgagacaggggagcaaattcgaagtgcctgtcaggactttcacaaggagttattcagcaggagacatttggaaatatgcggcagggatccaggagaggttgggacagcaaacacacatgtaggagtcattgggttgtacaggcagttcagtggggttgcgtttttaagggaaagagtgactgattaagaagtggatagaggtgatgaatctgagaacaatggattcagggtattgtttcaagaggtttgatggttaagggtaaaaaagagggcagttgcctgagaggtagatgagtaattttcttttctgggacttgaatgcatgtgtgggtgaaaactagtggtgaggaagacaatggcaatccgagaaaaaggagataattaatgtagtgagtttggacgaaaaatattgggggggtcttccttttgaggtggacaggaggaggaaagtatagtagatgatgagatgaacttagaggtggatagaagagaaatgaaacttattatatctccatttgcttaaaagaggaagtctgagtaaagggagggtggagaagggagtttaaggatacttttgaagatgtgagagctgctttgaaaagtggaagagaccggccgggcagggtggctcacgcctgtaatcccagcactttgggaggccgaggcgggcggatcacgaggtcagatcaagaccttcctggctaacatggtgaaaccccgtctctactaaaaaaaaaaaaaaaaaaaaaaaaattagccgggcgtggtggcgggtgtctgtagtcccagctactcgggaggctgaggcagaatggcatgaacccgggaggtggagcttgcaatgagctgagatcgcgccactgcactccagcctgggcgacagagtgagacttcatctcaaagaaaaaaaaaaaaaaaagtggaagagatagtcatggggataagaaaaagtttgctgaacagcaatgagtccagcccaggctggggctcatttgtctgcagcggagccaagcgcacagcatagcagtgttttctgtactgctgggaagcctgcaataagcagccgggaaaatgggcaggtgggttgatccgtggctagatattggctgggcagattttgaagaaagattttcttagggataggaaaatcaaagatattcttgactggtgttagtgaatcaactatgagtcctggagatcaaggataagtagtgaaggaagtaaaacttggaggggttctagggttagggaaatcgggaggggcaagagcttggaaggctgaaggagatgaatagtagaataagcaggtttaaacgagaaaagaaaaaggaaataatgttatggatcaggcatagtattttcatacatatctagtttatcaattcataagtcattccttcaataacaaaaatatttatttttgtcttattataaatataaaatatctttattttgttatattaaatggaacaaacacttttcagtcttatcctggaaattgaatattttacttaaaaaaaacccctcattttaaaactttggccaagttgtatatggtttatttggagacacacacacacataattattcaaggggaataaagggaagttaatgaattggattttttttgctcatagctaatttattccccatctactgtggtagtaaaataaaaattaaatatttacagttagcctatcattgtcatgtacctgttacaattaaataaagtgaaaatttaaaatgtaagctgaagttaagtttccaacctaagtttcttttagcattacatgtaaataatgtatttacctattacaactttctttttcccctcattaccattttttcgttcccctacatcgatatctctgttacaaagcaatggtatctatttatactatgcagatcagcttcaatgatgtgaagagctcacagaaataataatagacacatttatttgcatattatgtttctgcttctgcaagtaatattctttcttataatgcttgtatcttttatttggagaacttcaagtgatctggaagaatcccattgtattccataaaggagagtagatgagcagatggcttccacatctgcaaaatgggaatgttcgtggacttctgaaactatattgaaatttcagaattctctgtggcagttatataatatgctccttgaaacaacagcatattcaggaatggactagaatccaggccttttgccaacaagccattctttaatcctactgaggtcattattttctctatttcctaaagtcaacaacctgacattaaggaagcctttgctatgcaggtttctttcaacctatgtctctctgtctctgtctctttctctttcccttttatatctgttattcaaattacatttatgtgtagttacacattagttgttctctcttacctccattctaagttccttcactagatttcaaaaatcgcttaccacatcaaatacagccgaggccatccatccttcaagctacccatcatcagagccataccttatatattattctattcctctccatcacaacaaaacaaaggaaaactgatcaagtgccctcagcattctggaatacaatctcccccatcaccccagaagtactaaaccatcttactattctttagagggctttgaagttggtactttgataccagtgagcacgtatgttggtgcaactaacttctccagaacaagagccttctccctctgcgattgtacagatccaggcatcttgctaatgcttacaaatgtcagatttattcttcattacaatgctattgaatataacaaactggcctcatcgtaagaatctcctggaggaagatattgaaaacacagtttctctgacttccctcatatagattctgattgagtaggtctgaggtagggaatggaattttctactttttatcaggcaactcaggagaatcttatgaccagtaagacaaaggaaacactgagattggtgatttttatccctattttaagatgaagacatgaaaggttttctagagacatactgctcaatatggtaaccattagccacacgtggctattaaaatgaaagttaatgggctgggcacagtggctcacgcctgtaatcccagcacttggggaggccaaggcaggcggatcacgagatcaggagatcaagaccatcctggctaacatggtgaaaacccgtctctactaaaagtacaaaaaattagctgggcatggtggcgggtgcctgtagtcccaactactcaggaggctgaggcaggagaatcatttgaacccaggaggcagaggttgcagtgagctgcgagatcacgccactgtactccagcctgggtgacagagcgagattctgtctcaaaaaaaaaaaaaaaaagaaagttaactaaaccattaattttgtaaaagtatgtgagatgagagatatgttaatcttcttcactacagtaaccatgttactacccatatgtatcccatagcatcatgttgtaatcctcaattatacataagaaaatttatcttaaaaactaaagagaaaagaaaaacaggtattaagtttttcagtcacactagccacatttcaagtgttcagtagccccatgttaccagtgactgttgtaccgcacagaacagatacagaacctctctgtcatccccaaaatttctattagacaacacttctagtagacaccacatttgttagcatgtgatgtttttgcttctgcgagtaataacctttcttggaatgtttatcttttatttggagagcttcatgtactctgaaggaatcccgttatattccctcaaggaaagcagatgagcagatggcttccacatctgcaaaatgttttctagagaaaaagtgacttgcccaaagtcatataattaatacgtagtggaaccaacttaatgaggatttagacctgcacctttctgaagtagaatcttgtgccactgtaagtccagctttgttcagtggagactgagtcagcttgagggaaaggattgaaagtttgctctgtgctgagattgaacaagctctcctcagatatttctgaaagcctagatgtctatgtcttcctttttgggtagtaggactgaaacagaatgggcctctgagaatggcttagtataaaccattaatggtaccatatttgggggaatgcagacagatgacagccattaatctgactgcacaataagccagatttgcatccatggctgcaatccacttcttacctacatccaatcaacaggaagttcacctggttcaagagagcatctacttttaaaatgtttccttttcgcagtgtggaaataacagttgctcttatgtctaggcagtccttcaggtactcacagtgtttcaaatttaaatcagtggtttggattctggagtacttttatcttgcataacaaatattattgaatgttggtttggttttcacctataaaaatctgcaatgtacataaaagaaataatacacctgaattataatacagaactataagtacaatatcaattatatgtaactgccatttacaacttgtcttttatgagactatacaataaacattccaactgtatgctgggaataattcttcccattctgttaacccataatagtttcaatggagtgcatgagctcaggtacgtgagctgatatgtcttgggctcttactaactttctacacctatataaatgatgcatctctcattggcaaagacacaaaagtttgagaacatgctggtgagcctgtgtgtaaatgatgatctcctatgataatggtggcagtgcaaacggtataattcctatggaggtcaatgtgtccatttttataaaaattacaaatgcatttcctctttgacttagcattttcatgtctacaaatttttcctatatatatatatacctgcatggtatgaaaggcatatatatataatatatatatatatatacctgcatgatatgcaaggcatatataaaacaattcattgcaatattgtgcatactagacaaaggaaactgcccaagtatccatcgataggggactgattaaaccagtggttctaaacttcagtgtggatcataatcacttggagggcttgctgaaacacagattgctggattgtacctccagaatttctgattcagtaggcctggggccaatgggcaagcagagctaaaatccagcccatgttgcattctacattcatgtggggctggctgcatctgccctgaagaaggggcacctttccatagtttgcacgtaaatgctatacagctagcagtagtctgagactctatgaaaaagctgtcagtctcataaaaatcataaatgtattgttattctgataaaaatgccagcattgtttttccataggacttgacataattcaccctaaatttataaacaattcctacatgtcagtaagaagacaaatggggagaggatatggagtcacaggataagaaaccgcaatggccagtaaatatatgaaaggttgctcagcctcactagtaagtgcaaatgaaggcaccatttttcacctgttgaaacaggcaaaaatgtggaagtgggacagtaccgagaattcctgaggatgtgggaggaggtaactcttataccctgctagtgggatgtgaattgcgcagccactttggagggcagtttggctatatgaagtgcaggtgaagatgctcaccctttgacctaatattcttaacacacgcagtagagaaacttgtatatatgcaccaggagattcgtgcaccaatgttcacatcagcattgattgtatgagcaaaaagagaggaaatatgtgagaggtccatcaacaaggaaataaattgtactatatgttagaattataaataacagttaaaataagtaaactagaattaaatataccatgtacatgtgtgtatatatatttacatacatatatgagctatatatcataatgtgagtgaaaaaaacaagctgcagaatgataggtagaattaagcttgaacacatggataataatattatgtatggatacatacatacgttgtaagagtctaaaatgattgacaggtgtaaacaccagttttagcgtagtggtgcctggtgatgttgtggggcagggtagagggggttgcaaatgtagctgtagtattttgtttaaaatttttttgaggcaaatgtggcatagtatcaccattttatttagctgggtagtaggtatatatattattcactttattattctgtctgaactgtttcataactaaagaaaacatgcacgtacaccaaactgttgttatagtagtctataactcaatgtatctcatctcttggctcatataaagttggatacagagcagggtccagagaagctttgttaaagactttttaaataccatgcagatgatgggactggttcatagcagtactttttaaccttgattttgtgcaaaacagattcttaatcagtagataagaaaatctacctaattagtgcattttcccagggagccttatggtattagccagcaaagactgcagctttaattgagacagtgatgcaacttaattggaacacctgaatgcgattaagggagggggtactcatataaggtcagctggtttccctggtgcccagagctctgctgggtctatacctttttgctgacaacctctgccaactgggatgaagctgagccaaatgcttttactgtctttcttagatcacttaatgaaatgttttaaatacagattccatgtatttcagtgtgtattgtgaaacacattggcatgctgattctactggtaaactttagaacttattacatagaagcactagatatttgcattgcttttaattgttattgatgcaggagtttaatatatattaagtgaaataaattgataattgtgttgagactcaataatgtattttagttgattacatctttatttgggttctccagagaaacataactaatgggatatatatatatgtgtgtgtgtgtgtgtgtgtgtgtgtgtatttgttataaagaattggcccacacaattatggagactgacaagtccaaggtctgcagctggtaagctggaggcccaggaaagctgatgatgcagttctagtctgaaagctagcaggctggagacccaggaagaacccatgctccagtgcatgtccaaagcctggaaaagaccaatgtccaaactcaagggattcaggcaggagaaaatttcgtcttactcaggctttttgttctactcaggccttcaactaattggatgagggccacccacattgcccaatcggctttactcagtccacccgttcaaaagttaatctcttcctgaaacaccctcaccaacacactcagcataatgtcttggcatcccatggctcaaactgacacataaaattaatcatcaaaacatctttttgcctaaatttaagatcatttcacaaggcttctggacaatgtagtttttattaccaaagagtacttatattcctttattaatttaaaaaagtgcttgaattcctccataaaaattaatgtagtactaacagagaagaaaactctttaaaaattgacactaatctttaaaaaagttttttttgtaaatattctattactaactagttttgtgaccttggatcaattaatttcttgatctgaaaataggagagcattggaaaggacgattgtgatcccatccagctctagaggtctgtaatctttgatgttttcatcagtatatggatgttggaatgtgactggcattggtatgtctatgctacctgctaccatccaaatgaactcaagttgctttcttaggtggattgtggaatgtagtggaatgtagtctcagttatttacagttctacttcatacttaatctccttggtgcgtataatgactagttagaagtaagtgaatttcacctatgaggcctagactccaagcagagctgatgtcatgagattccagcacatttattaagtgctaggtgaactcaccttatggaagagcaatttccataggaaaaaggagtgattttaaagaatgtactatctacatagtcaatactattggattttcaggtggagtttttggcctctatttttagagcatcatgtaccatagctttgggggtaatttttcactaacatacattacttaggaatgtttaaatttagtgattaactgatccagtgactggcaatcattagattgccaaataaataaaatttggctctgtgatgagctatattttcaactgttctaggtcagattttattattggagatgtttgagttattatcagaaaaactgtatccagagacatagtgcttgaccaaatcatgtggacagtgggtcaaaaccattttggcatttcacaaaatcttgtgaggataagttagaacatgctaaagtaattttcactagtgagtattctatcaaccttgtgaataatttcagaaaatattagctggctacagaaatgttgaacggtttatagactttttttcctggaccctcccaagcctagcaatactaccttccattttctagccaagttcattccttactgttacacatatccccagactaacagaatgcaagcatatctgggccccaaacacagttatctagaaatgcgtttttttacattaatggcatagattcttgagaaagaaaaaatgtaaaatataaagcaagcatttcaaacaaatgtatgtctgtgtggagagaagaaaaatgaaataagaaaaagaaaaaaacataggaaaataagagagaaacctagaggagacaccatagaacctgatgtgttggaagggaaatcactgaaattcctgggcttgtggcctggcttattttaagtctggcctgatttcttttaatgtgcatgttgtgttcatttgcatggttgcaatctttaagcaaagaatattttcaggattttggaataatctgagagcccctgataaaatgagtgcagaaaaaatttaatgactgtgattagtcacaaaaagagcaaagggaatctcattatttcagtttctgaatttcagttagatgttttccttaaaaccaagaaaggttgtctaatgggcaaaaacattgttattcttcatggattcatagttcctgtgatgctctctgaaaaagcagctatatcagattaattttctttttcacactcttccctctcatttttgtaaagaaaaagacagccaatctgtagcttccttggggggcattagacagcttagaaaagtggcaaaataaacaagatttattctcatcagatgtatcatgagaaaattggaggcgtgctgtgaggtaatgacaaaataatcttgaaaatttccaagcacttcttccaagtggaatggaaggaaatttaaagtcagctttcatctatttatagctgaaacaagatgtgtgcataaatgtatgggcatatatattttttctaacaatactattggtttcctctcctaaaaaagaggaaaccaaacttaaggtcttagagttctagaaaggtgtcctctggaaaagttgaccacagcgggattttagtttctctatggaataaggtagtgggaatagtaacatgaaatggtagtgtgttttttcctctctgtccatcttctcccatttctcttacttatattaacctttgaaggtattgttccagaaaatgcacagtgccaatgggaccttaatttatttcagtggtcatttgcagaaaacaatatttttgcctctgcttacccattggagctgatatatactcttttatgtagcatctgtaagtacatgaggattcattgaatgcctttgatgggctaagctttgtggccatattagagatactgggcttgcttttagaacaggacttgggaagaacttagggtctctcacacttcgctgcaggttttgctcacagaatttgggacctctatgagggtaagtgttggaaagcaggaaacgatgctttattgtttgttcttaagcatgccttctttccatccagttgctggctgagccctacgagggtcctggcttggctttgatatatttcatataagctcttgggagaataagtgtttgtttgtttctctttgtggatgaatatccaaagtaaatcacagagaacttaagttggtttttatgtctcttatttttaactcaaggtgggatttctacagggtaggctgcagaatcaaggctatccgtgaatcattttgccttttcctaggagagactgttcaaaaacctgactctcaggcaccaataataaatgtgctttaaaaacacacatacactcccttcagttcaattatggagaatccaatttatccccgttctctaaggcatttaccagaagaaaaagagagtccttgggcattattctgtgtaattagatttttacacctctgtattgtgaattgggatttccaatttctccaccctaaggtgtaaagtgatggtgcttagcaacctaagaccatagctgatgttataattcatcaggacttttagactgttataatttgagaaactctggtgaaaataaacaatagtggatattgtaatttcttttataaatattaaatctattttattttttagaaccatttgtcttatttctcaaaattaatcttcacctgaaacctcaacagtttttaagaaactgtgccaatggcctgattaatcttctcatatgtggattttcctcagttgccaggaaataaccacctggttaaaataaacttatttttatttatttctgtatgtttcaccttcatagtaacagtaaaaatgcaatatctgaaagtcgtgatttttttttttgcaattttataggaaaaaccaaagctaaaatgtggatataaaacataacagtctcaactatttttaaaaagaattgaaaaaagattagcagaaaatgtataaaaaacagtgtttggatttttgtatctttttgcacttaatcagtacatttttgtgcttttctaaaagtaattgaaataggaagctacatatttcagagaagattatagaatgtatcatagttgtgatgacacagaatgttgggggaacgaggcataatctgctataaatagtatcttccaagaaagactgctgataaacagtagatttgagttgatctgcttcaggactgggaactggttttagaagaaccttctagaatgagaaaatatacagatttgtcaggctcttcagacttcataaaagttttacccagagccttgtatttgctgtggtttcagactggttaaggaaaacagataagccaagaaaggattttgtttgtaaattatttcccacaaataatttcatggacaaaactcatttaaaagcttgaaaagaattaacttgtaagagtctgatttattattattattattattttcttttttgagatggagtttcactcttgttacccaggctacagtgcagtggcacaatctcagctcaccgcaacctccgcctccctgattcaagctattctccttcctcagcctcccgagtagctgggattacaggcatgcgccaccacgcctggctaattttgtatttttagtagggacggggtttctccatgttagtcaggctggtctagaacttctgacctcaggtgatccacccgcctcggcctcccaaagtgctaggattacaggtgtgagccaccgcgcccagccaagagtctgatattttataaacagatatgaattgaatttcaaatgtgtgtgtgtgtgtgcatgtgtgtgtgtgtgtgtgttcatttattttgagacaggatcttgctctgtcagccaggatggagtgcagtggtgtgatcacagctcactgcagcctcgaattcctgggctcaagcaatactctgcctcaccctcaccccacccccaccactgctgagtagctgcaactacaggtgtgcatcaccacacttggctaattttttaatttttttttgtagagtcaaggtctctctatgttgtccaggctagtttcaaactcctgcactcaggtgatcctcccatctcggcctccccaagtgctgggattacaggcatgagccaccatgcctggccaagagtgtatatttttggtaattaatattcaagctgaaaactgtacctttctcctttcctggggcattggcatgggttttgttgatagaatgcattgtaatttggtttactcttgaatatttactcagccattctttcattcattcaacaaatatttgctgagtatataaacacaatatacccttggaggagagataagctatatttgaacagctgcagtagaagtggtacacaatcttgggagaatgccaaagaaggtgtgattgcttccagctggggagatccaaagaggtttctactcgggttgggactgtcatgtgggcttgaagggtctgaaagtggctagcaggggacttagggggagaaaggaggagagaaggcacatgtatgcacaggggcaagaaggcttaagttgagtgaaagaagtgggaaataaagacagttgaggtgagatcccaggcccgtggtactaggacgaggggttactaccctaggcaatagggaaacattgaagattttttttttcttacaaagatagtgatatgatcttgcagcagcatgttaaatgaaagctgccagtccaggacaagtcagaaggttgtgcccctatgactaatgaggtgtgacccttatgactttcaaaagagtgtcttagtaacatcagtgccaagatttggttctgaaatacagttcccacctctaacatctgggcctttttgtaactcatgctacctttgagtgggaccaaggtggtcagctttgatttagcctctcctgttctgccccatcagccctggactccggccacttctcagaaccagcctctgccacacacaccaagctttggctcattccccataatcctccaggatcagccctggcactccccctcccactctggttttcacttttttgttcctgtttaagagctgagagttcctgtttttgtttttctcctctgtctctgctgtgatgctgaagtagggtagatacagagaattttttttttttgagacagatctcgctctgtcacctagggtgcagtggtgcgatcttggctcactgcaacctctgcctcccaggctcaagtgattctcctgcctcagcctcccaagtagctgggattacaggtgtgcaccaccacacccggctaatttttgtatttttggtagagacagggtttcatcatgttggccaggctggtcttgaactcttgacctcaagtgatccacccaccttggcctcccaaaatgctgggattgtgtgagctactgcgcccagcccaagagacttttataatgtcgttgagagatagtagaggcttgattgaaggtgtggtggttgggatggggaaaaggaaatggaatcaagaaatttctggaaataaaagtggcaagatctgatgattggatctgggaatgggagagaaggagtcaaatgaatgctgagtttttgagcctgtatagagttaatggcttcaaaggggccagcagatatttttcttaattttacaaaggtgaactgaagctaagttatatggacagagttgtcaaagaggtgtgttagtttccttccgttgctataaggaaatatctgaggctgggtaatttataaagaaaaaaaatttagggtgggtgtgatggctcatgcctgtaatcccagcactatgggagtcgaggcgggtggatcatgagtctagggattcgaaaccagcctgggcaacatggtgaaaccctgtctctacaaaaaatacaaaaattggctgggtgcagtgatccactcctgtaatcccagcactttgggaggccgaggcgggtggatcacttgaggtcagaagtttgagaccagcctgactaacatggtgaaaccctgtctctgctaaaaatacaaaattagccaggtgtggtggtgcatgcctgtaatctcagctacttgggaggctgaggcaggagaatcactagaacctgggaggcggaggttgcagtgagccaagatggcaccactgcactacagcctgggggataagagtgaaactgtgtctaaaaaaaaaaaaataataagtgtggtggcacgctcctgtggtcccaactactcaggaggctgagatgggaggattgcttaagactgggaggtcaaggctgcagtgagctgtgattgcagcactgcactccaagcctgggtgacagattgagactatctcaaaaaaaaaaaaaaaaaaaaaaggtttaatcggctcatggttcttggttctacagcctgtacaggaagcataatgctggcatctacttctggtgagggcctcaggaagcttacaatcatagcagaaggcaaagggggagcaggtgcatcacatggcaagagctgagcaagagagaggagaaggtgccaggctcccttcaaacaaccagctctcatgtgaactaagggaacaagaacacacctatcccaaggggatggcactaagccattaatgagagatccgcccccatgacccaaacacctcccaccaggccacacctccaacattggggattacatctcaacatgagatttgcaggggacaaaagatccaaactatatcaagtggcttcttttagcatcagtgatgattaccttgaagggtgttatgagcagcttagggtcaagtgaattgtactaacgcaatgcccagcacaagctgtaataaacaagtaggattagagatacatacctgtgccaaaaatggtggtatatcaaaatgtggaagaatcccttccattgcttttagtccttccattattgagtaatctcctttcagtataagacctggcactgtgttttataaacaatttaggaaagagaatgtgatactaaatttggtgacagggatatgaaaggaattcagtgctcaagaatcttgaaaacggtgatgaataatgtagtttcagctgaggttattttgtgtggcccctgtgggctgatcacttgtttgaatgttttcattgtggaatattaaatagtcaaaattgattgatcaactaatatgtgtcaggcactgtcctagatagttttcaatatacagaatattttatttgctcctcatgaaaccctgtgatatgggcatcttattatcctcattttgcaggtgagaaaattgaggctcagagagagaagctcaatgaaacacagcccctaacttacactttttcttcagttcattaatgttgatgttttatttagttggttttaattcaggaatgcactgagggtcttctatgctgaacctttgtgaaaatgtaggttgtatttgtttggagcctgcaatgggtggggcagctcttctgtatacagcagggcaggatggccctagtgcaagagttacagtaaacagccggcttttttcttctccttaattccttagttcagcttgaggactttatcctggtgcttgcctaagggacacccacatcaccattatcatcatcattttaattatgatcaattatggaacattttctatgtgccagctatcatgctgagcactttactgcattagttcatggaatcattagaataaccttatgaggctgctactcttgttttcttcatttaacatgtgagcagaaagaagtaactcacatgagatctcacagctggcaagtagtagagatgggatttgaacctgtctgattcctaaccacagtggtattttgctccaacatcagactatttttttttaaattagaggtggggtcttgctctgtttcccaggctggagtacagtggtgcaatcatagctcatcacaacctcaaactcctggcttcaagcaatgttcctgcctcagcttcccaaagtgctagcttacaagcaagagccaccaagccagaccgtcccctgcctcaacaccagactttgctctcagtcttaggatccctacattgggtacttatttatttggatttagataggcttaatctaaagtccagatacacttgccaaataactttaggttccccccaccccagaacatatgatattgttagctatatcatacatagtttgaactagttattagattaattacctaaagaagctgcaattgcttctttataagcgctacctggtggatgatgtgttaatgggacagtatgcagatattcaaattacagaagcatttttctcatatatcagaagagagcattatggcacctcaccagaagcagggcgtccctggggaggcttggtgatgtggcagaaaatcagctttcaaagctttatagagttcatcataaaatgacattcacctcctttcatttcaatccaagtgctttcaagagtacaaaaataaacattagaaattaacaggctgcttttctgatagaccaaacagtggctacttggacctaaagggcaaattttgttcatcatttatatgttttagtaaagtgagattcgttctcattgtgggaattcccacactgtcccactcctatgtaagaaaattatagacaagcatagagaattacactgcataaaagctgatagcataataaccaattagatgattataaagcctgagtatattaaagtattatgcaaatactgattaatagtaataccataaatgcacagagcaagcaaaagcatgcctgattcaaattataggagcttttatttgcatttctacagaatctattattagtgggtctcaaagcaccttacaagtaataattattaaagctcacatgaccagtaaatgccatgttatgaagtgaatatgaaagaattcctctttacctcatttatagtataagacctaaattcccaaacaaaagtaggattctctgcatatggagagtattcatacattatgggtgtttttggctatggttctataggcttagaaacgggttgctatggattcaaggctttcctattgagtacctcaatctatgtagttagaactcttcacttatttttgaaatttaacccacatgatagctctaaacaaatcttgccagtatattttaatatctctttattgactataatatcaaattttaaaagcaaaaatgatgtcaagttcatatgaaagtactttaaaatattttggaatattacagcaagtttatttttcctcaagctgtaccctgttctgcggactcatcgcttacgagcacaatcagtgaagcctgtgtttctttctgtaccctgcagcaagtagttgaaatgttgtaagggtttctaatctgcatgagaatgctcctacacccaccctttcccctctattcctccttctctcttccctcctttgcaatttccatactctctaaagctaagcacagattggaaaggcaagaatgtttcaggtgtctgactctccctgtccctccatctcaagtcctcaagcttcccccacatggttcatactcagtttgatttactttcggtgctgagagactatttaatatattgcagtttctggtcattgtgaggcagctggactttcgtactgtacttatatttcaatggcatgcagatccaaagaaatgtgtagactagtgagcaccttcctttatagttaggattctggagccttgagagtcgaatgacttgactgaggttgtacagctggtttctgcctcacagaatcgagaccagagctcaggtctctaggctcttaaaccaaagtttccccctctgtctcgtggtggttatatactgctttgaatcacacacaaaaattttaaaccagaaatattggagcagagtgagaggaaacacttgttgattttatccaggactgtgagtcacaagactagaggtggagcctcagggatctgaagaaaaagggagtgatggccaggtgtggtggctcacgcctataatcccagcactttgggaggccgaggcgggcagatcatctgaggttgggagttcgagaccagcctgaccaacatggagaaaccccatctctactaaaaatacaaaattagctgagcatggtggcacatacatgtaatcccagctactcaggaggctgaggcgggagaatcgcttgaacccgggaggtgaaagttgtggtgagccaagattgtgccattgcactccagcctgggcagcaagatggacactctgtctcaagaaaaaaaaaaaaaaaaaaaaaaagagagtgatgtgcttgcagaattgaaggcatagacctgggattatcatttggagggaggagctgaatgactggaggtcgaggagaataaagaacaagtagaagtggagagagggcgaggtagaagaacagtcttaggaggattagaaggatggttgagtttatggtcatggcgatagtctattgatagaaaataaagcaaaactcaataggttacgggatttagtccttagggtcaatttagtccttagggtctgtgaagcctctcaggatgatgccagaaggagagggagagatggggcatgtgcagcaggtagcaaagttctccgggaagacagactactggcaaatatctgggaaacaggggtgactggagggatagaaacaggggtgactggagggatagaaacagagagactggagggatggtttttggaactctgtagataggtgtatattctgtgctatacttaagaattctaattttcatatttttctagggaaaactgaggctgccatcaaaaacttcagtccctactacagtcgtcagtactctgtggctttctgcaatcacgtgcgcactgaagtagaacagcaaagagatttaacgtcacagtttttgaagaccaaggtaagccatggatatttggtttacatgtatttccccttgaagaaggctatatagcacagccgtatttctgaaataaacaataatttgaatggcagttttaaaaactctgctctgaagtcgtttcatgctcaaaaaactctatttgcctggaagttagaatgtatgatttcttgttgctgatataatccatagaaaaaggaaattagcttgaatccaatattgttatgtatttttcccacatggatgctttgtttgtctaagaaaatttgactttctgtagtgaagttttggtcattgatcaaatatgattttctctttgaatcccctaatttattcttactcctttgctccattataataagtaaccaccacctcgacaaatgtttgttagcacctactatgtgctaggctatagtccaagaactggggaattaagacaagttctctgccttcctggagtttatattcacacacaggaaacgggtaataaacaaattaatatcaggtgacatcagataataataaatgctaaaaagaaataaagcgagtcttattttatttttgagatagagtcgtgctctgtggttcaggctggagtgcagtgatacaatcgcggctcactgcaacctctgcttcctgggttcaagtgattctcctgcctcagcctcctgagtggctgggattacaggtgcgcaccaccacacccagctaatttttgtatttttagtagagacaggatattcaccatgttggccaggctggtcttgaactcctgacctcaagtgatccacctgcctcggcctcccaaagtgctgggattacaggtgtgagccaccacgcccagcctagagccttattttagagaagatggttagggaagccctctgtggagataacatttaagcagaaactggagtgcaatgagagtaggctgtgtgaatattcgtgggaagagtattccaggtctatggaacagcaagtgtgaagaccctgccacacagagggaaggtcggtctgctgggagcactgtgagcaagggaggagggaggaacaatgacagcagagagacagatcgggagcacatcatgtcaacctgtgggtcacaacagggttttgattttgttttgtaatgggaagtctcccactggagggtattgaatacagagtggcatataattttagatgatctgtctggcctctgtgtaaagaatagactatggggcgagaggggagaatggaaactggggagcaggatactgtagcatctgagggaagaatgatgccaaattggactggggtggtgatggtcatggttgtgaggagaggtgcttatgatagagctgacagaacatactgttgggttgggtgtgagataatagaagaagagagaaatcagtgatgacttcttggtttttaaccagagcaaataagtggatggagttgccttttacttagaaggaagagtcggagtgaatgggatcacgagttcccttttggccatgttaagtttgagatgctagtgtggaaatgttgaataggccattagatgttttcatttggagctcagcagagtgattgagcctggagaatagaaatttggaagatgttagcttataactagtattaaggccatgggccataaaacagggaaagactatagacagagaaaagaaacagtacactggccccttcagcatttggagatcagaaaaaggagaaggatccagcaaaatggactaagaagaaacggtctatggagtaggagaaaaatcagaaaagcataatgtcccagaaggcaaataaaaaaggggtttcaaaattaagaactcaatcccatttataatagccacccccacccaccacacacacacacacacacacacacacacacacacacacacttaggagtacatttaaccaaggagatgaaagatctctacaaggactacaaaacacggatgaaagaaattgtaggcaacacaaactaatggaaacacatcccatgctcacagattggaaaaatcactatcattaaaatgaccatgttccccaaagcaatatacagctccaattcaattgctatcaaattaccaatgtcatcttacacaaaattagaaaaattaatcctaaagttcatagggaacaaataaaagcctgaatagccaaagcacgcccaagcaagggaacaaatctggagacatcacattgcctgacttcaaattatactacaaggctatactaactaaatcagcatggtactggtacaaaaatagacacatagaccaatggaacagaatggagaacccagaaataaagccacatacctacaaccaactgatctttgataaaatcaacaaaaataaataatgaagaaaggataccccattcaataaaaggtgctgagaaaactggctagtcatatgcagaagaatgaaactggacccctatctctcattatatacaaaaattaacttcagatggattaaaaacctaagtgtaagtcctgaactatagaaatcttaaaagaaaacttaggaaaaactcttctggacatttgcccaggaaaagaatttgtgatgaagaccccaaaaacaaatgcaacaaaaacaaaaatagagaaatgggacttagttatgctaaaaagcctatacacaaaaaagaaatagtcaacaaaataaacagataacctacaaaatgggagaaatatttgcaaattatgcccctaacaaaggactaatatccagaatctacaagaaactcaacaagaaaaaacaaccccattaaaaactgggcaaaggacatgaacagacatttctcaaaagaagacatacaagtggacaacaaacacatgaaaatatgctcaatatcaccaatcatcagagaaatgtatattaaaaccacaccaagatatcatcttacagcagtaagaatgaatgtcattaaaaagtcaaaaaataacagatgatgtggatgtggagaaaaggaaatgctcatacactgttagtgggaatgtaaattagttcaacccctacggaaaatagtatggagatatcacaaataactaaaaaagaactatcattcgactcagcaatcctactactgggtatctacccaaaggaaaataaatcattatataaaaagactcctgtatgtgtgtgtttatcacagcactatttttaatagcaaagccatggaaccaacctaagtgtgcaccagcggttgattggataaaaaaaatgtggtatatatacaccacaggatgctacacagtcataaaaaagaacaaaatcataccctttgcaacaacatggatggagctggaggccattatcctaagtgaactaactcagaaacagaaaatcaaataccacatgttttcagttataagcaggagctaaataatgggtacacatggacataaagatggagagaatagactctggagactccaaaagtggggaaggtgggaggggagtaagggttgaaaaattacctattgggtacaatgctcaagatttgggtaatgggtacactaggagcccagtccccaccgttacacgtaatacccatgtaagaaacacacgtaccccttgaatataaaatttaaaaaactaaaaataaaaaagaaggggtttcaagagagaataagtgataagtgagtcacataatgctgagaagttaaccaatatatttagcagcatgagtacatagggataagtgattgctttccctcataaaacagtgatctcaaaatttagggagcttgttaaaatgcacattatggcccacagctccagagattctgatatagtaagtctatcgtgaggccccatttttaacaagcttatcagttgattaagtggtccaggttttaagaaaagctgcacataagaactatgaagttcagcttatgccatggtttcagtttcatttaaagagaagagattctctcttaccttttaatgaggcaagataggggactgccgcattatctgtctcctatcttgcctcattaagcactggaatttggaagggaatttgtttcatcccttagattattcttaaaagagattggcatatctattttttttctgtatagctcatttaaaattttacttgaaagtagaggggtaagtttctgaaggcactatgattttttaataaagggaaaatagatgtaaactcagtgacatgtaaaagaaaagaggcccatttgtatattttgaaataatatgaaaattacacaatgaagccggatgggaattatccttacacagttaatccaatggaagatgtaactaggaatctaatggaaatgcccgcacagcacatatatcaccacagttaataagaaatcctcaaacttttcagtagaagcggtggaactcaggtgttctggcttgatacctgcttgttctttaaccaaatagcaaacatgatctccttgagtagcatggagaggggtccccatggctttgggtttaggaaaaccattgagaattggaggcagcatcggcaggtgtaatggataggggaacggtctgttaattctcccgctttgcggggattaaccctgagtcatgttcagggtgtccaggtaggtatccacacttacactttcctgcctcactccctctctcccatagagtttatcaagcatttattgagtgccacatgcatgcaaggcataataaccttattactataattccttctaccatatgcttctgttcctatagcataatagagggaaatgaaaatcataaaaataccaataagacaaatatttacattgggtcaagtggagtaggaaagggaaattgtggggggagaggaggaagcaacagtttccccaggatctcagtggaagatagtttcctaaactattccttgaaatagcatggataactttgtggtaacaaggtgtgttatcttttgttgtgatagttaattgtattcatcttctttaagccaccattggcgcctggaactattttgtatgaagcagagctatcacaattttctgaagacataaagaagtggaaggagagatacgttgtagttaaaaatgattatgctgtggagagctatgagaataaagaggtaagacacttctttgttactactgattcttacactgttcttaaaagtttggctcggttgattggtgtgccctctccttcctacaaggctatactaacaaaatcagcatggtactggtacaaaaatagagactgattcattcaataagcactcattcatgtaggtatctatttcagctaacagatactgattgaatgcctactgcataccaagtgttatacaaggttctgggtatacagcagttgataagacagatgcttgccgtctagtggcaagatagactttgaacaagtgattgcaagtgagtatgaagacagaaggaccagtatttggcatgggagcctttcctatgatcattcagccttgaggtctttctcagccaccatcctgacatctctgctctatgtctctgtcttcccactctgaagccctgtgcatgacaggtggctcaggagttatttcataggttgctattaaatttgaatctgcctgggttttcctgggttcctaggaattcagaatgcctcacatactttatttccatggaggtatttttttttcatttaacttttttctggttatttcactattttccttgtctgtaaaatgtggagaaagtgagataatgggtgtaaagcattcagcccctgggaggactttagtttttattggttcccatttctttccttatgtaggaaggtagtgtggtataggggaaagaatagcaggcagtgaatttggcaaactaaaggttaggtcaagttgtgccattaactagaaatgaacctgttgacaagtgacttcttgccttcagtcctcaattaagctaaacagttaggtcaaatgatcccactatcctcccagatctcatactgtacacattttttagtctgcatagaccctcaagctccctttgaaatgaacagctactatttatcagtgaacgacagtaacagatttaaaactctgctctctggcctctaagctcaagaatagtcaagatggcgaggtgcagtagctcatgcctgtaatcccagcactttgggaggccaaggcaggtggatcacccgaggtcaggagttagagaccagcatggccaacatgatgaaacctcatctctactaaaaatacaaaaattagctgggcatgctggtgcatgcctgtagtctcagatactcaagagggtgaggcaggagaatcacttgaactcgggaggttgaggttgcagtgagctgagatcaccccaatgcactccagcctgggtgacagagtgagactctatctcaaaaaaaataaaaaaagagtagtcaagatagtcttcacagagcactgtgaggactacacctgatgctaggaagaggcttcagactgacagaccaatctgtttccttcccatttctgatggaaaatagaaataaaatatactacaaacttatttcacaggctaccaggcaaagctcaagtgctctcttgggtagacttactcttttcaacatttattaagctaatattttctctgcttatcaatattaggattttattcaacacttaatttgtactcagcaacaaagtatcaatacactacaaatagtgatgataataacaagacaccttatgttttgtatgactcattacaacgtcctttcagaggagcttgaggagggacagtgtagcataatatggttcatactatgggctttgactcatacctttaccacttactagataggcgcccttgcctaagctataaatcttgagcctcagttttctcatctgtaaaatgagatctgcgtgatttctttgccatggtgttgagaggagtaagtgaatgaatgtacggaagcatttagcatatggctgggcctgtggtaaagctagagctgggtgtggagcagttgctggtatgattactactaacccattgggaagaaacagccctagatcttgttcttggatttattaaagtttttcactgcatttaacactaactgaggtttcattttgaatcaaatgttggtgtttttcctcttttcacttatttcagcttgctctctcagcttgcagtttgtacattgcactgctttttctttgttcatcgtttttaactgaacctgttcaaattgttaagatatggtgacttaatttggtaataaccaagtgttttttgaaacttggaattcttttaaagtccacgcagtttgtcataatttcttgaagttttaataatatcttctttttttaatttatggaagtatcttataaaattatatctaagaattatgcattaagtacctgtaagtcatctattattttatttagagtccaattctggctggcaattaaacaggaaaagtaaaacattctcacttgataatcagtttctattttgtgtgcactggggctggacaggcatgaatataaatcctggatgtgtcacctactcactgctgggccatgggcaagttattcagtctctttgagcttcatgtttcccatttgaaaaatggagataacatgtaatgcatagtactgttttgaggattaagtggtataatgcttataaaagccaatattggggcctgttataactagtaatacaattcacttttgagtccagtctaaatcaaattgcttgtaaatcttcttaatatcatacaagtttagattcttctctcaacattattgtttcactataatgtagctctgtgggagttcttagagctgtaaggtattatttcatggggagccctcaattatgtatagatcctccttcctgggttaatcatttattcagaagagtcctccaatcgtctttcttaggatgaataggtcaggctgccagaattctgtgttagtgggtatattctggttccctcacatgcttaagcagttgattagtcgttgttacaagtaatttagatatctgagagtttgtttcatttggatctcttcactatcttattgctgcagaacgtgttatcgttactctgattatgttggtcagatcaacattatttagtcatttccaagagtaaattctagattttgggtctcaaactttcttagtttcaattctcaacttgcctttagattactagtttcagaattttgccttgacttaagccctcccgtcagatgcacatacttaaatgttatcttatctgcatgtccttgtgggcataggtgcttaccaaactgctttggcaatgccctgtgcctcttttctgtgtctcaaatagcagagcttcttgtctgctggccagcatttgttctgatgtcacagtgctgtacttccatctcaaccattttgctgcaaaacagtttcacatctgagggcaaaatagtggcatattttatgccaacattttcatgttttgatgaaaatccatggtaactatcattgcagctacgtgttccacagtctcattagtcatcctatgtggcccacatcagtcaccaagcattctgtgcagtatttgtgtgatcgtcacctttgtggttattatcagaatgatttagttgttagcatctgaaatggcaaatgtggtgcagactttcagggttactgagattatgttttccacattcgagaacatacctagggtaaatctccctgagattagggactctgatttaccatgttgtgactgtcacatgaaagtattaaaatattaccttgccattagcaggtattcaaaacatattttttgagtaaatgactataactcaataacatagtatggggattgctatctctgaatgtctgaatctgtctatttgttatatccctgatattttccaaaaatcaaatggggaaaaagatatcattcctgtgtgcctttccctccccaggcctatcagagaggagctgctcctaaatgtcgaattcttccagccggtggcaaggtgttaacctcagaagatgaatataatctgttgtctgacaggcatttcccagaccctcttggtgagttgctgatcattcttttccaaggcaaaatgactaagcttctttgtttagctggagcagtgtttctctgtgaaggagagggatttccctccagggacatttggcagcatctggagacatttttgtttgtcacaattggaatcggggtgctatggcatttagtgaatagaggccagggatgctacaaaacatcctaccatgcacaggacagaccctaacaaggaagagttatctggtacaaagtatcagtagtgccaaggttgagaaaccctgggctagtcactcatgtcccatagacaagtggaagatgtgatttctctagttgaggaaaacattttaccacttccattatttctaatcccattcaataatacacagtcagtctctgtgtttctagcacatggaaaatgtgctgtcagccaggtatcttgaagcttttggaatatattgcaggctttgatagcactccacaaggcagcagaaataaacaggtagggcccagtccatgaaatatacaatcccatcttctagtaagcaagcctggacctgtcagggaatactatttttctaattttaggatgatatgcaactaaataccctaaatagacaaaaaaccttttaataagtgttacagtaactcatagctactgtgaaaaaaaaaagcattgcattaatttgcatatctataaataaagctgggatgctgccatggaaagataattgggagattggatttttatctagttctggctgtgccacttaccaaatgctttagcttagccggctgctgaacagctctggtttctgtttctccaactcaaaaacagggctttgaacttaaaaacctagaagggtctttctaggtctaaccttctttgattctcattcattccactttttacatgtggagaaatgatggataatatatagactaaataaggcaattcatagagattcatgaagtgtggataatgtaataactccatttggctttgcataaatcatactacatagtaattacttggttcttgaagagagccctggttcttattaacggacataataatttcattagaatttatggagaaaaacataatcattttatcaattgttatttcggtgctgagtgcttaacatagtgtttttaataacacaattacaggattggtacatggaccataaactaagattaacaaattattactaagtaattcatgctaaaacaacactttatgtgcactatgcatattattatattttcttttacatctacttatatgcccttggcagtggagctgcagctagaaatgggaataccaacatgttgactcatccaaatctctctaaaactttccaatgaaatcagccagaagagacaatatgtttattgatttattgctgtaatcatattggagggaatgaaaaggactaaaaaacacaagtcctgtgtgattaatcccagttggcccaaggcttcagattggggcattttaatgactttttaaaattgtgtgttgtgaccttctgacttttaaaatagaatattctacagtagatcagttgtgatattcttgtaactcagaaaaaattcactgatggcatctggaaaattgttgtaaaaggttgagagataactagaggctaaaaggaatgaattttatgggtttgttgaggctttttaaatgcaaaggatcaatgttgcttttggttgcttgtacaaaattatgacattcttggagagggcaaggaggattgtttgatagaaccatgtcagtcaagaagactgactctgtgatattatttctaccagaaagaataaaggcataataaagatgggatgcttatgaataagtgcatttcttggaaaaagcactagaggcttatgaataagtgcatttctttttcttttttcttttgagacagagtctcactctgttgcccaggctggaatgcagtgatgtgatcatggctcactgtagcctcgacctcctgggctcaagtaatcctcccacctcagactctcgagttgctgggaccacagctacatgccactatgcccagaaaaacaaaacaagcaaaaaaacaaacaaagaactgcagagacaatggtctcactctgttacccaagttggtcttcaactcctgagctcaagtgaccctcctgccttggcctcccaaagtgctgggattataggcataagccaccatgcctggccaataagtgtattctttacagagtgttcagctaagttgatacagaaaaaaatgcccccgtgttttgttaaagtaattcacttgtttggcattttactggttagaatctcatttactgcatacaataaaaaactcaaagttttattatctcactaaagatatttcgatattagttcagggctggtgtggactaaatttgtctgaagctcaggctctttcttgctttctccccctttatttctaggttgtggccccttttggcagggtccagggtggctgctgagctcctaccatagcattctcattccagataatagggaggagaaaaggaaaggaggagggtacattcactttctttagagatacctccaggaagtttcatatgccacttcagcttatatcttactggacagatcttagtagctgtgggctcaccaagctgcaaaggaggctggaaatgtagtcttattttatgtagtcacttgcccaactaaaaatcaggggccttattctccccagaaagggaaatagatactgtgttacaactacaggtgtctctatagcattcaatcattcattcatttgctcgttttcatgttgattcattcccagcattgtgctaggtcctggtgggccatggcttgtgctggtggtgcattctcctctgttaccttcagattccaggacactggaacagggctcccatatatccccagaaatttattctttatttaaaccaatacggattgattgattgactgattgattttgagatggagtttcgctctgtcacccaggctggagtgcagtggcatgatctcggctcactgcaacctctgcctcccgggttcaagtgattctcctgcctcagcctcctgaatagctgggattacaggtgcatgccaccactcccggctaatttttgtatttttagtagagatgggttttcactatgttggtcaggctggtcttgaactcctgacctcatgatctaccctccttggcctcccaaagtgctgggattacaggcatgagcaatcctgatttattaatttgccagaactgatgcggttctgtagactcccatgtggtcatgattcatttccttgtattcccagtgctttcaatggcctcttagagagaccttcttccttacctttccctgagattggtgcttaatacatatgcaggaagcacagaactaacattttcttctgcttattttctgtgactctggaaaaagttggaactcatttaaccaagtgcaatatcatgtaataggaatgcatggaaaggagtaaagtttaggtaggggttctgaatagtagtcggtttaaaatgagttgcttggaattgattttgagggaagaggtaaaagtcccattgtctagggctttaaaaaaatatcctaggccaacaaagcacatttttcactcaacaaactgaagttgaacatctgctatgttccatgactgtgctgtgggctaaggatacaaagctatggaagatgcagtctgcatctctagacgttcacagtgggtagcagtggttctgctccttgcggaggggaacagcacgggaatccatctcattcccctcccccgcctccctaccctgagtgtgggcgctgggcatgaaaacaggtcattgcagtatttggggagaacagggtaggaagcacctaactctgtctctggtggcagtgggatgtgccagcaaaggcatcccagaggagtggcttttgaactgacttttgaaggatgaatgagaatttttttatgggaaagcatgatggaaaggagggaagagagggttctatggactgtaggaacaatataaaaagtcacggaatgggtgaacacaccctgggagggtacagactgagagtggaggggaagccagcacagaacagggcaggcaccgatgcttagcgaggagatggagagagtcagcagaggaaccaataaaggtgataaagaagaaacaaaattctacaaagcatgaaggaaaccaggagagaggcactcctggaagtcatggggagataatgttttcaaaagaaggggttgttagcagcagcaaatattccaggtcagatgaaaagaagcagccataggctggcagtcaggatgacataaatggcttcagcagttgggtttcaggagctggtggggacaggaatcagactgaggtgagaataaggttgatggcataaaaacagcaagtggtgtttggcagtgacagggaggagggagagagtgcagggcagagagctgccctgttggagctggagcctgcagggccagtagagtgagggggtgcacaggttgtcagtggcctgcagaggggcaggagggcagaggaagctccgtttgtgggtctttagacataaggaagttgagaaagattgtgcccaggctgggcgcggtggctcatgcctgtaatcccagcactttgggaggcaaagtcaggtggctcgcttgagctcaggagtttgagatcagcctgggcaacatggcaaaaccctgtctctacaaataatacaaaaaaactagccgggtgcggtggcttatgcctgtaatcccagctactcgagaggctgaggcgggcagatcacttgaggtcaggagcctggccaacaaggtgaaaccctgtctctactaaaaagacaaaaattagctggaggtggtggtatgcgcctataatcccagctactcaggaggctgaggcaggagaatcatttgaatctgggaggtggaggttgcagtgagcaaagattgtgccactgtactccagcctgggtgacagagcgagactctgtctcaaaaaagagaaaaaattgtgttcctggtatcctcactgtccctgtgatgttgggtaggaggccaggcagaccgcagtgggacaggggaagctggtggagggatgccagaggagccagtgctcccagtttccctatcctgtgaaaatatctcaccaactttccatcccatggcctgccccagatagtcaccctcacgacctgaaacacacatttgaaataaaagatacatgttttaaaaggtatttgtgttttcaatatttctttagcctccagtgagaaggagaacactcagccctttgtggtcctgcccaaggaattcccagtgtacctgtggcagcccttcttcagacacggctacttctgcttccacgaggctgctgaccagaagaggtttagtgccctcctgagtgactgcgtcaggcatctcaatcatggtatggcgcggctcccctctcatccccggggcgggaagtggggcagccctcgctgagttgttctggtccatcatctattgcagtgattcttagaaagagccacagatgagccaagtgcggtggctcatgcctgtaatcccagcactttgggaagctgaggccagcaaatcacaaggtcaggagttcgagaccagcctgaccaatatggtgaaatcccatctctactaaaaatacaaaaaaatatagctggacgtggtggtgggcacctgtaatcccagctacttgggaggctgaggcaggagaattacttgaacccgggaggcagaggctgtggtgagccgagatcgcgccactgcactccagcccagatgacagtgcaagactccatctcaaaaaaaaaaaaaaaaaaaaaaaaaagagccacagatggtgctgcccagggaagaagagggaaacaggtaaagggagagttctgtgcacaaggagcctcacctgcttgctggttttcaggcaggcctgggaggccccggtgaagcagaacatggggcagttatctggctgcaagttggggggtgtcacattctgactgtcctgagtttattcatgtagaccattttgcatatacttcactctccttcttcctgatttaaaaaaatctaaatgccagcaagaacatgccagttttccctggcaaatgctagtctttttgacatttcctttttattttcacctttatttctgaataacagttactcagttaagatgagtggcacggtccgtggtaatctagtatttgtttctggatcagtgtttcttaaaactttagggctcataagaatcaccaggagaacttaattaaaacacacattcttaggcttcacccccagatattctgactcactgggtacaccgtggggcctggacttggcttttctagcacacggccgagtggcactgatgctgctggttcgcgaaccacccttggggtggtgttgcttcaggccactttgcctccaggcatggacttaagcaatgtgacatcaatagtaaaagagacttctcattccaatatgtgatgtttttgatatactgaggtgaatgctggtttttctggactccacaaagtcttcagttacagataactgcgctctttgttcttggcacttggaaaggcagccagtctaagagtactgagggcttactctgtgccagcctctacgtaggtgttaggaagagagtaatgaagcatacagagttcctgtctctgggagttgaaattcaaacagggaggatggataaacacccaccaattatcatttgaaagttatcacagttaatgggttaaagagcaacgagaggttactaactagtgaagaaaggagtgccgaactttcagctctccaggggagtcctgtatgagcaggtgacatttgagctgagtcacctcacccattgtgcctttatttcctaatatggttaatttcactgtatacttattttaaaattcagaggtttccctgagagtgtcagtcccacagagtgagagtcactagtgatgcatctcaactaactcttggttttagctgtgtattgatggggactcacggaaaaagataaggtcagtctgttttgccacagcaaccctgagtaacattcatcatcatactggatcataactagttaggaacttttttaaaaaaatgatacccttattaaaatcttgccttgtgtttttgatgttctagagacaaaaaattgcccagcactgactgcaccctttagctcattttccactacacttgcccgtctgtgtttagggcctcggtctagtaggaacatgcagttggcactcagcacaggaactgcgaagtttcactgagtgcagaatgctccctgcccagccaaatgggacttactgcattccccctttcatgtacataataggactttctctgaggagtttttggatgttatgtagcctgcatttagactccatttatggaagatttcagcccattcaaaaccccactctgctctccagtatgttatcaaaggcaccaagataatgaggtctagtcatatttccttggttctgtgtcacattcctctgcccagaaactgttttatcctcgctgaggctttatgtggacttaatttggcataacttccagtagctccagtcagaaccagaagctgtgataacattgtagggaacagtccttgactatcatgggccaaggagcagacctttcttttctcgcctctttttctgtttttgacagcatgatgtaccactcatctttattgtgtcacattttctgttctagtctctgcctgttactcattgtattattttgagtaaaccagaaacaggctttcacaagctgccacttaaccactttttcccataattacccaaaaagttaagaaatatagttaaaattagggctgggataagggccagaaaccctgaggtggctgctgggagcctgctatcctctacccgcatgcagatgaggaagggctgtcagcctgctgtggccattgtttcattgactctcaggccaccgtgcttctctgttgagaaccgggtcctaggcattctagtatcagaggcgtgtgaaccagagcaactccatcttaaacaggagctggaaatgaggctgaaacttactgggctgcattcccagatggttaaggcattctaagtcacaggatgagataggtcagcacaaaatgcaggtcataaacaccttgttaataaaacaggttgcagtaaaggagccagcccaaacccaccaaaactaaaattgcaatgagagtgacctctggtcatcctcactgctacactcccaccagtgccatgacagtttacaaataccatggcaacgtcaggaagttaccctacatggtctaaaaaggggaggcgtaaataatccaccccttgtttagcatatcatcaagaaataaccataaaaatgggcaaccagcagccctctgggctgctctgtctatggagcagccattcttttattccttaataaacttgctttccctttgcactgtgcactcgccctgaattctttcttgcgcgagatccaagaaccctctcttgggatctggatcgggacccctttcctgtaacgctagcagctgatgctaggcatgttgatctcgcttggggttccaggacatgtctcctagcactcaaattccaccacaacctagcccacttgcgccagaagtgttgggtctgaatttggctacattttcatgttcattcattctgaatctagaacccccttgtcctgcttttccttatagggtgggcgtttcctatttaaccctgatgaagggcctgattatgccctgttctccaacagtaaggctagctcctaaggtaggtaagggccagtagagagctctatgtttctccctccttcaaaagagagagcagcctttaggagcctcaaagattattttgtatcctaaggagaataaaggttgtgtgtgtgtgtgtgtgtgtgtgtgcatgctcacatgtgcactttcatgggtgttttgcttttatttagttttggcacctcttcattgggcaggcataagaaaatcccacaagattaatccttagtaaaacatcccactccacctcactggactaaatgtcaagccaactgtatagtatgatcctagaatagtagctgctgtcctctgtcccttttggagtcacactgtaatcccttgtctctgatcagggaaggctgtggttctgaatgtctgctgccacaaactgagacttatataaagccaagatgttctgagacagtcctgttgtccaaaatgcaatcctattcttcagaactttagtttgcaaaatacgattgtagttatgggttatagttaaagctcctgacaatacagagggctgaacacatgcgatatggaataatgatcattatcgatgcaagtctgttcttccagctcaggataatcatttcttggcatgtaaatgtgcaggaagaagaaaaagtgttcctggaggaggaataggatatgggagggccaggaagtaagatagagtatggaccattaaaggaacaggaagaattttgtgtgactggtgcttagagaggagagaggaagatgggcaggatccatgctataaggggctttgtgatgcatattaggaacttggactctattataacagcaataggaagccattaggattttaagtaaatgagcaacttcatcagatattcacttcagaaaggtcacaatggctgcagtgtaggcagtggatgagagggtagcatggtgggtggccaggaggccacttaaaaagctttggctggcaacagatggcagtagcttgcaccagagtgagggaaggcatttgtcaatatcaacccatggtactcagactaaaggatttgggggaacagaggaactggatgttagaaggcagccatcactggatgaatggtgattctggaaaggaggtgtaatgctggcaaagttttgttcaacagtgctgtgctagcttgaaggacagccaggactgccactaaacagatgccagtgttcacatcgtcatgaacacaaagaaagagaggacagtagactatctgggaagcatgtgtgcacacgggttgaaaacggtagtatcaaagaaaagcccatagaattttggtgaaaagaccacaacaatataaagacactctgcaaatcagtgcttcaagttggactagttcaatcacttatgacaatggtaacatccaacattgcttgtatggagtgagtcaggtggaatgtggagctataacagtgattatgtgttggaattggttactctgtcagtattacatgccttaagctcttaccccagaaatcccatgcctttattagatttgattttgatacttgcaagttttaggtgttcaataaatgttgtggaattaaattgaaatttagaacaacaaaggaccttacaattcaaatcagacagagcaaatcctttttggtgtgtttatttgaacatgatcttcttgctgtgcaacactcagcagcaaatctcagctctattttccccagcttattgcttcctggtcacctacgaagcaagttcattacttgagagactatgcatctagtgtggagatcaatcaattataactgaaaatatacaatgaattttagtttgtaatatgtgaaaacatacttttgaattttgtggcacatgcttatgtttatggacatgcacatatctatgagttggaaaattctaacttttacttaggctcctttgggcactttagtacaaactaataatgtttagagatagataaggaagaatacaattgtcatgaacatatctttgaatgcttttacttataaaaatattctatagtatacatgtgttgaaatgcatacataaaaccctctatgcactgcaagcaaaatgcttgctagttactgttaataaataagtagatattaatttcctgttttcctaggaatatcccaagcaaaattctttaaaagtgttctctctgcttgagctacattctcttctggagtttagcctgtgctctttgcctcacatagttagtactctacaattagaaatatttctctctgtctccttgtgagtatgtggtttttacttaggaagtagtcattcccttccctccccaacttcccctcacccctggtccatgaaactctaaatttgggagggactttcatggtcacctattccagtccctcagggtttaattatgataaggctcaaataggtcacagctagttagtggctgagaaccagttgtcccaatacctggcctttgacgtctgtttcagttgtagatatcatgttgtcttctcagtgttactttctaaaagactcatctcttgggcattttaaacatgctgctattaaatcaatctattctttgcatgatatgtttgcatgatccagagtgaagcaaatccagagctattcacttaagatcacctgagacctggagtatatctggcttctcgataaattgtatgatctgtgtttaacttggtattttgtccacaggctaaccatgactatatcttttagtttagaagtgctctgaagataaaatatttgatagcatagcttctctactggtttagtgtagtttaaaatgcaaaccatgtatgatttcatgcaatttaagtaaaaactctaatttgtaaaggaagattgcactgcttgtgagggcatgggttggaatactttaaaaatagtacatctaaaatatgcctttatattatttatacttaacagatttacttaaattacttgaagctctcaaagcaatttaagagttggaactagaagaacaggtttccatcacagactagaataaacagaactgctctctattagccattcagtgtttctccccagcagtatatgggttatatagtcctgggttcactgttgtctaaagcagtgttgccaagaactacatttaaatacttcttttggcccatcaaacatggtgctctttcagtgcaatcacagacttccaccccatctccctcagttccaatgaaccaaatagttatttggtatgaaggtctaaaaattgtatggttatgatagttcaggatgacaaattggaacaatcattaaaaaaattacataagcagagttaaagttcatttaagcaaaaaaaaaaaattgttttgttcgtgctatttagattgggtagattccaaaatcactggacagtttttgatattactataatcaactgtggcaaagcctgaatagctttcaagttttgggtttgtttttcttcttttacttatagacaggatatattacaattgaaacatacttattagaatgacatagtaaatgcaatggctgttttaatatgtggttagataatcaacattatgaaaggactctatttggcatgcatatagcccaggatttcttttaaatataaatatcctggagaatttggataaaattctcatctgttgttattgaacagtgagccacattcattcttcccataccatgaacaagcttagagaacgtgatacgggagggaatcatgcttggagctattgtttactctattagttgttttgagtttttaaaattaaatattgagtagatttagaagaatgtttgtaaagtatgtatagagtataaagaacgttatcgttacctctgaaatttcttatgtgtctttccctgatcctatagccttctttttcctttgagaaagctccatactagattttatgtttggcttttctttacagctttatcacatatgcttaatcattttgtgtgtttttaactttatccatatggaattttactacacttcctcccatgacttctttttgttcagtattatattccagtgcttcatccatgttattgcttgtagctgcaatttattgactttcaaagctaaacatattctattacattaatataccataatttctaatatctgtgttactctagatagacatttgggttgtttccactatttattattgacagtgctgctgtgaacacttactgtttgttgctggtttaaaggtatttagttttgattgggtttactaatatctaaaggaatgttcacatctgtgttaatgagtgtatttgcatgtaattttcctatttttcagtgcatttttggatttttgcaccaaggttatttttgcttcataaaatgatgcatcttttcttttcctttgctataatctgaaatagtttgtgtaaaactggaattatttgcatgttttaatatttggcagagcgtgcctgtaaaatcatcttaggtgttctctttgtgagaagatcttaaactactaagttaaattttaaaaatgttacaggattattcagtttttcaatttcttttttttttttgagatggagtcttggctggagtgcagtggtgctatctgggcgcactgcaacctctgcctccctggctcaagaggttctcctgcctcagcctctagagtagctgggattacaagcgcacactaccacacctgggtaattttttttgcatttttagaagagacagagtttcaccatgttggctgggctggtctcgaactcctgacctcaagtgatcctcccactttggcatcccaaagtgctggaattacaggcattagccaccatgcccggccccagtttttccatttcttaactcagttttagtaggttacacttttctagaaagttgtccattctgtttatgtttgaagtttggtggcataatatcctctcactttttaaggatatattcatgatgccctctttattctctgtagtgcctgtagctgtttcctctttcttgtttgcttgtgcctcctctcttgtttccttgatgaattttatcaacttcctcttttctttttttttttttctggagacgaagtttcactcttattacccaagctggaatgcaatggcgcgatcttggctcactgcaacttctgcctcccaggttcaagcgattctcctgcctcagccttctgagtagctgggattacaggcatgcgccaccatgcccggctaattttgtatttttagcagagacaacgtttctccatgttggtcaggctggtctcaaactcctgacctcaggtgatccacccgccttggcctcccaaagtgctgggattataggcatgagccatcgtgcctggccttatcaactccttaaaaaaacacagatttggactggggagattattgtatatttgttttctattatgttaatttctgatgttttaaaaattgtctttcttctattttcttgggctttatttcgctggctttgttttctcatctctccaggtagatgcttagctcattgtgatgattttaaagcacttgcaaattctttaacattctttccttcaaaaaatggagtcaaattttcctccacttgaatgttggccagacatagtgacttcttatgaacagcctgtggcagaagtgatggtatgtgactttcaagaataggtcaccaaaaagaatcatttctgcctgactttctcttggatcacttatttgggagaacctagtcgtcacgtgagaatacatgagcgtccctctggagaggcccatgtagagaagacaaccatgtgagtaaacttcctgggaagtggatgcttctattctgtcaaaccttcaaacgattgcagctttggccaacatgtgactgcagcttcatgagagacctcaagccagaactatccagccaagctatttttgaattcctgacccataaaaactatgagagataataaatatttgttgtttcaagccactaactttaggggtaatttgttttacagcactagaaagctaatatactcattagtcatcggccatttttctgctctaatacaagcatttaaatgctatagatttctctctacattagctgaatctcacaagtttggatatgcaggatcatttggatttaaatattttctgatttctattattattatttttaacttacgagttacttagaattgtgtttcttaatttccaaatatatactctatgtcaattattgatttctagcttaattgcactgtggacagaaaatctgatttgtatgatatcgtcctttaaaatttgctacaccttgctttgtgtccctgcatatggtcaatttttataaaagctcataggcccttgaaaacaatatatattctatagccttatatgtccattagcttaggtgtgttaatagtgtcattcaaatctatatccttacttttgtttttatttatttatttattttctgtagacctcctctgtggattttttgctatgctaaatttttcagttattgagagaagtacattcaaatctgccactgtgatgattgactgattttactatttgcatttctattgttgaattatatgttttgagttatatatgtatatatacacatctacacatgtatatgtgtgtatatataagcacacacatatacatacacatatatatgtaatgttactagatagattcatgcttagaattatatcttcctagtgaattaaatttttatcattatgaaatggcacattttattgctattaatgctatttgccttaaagtttaaaaacatctgacagtctttaaatgatgtgtatcatttaagagatgtttatcacttaaatggtacatatacatcatttaaaggatatatcatcatcgttaaatgagcatttagtttttttacatgtgttataattactcatatttttgtttgtaaatttactatcttactttgtgttttctacatatcccaccttttctgtttcctttcttctactttcttgacttctggattgattattattaaaactttattattagcaataataataaacacaatatattttatattctatttttatttcgtatattctatttttattttgttagtgggtatcctagaaattttaacttgcagaacttatcaaagccaaagattaatcaacatccttaagtttctctcaaaaaatatagataacttagaatgctttagctcctttaacacccctctccacttataggttgttgtggacttaaactttaattacatttttcaatttttaaccaatcaatatattattattgctgttttataaaattgtaatatttactgcatttttaccactgtagaggaggaaaaacttttactatactctcttaggttctgctggaatcggtgaattaagctgataaaagacagattaacaggaggaaagcatacacattttatttaatgtcattatttacatggcaaaaggggtttcacagaaaacaaagagaaaatttccaaagaagcagttagacttgggggcttatataccaatttaacaaaagtaataaattgtggagaagtggctcaacaaaggaaagagatttgagttcctaagagtgcaaaattgtgggaaaatgggaactctgggcaatctagtggaagataagggttattttactaaggtatatttgtgcagattcatcttggcattgactccttaactctggtgataagaatattctcttcttcctggtaccaggagggcacgtttctcatggaaaatttatgccttgcttttaagcaaaaaggacaagggcggggagctcttcttgcatctgttgtttctcaattgcctttggctcaaaataatcaatatgccaatgcagtatattctgagatggcatgttctgatctccttcactgctttctttgctcataattttttcttgcatctcagactgtccatctggaaacattttccttttgcctgaagtacatcttgtagaattttctttaagtttgttcaaaagatgtttctaatctttttctcagtttttgtttatctcattctctcatgagaaaatgtctttatctcattcgtattcttgaaagatactttcactgcatatgaaattttggtgcagcaattattttcctgtcaccacattgaatattttgtttcatgatcttctggcttccattactgaagttgaggaatatgctatcagcctaattcttgttcctttcaaggtaatttgattgctttctttcctatttttttctaaaaacatctttttttgtctttggtattctgcagtttcacaagaatgtgtcttacctacagatttcctatttatttatactgcttgaaatttgttggtcttcctgaatctgtgggttattgtttaagcaactttggaaaattctcagccattatttcctcttttcctctattccctgtctcttttcagaaatctgattacatgtacattagatagtctatcttcctcacctcttaacctttttttttttttaatttgatacagagtttccctcttgttgcccaagctggagtgcaatagcacgatcttggcttactgcaacctccacctcctgggttcaagcgattctcctgtctcagcctcccaagttgctaggattacaggggtataccaccatgcccagctaattttttgtatttttagtagagatggggtttcaccatgttggtcaggctggtctcgaactcctaacctcaagtgatctacctgcctcagcctcccaaaatgctggcattacaggcgtgagccttcatgcccagcctacttgttaacttttaattttatattttctatcttttttctctctttttttttccctgaacagtttctgtgctctgtcattcagttctctacttctctcttcatctgtatttaatccattactaaccttatctacggagtttaaattttaatttttttatttttcatttctattaattattttcgttctttttctaatctggtcatttaaaataatctctttttacttatatttccaatttttaaaaatatttttaaacatgtcaaacaatatattttatattccgtgtttgctaattttaatatccaagatccctgtgggttgtattctgctgttatttgtgctggctcttactcatggtaccttattaacttgcttattttgtgatttttttgatgatgagttcatatttcactgaagccagttgaaggtgagttcctgagaggatttgtgtttcctcttactagatgcttgaggacactaccagatatttggaccatgtagctaatgtgcatttaggccataaagattgtggggacatccttctgattatgatttctcaagagaaatatttatctctttcactcaatgcctaggtttgagacagacaattttccttagaatgggctaagaccgtgtgtatgtgggtggtttctgcaatttaatttggcacattatatgcattggttctttgattctggtattcagcatcctgggaggctagaaaaaggtagcttaaggtcactaggttctatcagtgtcttcaaagtgaaaactagcttcaagacttgccttatgtttttgggttttgtattagtttgctagggctgttgtaacaaaacacctcaaacttagtgacttaaacaccagaagtgtattgtctcaaagttcaaaatccagatgatggcagggttggttccttctgagggcaatgagaaaaggatccattccaggcttctctccttggcttatataagcatcactctgatccatgccttcatcctcccatgacattttccctatgtatgtgtctgtgtccacattttcctcttttttttttttttttttttttttttgagatagagttttgatcttgtaacccaggctggagtgtaatgacatgatctcagctcattgcaccctccacctcccaggttcaagtgattctccagcctcagcctcccaagcagctgggattacaggcacacaccaccatgcttggctaatttttgtatttttagtagagacggggtttcaccatgttggccaggctagtcttgaactcctgacctcaggtgatttgcccaccttggcctcccaaaatactgggattacaggcatgagccactgcacccagctagcacattttcctcttttataaggacaccagtcatattggattgggggcttatcctattccagaatgatctcatctaaactaattacatatgcaatgaccgtatttccaaacaaggacactttctgagatttgggggaatcaagatttcaacgtatgaatttggggggtatacaattcaatctataacaggtcttacgttgttgccagttcattgaggtattcaaaagaacttttggaagtgcaatttatccactatgtcttttcttcagtaagagggttggttacggtatagagtatgctatgctgctgaacaccataggtttttgcatggtgttaacaaaaattgtatgatgttgaaaagttaactgtcactaaggcagttttacaaaggctgcttccatctttggagcaaccattcattttgcagctctgtcgcattatccttgaggttctgaggctgcacatttaccaccttgaccttgcgggaaatgactcaaaagccaccttcttgggctatatatttgccaccttgacagcgggggaaatgactcaaaagctaaacctgacgttcagaactttttcgagttgtagagccattttagggatccatgtttcagtcaactctgttgaatgctcccggcaactatagcacatatcaatcataacaataataaacaaacctcagtcatcaagagtaaattatatcctacgtgttatgtgttagatgatagagaaatgtggaatacattttaggaagctttctatcaaagagagtttaaacctttcccatgtataaaggattagctcttagctctgaagactttgcttaatcagaagatattactcatttaaggttatttaaagataaaaacttttagcatattgtaatctatcaaccactgcttctgaatgacttggtgtggaatcagagttggggggaagagacttttaaaatttcagagtccctggcattattccagacctacgaattagaatctctgaggaaaggagcccagaaacgtacattttaaacagcatcccttcagagttagagaatcgttgttgcctagggtcttccttttaaacataaggtattttgcttcagcaacttaatttttatttttctcaaattgtattactggtaaagattcatgatttttataatatgaatttaatgtttgaagtgatattcaacagcacaataaaaaagtggtgaatggtgggccgagcgcagtggctcacgcccgtaatcctagcacgttgggaggccaaggtgggtgggtcatttgaggtcaggagtttgagactagcctggccaacatggtgaaaacccatctctactaaaaatacaaaaattagccgggcatggtggcgcacaactgtaatcccagctactcaggaggctgaggcaggagaatcgcttgaacatgggaggtggagttgcagtgagccgagatggagccactgcactccggcttgggaaacagagtgaaactctgtctcaaaaaaaaaaaaagtagtgaatgcaaataaaagtagtgaatggtcacaatgtgcttagcaattgtaagataaaattaaactctttataatattttagtgagaggaccacaactagactcttcatgggatttcctttttgaaaataatcctgaatctaatagcaagcacaactgagatacattttctttactgagttttgcatttccagtgtgaccctttcgctttttatactggacgatctaattttacgtaagagctcactctggtaagctgtaccgtgtgtaggtgtacatggatgatctccactagtaagataaaatacctctcttctcttctacttttatccccttcttctgtccgagtgagaggcaatgtaccacctttcccttagacatgaccataaaatcccagaggaaagcaatatgcctaaaattatttagtctgtttcccttgcttgaatatgcactggaattccctggcctggggtgggtcctaagaatttgcatttctgacatgttctcaggtaatgctgatgctgatactactggcctggggaccctacttggaaagccactgtattaactcatttaatcctcacagcagtcctgtgaggtaggcactattattgtcatcatgcccattttatagacgagggttctggggcagctggtaagacagctggtgatcaggacaagattttaaagccaagcaggccgacttcaagcccgtgttctaaactactgtaccatgtgtcttctcagtcagcaggtacttattaaacgcatactgtgtgccctgtgtttgactagctgatatttttaaaaaaaatctaatctcattccttattcaggaacagatgatttgaggatactcacttcctactgaacttgacatggataatttcttgatatctacttgagagggacatgagctgctacatcaattgaaactcaggtgacaattgagatgcagaagttaagtcttttctctgcttttaaacatgaagttgtgccttaacccaaaagggtgttcctgtggtaaactgtgtactctataaatgttctccaaagctagaattttcttggtttatgcaaatgtacagctgagaataattttgtgggatatgttgcaggggtggggttgaaaaattcatggtacttatctattaccagttctttgtgttttaagtacttagcctttatttttttttcctttcagcattttcttttgttaactggattcccatactggctgttgctgagggggttggggaagtcctgatctgacctgaattttttaaaacaattttttagcattttcttttggagaccacaaatcatattgcaagtcaacaacgtctgggtgttagtgggacatttctattttaagaggcttagaaaaggaggtaaaaaagaaggaagttggaagttaggaaggagcaatgaaagcaaagcacccattttcacatcttaccagacaaagcccctccctgccaagttcctttctggtgggagatcagggcatggctcatgcaatcaccagctaagaaaggaactgagacttctcttcatttgttgttttttccttccccacctttccctagaaactattagactgccacactgtcccgttgtgtgacacgggacactttaagtgacggggtagacaaaagctggaacaaaagagcctctattaaggtaagggtctactgtgtccagaacattgtcttagatgctgggggcaaaacaaaccgaaaacacagtcattgcttataaaccaaactcaatttgtaaggctatcccactcagttaacagaggagagtttgaggatgatttcctcctgactttccaggataagtggaataaaagaaatagaaaatagatcaggaacatcattttgcctcattccatctcactttaagtgaactcgggcccaagcccaagtggttctgttccaggaaacacggtgggtcaagcaggatgtaaccttatcacacaccttagccattgtcctttccttcttaaatccctagtgaggaggataatagttgaagatatccttctttttttcttctccaggctttaggatatcagattaggtattttcaagttgagaacaaaaagccttaccacaaagttgtattctccttgtgccaataataatgagtcattcttgctaagaacataggtggtttgtatctttctagtgcttcttgtcagaagaagcttaacatgcacagagggagatatttttcctggcacaatagaccctagtcacaaaccacaaagttttgcaataaggctattcgttaagtgaatgcaatattatagctgagacacttttggggtgtgtgtgtgtgtgtgtttgtgtgtaggggtgtgtgtgtgtgagagagagagagagagagaccgagagagagtgtctgtgtgtgatgggggctatacctcagcttcctgtttggccttgctgatgtcaccgcattagtatcggtactgcacttcagatttttgtacagatgtaagtcatcatatttagtatttgactttaaaatgaattggtttttgcacatctgtgctcataaatgaataacaatagaagggggaagaaattttgaattttgattagatgaaaggggtgcaaaacttccactctttctttcatagataccttgcaagccaaaagctttctagaattgctaggtgaagttctaaatatcactaattttgagataggctgattgacatttatgattgggtttggtcaggatgaagggtagtgaaattaccagcatagatgagtgagttgccattggtctaaattttgccatctctggttttcttctgatttctagttccatatttggtggctttaaatgaacacagtactgttctcttcataccatgtatattttttaccaggtcaggaatctaagaaacttatgatctaatttagatgtctctggaaatgtgaatttcataacttaagagaagggaacagatttgaaattgaaatattattatagggagctgacagttgggttaagtggattgttacacattatcatcttaaaattacatttcgtgtcttcttaactttcctccaaagaacacatcctagaattataacactattttcaattccctctgcatctttcagcccttagaactaaatcctaagccaatagctcacttttggactcctaaatttgattttctgaaggccttaggttaaatgtcatttccaccagaacacctttcttaatctttcaggtaggtgaaagccccacaattttcttctatctgtccattcatctgtccttccttctctcgtacctgtccttacttccatcacagttctaatcacatcatgtcatcattgactatttatttatctgactcctaaaactaggagttcctagaagccaagtctatgcccatctactattacatctcagccattagtactgagtgtaggggtgtagtaagcacatactcatttttttttaactgaataaaggagcatgggaagtaggtcatcatttgaaaaagcatctggaaatgataagaatagttaataaagcattccggattgtttaggagaaaggtctattttacttgttaacagcaaaggcaatttctttggaagattttgctttcttttttgactatctgtgcagttacttgtttatttttcattttccatcagctttacaactttttttctcatgctcctcatcgcctactatcatttgtgtttaagccttcctttacataaaacagtatttttggcttattatttggatgattaatgaaaatcaatcttagcagttagatttctgactgagactgaccagacaaagtgaaatgtgttgcatgatgccattatttaagtcactgttttgttggctgtgacccattaagcatcctttctttttgtttaaaaattattttttttcagcttgttttagatttgggggtacgtgtgcagatttgttacattggtatactgtgtgatgctgaggtttggggtatgaatggtctcgttacccaagtactgagcatagtatacaatagttaggtttttcaactctgtacccttcccccacctctatagtcccgtgtattgttgccatctatatgtccattggtactcaatgtgtggctcccacttataagtgagaacatgaggtatttggttttctgctcctgtgttaatttgcttataatggccttcagcttcctccatgttgctacaaaggacatgattttgttctttttttaatagctgtgtagtatcccattgtgtatatataccacattttctttgcccagcccactgttgatgggcaccaaggctgattccagactgctttccacagtggctgaactaacttacattcctatctaccatgtataagcattcccttttctctgcacctcaccagcatctgttattttttgactttttagtaatagccattctgactggtgtgagatggtatcacattgtgattttgatttgcatttctctgatgattagtgatactgagcattctttttttttttttttttgacctctttagttttatattgtttcagctaaaacctgtgatgaggtcattcttagtgaactacttataactagttagttcttataaatgctgccaatgttttttttttcttttattattattatactttaagttttagggtacatatgcattcttaaaatatgtttgttggccgtttgtatgtcttcttctgagaattgtctattcatgtcttttgcccatttttaatgcgattatttgttttttgcttgttcaattaagttccttaaaggttctgaatattagacctttgttagatgtctagtttgtgaataaaatattattttttaatgcatctattttcattttacgtatttttttttacagtcaccttggtgactgtaacacttaccatcacttttgaagaagtgacttaacaaaagaacccaaacaacatttcttcacctctgcagactcttcctctcacaatgaagtggcttccgttactggaataatgtcagggaagataacagcttcctctaaattcaccctattcaaatgtgtaattcacacttgttcacagactagaataatgtacctataaagtgtttattggctgttatatagctcctagaggaagaaaataaaaatgaaatggtttgtacgttatagtttgtcagaagtatgattgccaattataatgataaaatactaatgatagctcacattgctaatatttattgagcacttaccgtgtgccaagcactgtgtgaaggctgacaacaatccttttagttaaacagcattattgtccgtaggaaaccaagatttagatagctaaaggagattgcctagaggtaggcagttatcaagtggtggactcagaattcaatcctgaatgtttaactccaaagctcaagctcgtaattgttgtgtattaaagagcctgacaactaaaggattatatattcagtttctcctgctacatttgaagagggattttagaaagtaacaatactagcaaccaattattgaatgccaggtaatacactgagtgtttaatgtatgctctttcgatccctatgacaatactaaggaggaacaaattttatctccatttttcagatgacactgaggttcatggaaattaagaagtatatttaaagtcacaaagctatttaaggtcacaatagctaattaagctattaaaccaatgaatacctagatctctgctcttactgcttattgctggtcatactagagtatgtccagtgcttgaatagtaagaggtctggcaaccaggtcatatgactgagaaaactgggttatgtttaacctgacagtggttgaagggaggaaaaaaatcttcaaatatcttttgtcacgtagaggaaggatcagacatattttgttttgctccagaaggtaaaagtgtctcttgtaaatgtaggcaatctagattctgaaattgcaattgcagttgcttgcttctgggaattttatttaattgaaaatagaaattgaatctgtaaaccaaaaatacataaacaaacaaacaaaaaaaactaatttgaactcagttaaagtccccaggtggcatctattacatgcatcttctgaagacaccgttgcatttttattgtattagaagaaacaacatttccagaatatcagaggtgaagcctcaagtcagttctgtgtctgccagaataaaaacaaaaataaacttatctttcttcttgttgtcctaagaataaggtatcagtagttccagaggaagataagaccaactgagagtgtgggaaagagaataaccttagtgttcaaagcttcatagggcagagaacattggacaggtcaactagtaatgcctaccgcatcgtgtggtgatgaggagggagagaatgaactgctacacgtgaggttctcagaactcttttaaggaggacgtaatgttaaactaataaaacctggtgagaaacaacacacaggggtgcctccggaggctggagggtgggaaaaaggagaggatcagaaaacataaataccagatactgggcttaatacctgggtgatgaaataatctgtacaacaaacacctatgacacaagtttacctgtgtaacaacctgcacttttacccctgaacttaaaataaaagttattaaaaaaaaaaagaaaagaaaaactgtgggatagcttggctatacaattatcaatattctgatattttccaattaatgctgctgtttctcatatgaccacaaaagggagatttgtttcttttctgtgtttgagatgggcatatggaattctttaaaaacaaaaaggggaaataccaagaaataaaatcaggcaactgaagatatgccttctgccatggaagctcaaaattttaggatctttcaagttcttcatttgcacctgggacttcagatgcttggtattgctaaaaaatgtgttcattttctatttcaaataaatatggagataattattttaacaaaacaaaacaaaaacctggtaagagggctgagcatggtggcataccactgtagtcccagctgctctcgaagctgaggcaggaggatcgcttgagcccaggaattcaaggctgtactgcacaatgattgcgcctgtgaatagccacagcactccagcctgggcaacatagtgagatctcaccttaaaaaaaaaaaagtatgaaaaacctgttgagaaatggagcatcgactaggaagctgacctgaggaggatcaagagacccagtgttagctagccacttccatcacgggacagtggctgctgttaaccgggcagggggagcattcggagataaacaagggaaggtctgcaggtgccagggaaggtctgcgggcgatttttctaatatgtactttggcatggtctaatgttgactttttgcaaggaaaaggccaggtcaatcttattgttctttcctttctttgaactgtggaataatagtgagtgcccttgaacctgtggagaaaaggatagaaaatttgtttttctttcacataaaaggacattggggcatgccttagtccctagctgacagtactagtcactgtgcaggggaagatggctttctggagcacactaattccacttcagaacacagagcaagattaattatgaagaactgataactccctacctccctacttccctccctccttctctctcttcttccctcccttcttctttccttctttcctccctccctcctttcttctttcctcccttcctccctccccttctccttctctccttttccccttccttccttctttccttccctcactccttccctccctcccttcctccttccttccttccttttccttctccttttctctttccttccttcattctcctttccttccttccttccctccttccttccctccttccttccttctctccttctttcccttcctccctcccttcctcccttcctccctcctcttccccccttcctgtcttctttcctcttgtcccttccttctgccaacaaatacttatcagcaccttttgtatgctgagcccttgctaagtgctgacagtccagtgctatagaaaacagacatgatccctgccttcttagaagttacaaactagtaataataaagaaaaaaatatttaattacaaattgagatacgtgtgtaaaggatgcaccaagaaattataagagggacttgatttagattggttcaaggaaaggaatctgtgaacgtggcaaattagccctgaagaacatatggtctggagcaagagctggcaagtctggctgccacctgtttgtgtgtggaacacagccacaccatttgcctaggtattttgggctgcttctgcaatagaatggcagagttgactagtggcaacagagactgaatggctcacaaagcctacaatgtttactattttgccttttacagaaaaagtttgctgacccctggtctagaaaatacttgaaaataagagctacaatatttcatttgatccatgccttttcaggtagggtgggccgtggactttgtatgactgaaacatgtgtgggcacaaattacttgggtgtgataatgtgtgtctcatcatgaagtagactctaagcagacaagaaactttctccaaaacttgagattgcatatttcaaatgaatttcctgtttgtggaaagaggtattatggtgtggtgtttgtaagcttagtatttggaatttgattttgaaagactattttggattcagatcttggctccaccacttaggatctgtgttactcactctcattactcttcaattttctcatcagtgggacagaggtattgtcagtgcccattcatatagttattgtgaaaattacctgagataatgaaaagacagtacttagtacaatgactgacatacagtaaatacttaatatatatacactgttaggatttttaagatacaaaatattttcataaaataacacatcaatttttgtgatgctactccataaataatattcagtttttgttttttatcctaatagaacaatttttttcacaatgtctgaggataaataaaagcaatgacttctaagtcacaattatacaatttttggaagctaattttataatattttgaatttttttgcatgtttacaaaattaatttttgttttactctggaagtttgaggtagatctgcccccgtctccctggccccccgcccccgccgcagtgctatatttagcatgcttcctcccacctgcctacagctttgcataccctaaaatgcccattaaactccttttcattccttctgtctacagtctgggcctatattagtcctatggctttgattccaaccccactcacaccatagttctctggttcattttcagctagttcatgagtgggtctattcttccagccttttcttactttccctttgtggtctacggtccttgcatggacatgaccacttcccaatgcctccccacagtccttcgttccctgaagttctggctttggttccactttcccatggctctgacttgcaggagtgcttggttgtaggctaactgccttgcacacaccctcatcagctgtccgctttcctgatgcagacctcagctccttgctgagcaatggcatcctcaccatgctgcccatgaaacccccacccagcccttcccttaaaatatctactgggtagccaccagtcactcacagtaatctggtgagcatggcagagcgaaccagcaaggcacagcagataggactgcttatataccataatgatgacttcatagcaccatgaaaataagcactggcctagttacctggtcaagaaaaaaaaaatcagaactcttacaacagaaatcaggtagtgggatatattctgcttctgctttcagatcctttttggtttgtttccattggctacatggttactggggaaatacagatcaaacttgtgttctctgaacccagtgacacggaaagcagaggtatcaaataatgatgccagagctggaaagtaccttagagatcctatgtcccactgccatcattgtggtagataaggacacagggaggttgagcactttacccaggatcacatggaagaaatgtgatattgatcaacgtgggtaggctgaggatgtatttgctggacagatgtattccactgcccagcaaatgattgagccaaataatgaatgaaaggaccaaataattccttgagtcaaatattcttctctttgttttacattattttaaaacctcatatatatatatttatttatttatttaaaaccgcacatatatatacatacacacaattttatataaatgcataaattggatcatatcataaatgttagggtttttctttttttgcttctcttttcattcttttaattcctccatagaggaattagaactcctgtaggaattaaaattcctgtatgtatctttccatatttttctcaatatacctacatatattataggggtttttggtcactgttttttgttttttgtttttttaaggtgaccatgtgatacacttttctctatttttctttttttcactcaacagggtctcatggaaatccctccaagtcaattgatactgttttaactcctttattagcagctatataatattctgtggtttgcaccctacatgattcaaccattctcttcctgatggcctttactctgttcccaggtttaccactatcacccatgattaaatacgtgtccttgtacatatatcctcatgttcttatttctatgaggcagtgcccgtgaagagagattgctgggtaaatgtatttttaacttaatagatgttgccagattaattttctgatagactataaaatttcatatttctacagtgtatgagagtgccctttttccagcagccctgccaatcataggtatttcggctcttgctttgtttttttttgacaagctgatggataagaagtgaatttgctttttattttgagtggcctttcccggattggccatgagtctgagatcttatctcatgtttatcagccatttagatgcactttcatgtgaattgtccgttgatgttctttgccattttcattttcattcatttattcattctttttcttcttcttccttttgttttgtaatattcttgtaagaactctgaacatttagatattaaccctttttatatcttttcattgtcattcattccttccttctttttcttgttctcttgttggtaattttcttataagaactctgaacatttagatattaactcttttttatatctccattaaaaatgtttttctcaaattcattgctcatgtgttattataaactaattatgttattattaacctttaattatgatatattttgccatgcaaaggtgtctatttttatgcagtcaaatatattaatctttatttttatggcttttggattttctgcctgtgtttagaagattccccttaacccaagattatatttctaatttcctcaatttttcttgaaggttttatattgctattttttttttaacatttgagtttccagtctgtgtggaaatcatgtttatatatgatgtatatgagtggtctaacattttccctttaaatggaaaatcagttgcgccagcaccatttattaaataatctaaccttcccactgaattaagctacaatttttgccatatattaaaattatatatatacacacatatacatatgaaaagagaaaagaatacctagataacctcaagacacatatgtatatgtatatctatttgtttattctcatgttaatgcaattttaatttgattgcagatttttgttgcatattctttaataagaacattttccacttacaattcagtcgtataatacttttcttgatcattttaggcatatattctcattgtgaatttacattcattgtagctaattattccctaatgcctgctgggtttctaattacaatcaatttataaattattttagaaaatattattaaatgtttacatgtcatattcaatgggggatccaaaacattcattttgaaggcccactcacactcacgggaatagattaaatgttgtagtgtgcttttcccatctgtactaagctcaaggctgccattaggacacagcaaaggagaagaaggaaggtcactggaagctagagaactcaccaagtgcaggctctgtccttaggcctttgttcatggtgtcttgccttacacaatagcatcttgatcccagttaggaagcccctaagccttgcagactccagaacccatcaccttgcactctatctgttggaaggctttataaccacatagttttatgtctgcacctaatataaattaagaactctttctaggataggcttgaagatttcataggttgggtgtttgaaaaaggaaatgctgtgtgatgaggacactgtgctctgtggctttcctctgtgctttgggtcacgctcttcctttgccttgagaacctgccacctgccacagttcagcccacccatgtctacttagctccctgttccatgaaaacatccatattccaaaccagactcccatggcccattgctttcactagtagcatttatcacactcgctgttgtgttacagatcattatgccttcttttgccaaacacttaccaggcacctgccttgtgattgttcagagtgccggggatccaatggggaacaggtggtggatttattattctttcccactcaaactttatgcccatgaaccaaatcttgttcccttatattcagagaatccctcacagtgactcatacatagaatatgttcaaccagtgttaggggagtgagtgaatatataataatgattaggtgataggaggaataatttggttgaattatgattttctcatttctgcatcaattagttatcaccttttttccagcttaaaatttttccccatgttttgaatgtgtcacctttgttgctttcttcctaaatgtccatggtcaaattttcaaagtttgccagaatgaatttttcattaaataaataaagattttttagaacccttactgtatgttaggtactacaataagcattagggagaaaataccgatcaaaaatagacccatatgaataagattgccattttacaaaatgaaaactgggtcatttttctccagaaggcatgtaggcacaatattttaaaaatctaagcccacaaaatctgacttataaaacaaataatgatgtcaatcaggagcctaaaatagatttgatatttaatacttatatttaaattgagaagtgggtgaacatgattgaacattctagacttgtggattcagcatttataactagaaaaatatgggaataagtcagaagtaatcagtatccccaatctttgatactgaagaataacactttttaaagagcagtattactacgtaacccatttgctttcatttatattgtaacacaataaatgtttatttttagtttagacgtgtacttttgtcttgctcaatgtacttaccaatcggctagaaacatgggtctagatgaatacttatacattaatttaagcttaattagaaactggcaatctacactgatcagatctacattcatttattcaacaaatatttattgagtatatagtgtgtgccaagttctattctaggttctcaggatacagcaatgagcaaaacaaagatgcctgttcttgtgacacttatattctagttcggggccaatggtggaaacagaaaatagaccatgaacacagtaaagaaattatgtagcatgacagaatgtagcaagtgctgtggaaaaatagtagagtggactaaggggatccaggagtgctggggttgaagggggagaggtcaggcaacatataaaataaattgtattagagaagcacagaattagagagaactatgcccagcctagaactgaagagaaatgtggagatagagaatgctatcagagagattaaaaaaaaaataagtatgggattaacaaacaaaacctataaggaatactagcaataattgtatcattcagcttgaaagaaaagctctgggaagacacgatagtgatttttcaatgttattttattcaatgttatgcccagctgctaaggatgctacctgtagaaatgttcttgattgtaacgtaaacccacactatttaataaacattagctttttacagttgttaataattataattggtctggaatattttatatgctgttacaactatttaataactagtaactagttacaactatttaataaataaatattgccttattcgtagggaaatggattggacatttaaagtccattttagttctatgattccatcatgccttccacaatcacaaaatgcaattaggatctatgaatgcccaagagggatttacttacttatcattaacacaccaacataggaaatgtgcacacacacatacacactcattcctgcaaaagctttgacatttctgacacaagaattgaggttttgtttttatttcctcttttttctattttactataagggaattagatcattggaccaattctttcaaatagttccatggattgagttaattacaatacgtgatccaagtctgtacccactattgagattgtctacaatagaaacagggggcatctaaatccatcaagcattttagctgttggttctttttggtggaaagtagaggcagggtgaacaatctgttactataaatatagtggattgttgcaaggctgtatcctgtttggaaatgatctcatctgtctgttgctggttagcagttttctaccaaactgagcaggaatattaccatatggcattgttgttagagagccctcaaagttaaagccacaaggattcctcattgcccatgaggtagggtttatgagtgagatataattgtcaagggtcttgaatttgaactaaccttaatccacatagggacttgttacaagtttattttattccttaattttgtgcattattccgatcctgggattgttctattggataagctgtgctatgtatgtaattgatgaattatagaaaaagtcaagtttctcccttctttattgatataaaacagatccctttgtaatgaggctgtttgaacatgggcaggtgtgcagtggcatgctctctttcattgcctcctcctctgccccaactcaaataaacaacatactcttaaaccacaagcatctagagtgtgctgtccaatatggcagccatagccccatgtggttaataatcacttaaaatgtcctgaatccaaactcaaatgtgctgtaggtataaaaggcacatcagatttcaaagacttagtactaaaaaaagaatgcaaaatatctcattaataatttttatattgatcacatatttcagatatttggggttaaataaaacattatcattaatcttacttgtgtctttttttgatatggctactataaaatttaaaattgcatacatggctttcattatatctcattatatgaaatgtatttcattatatttctcttgaatagcaccagtctagagtcttaatgggaaagcaaagagacttcccatttccctttctcttaccctgggagagggctttaagacaaagtattgattactttctacagcccagagaaagatgtgtgtgtttgtgtgtatgcacatgtgtatatgtgtatttttgtgtgtgcgcacaggtgtgtgtatgtatgtgtgtgtgttgagggtgggagaagattcagtgggaaggataaggagcatggaaagggaagaaaagtgagcattttcaaccagttggtctgagatgccatctactctcactggaagtaaggaacaaagaatagctgagcacaagttagttcttaaaaggcaaatttgctttttgttttaaaaataggatgaatcagtggaacatcagactcatttgaattcaaatgtaaatgcaaattaagcttccttaacatcagtacagaagcaaatatgaagttttaagaattattatcatcactttatccattgttagcaaggatagtcaagaactgacctgtattccattgtatagtcttgatttatacaaagggtatgatttattttgttctgaagcattttatgaaagaaaaatttctggttgagatagaatcacttaatgaccttacagtttatattcaaataaacacccgaaatagtaaggtagcttttctggataactggatgattttgtatatcacaatgcttttggtaaatggtaaattaaggggtttaggaagaacctactttttcaaataaaaagaaagatataagttaatgatgtaatatttcatagttttgctataatcttttcattgaccatgaaatggcaaatttgaatttttttatttgaatattttcactattttattaggttaattaattagatattccatgtggtaagtccaatggaaataaccatgaaatggactgttatttaggggagtagaaggggaaatgaggaggtcaaagagaccctagacaagcgctgtccaacagaaatataatgaaagacacatgccatttaatatcttccagtagccacattgatgcctttctgcagcccagagaaagatgagtgagagagagagacaggcagacggagagaaagagagaatgtttagcgggaagaaaaggagaaggtagccttgaagacggaactttatgtccctaagttgaactactatcatggaaagcaccaaccaaatgtcaatacaactgacggtactttcagttgatcatagaattacattgtttcatagctgagaaagcagacatgatggtcagccttccacttgaaatgagagattaggcccagagaagcaaagtaactcacctcgagtcacacaggagatgaagcagaagtggaaatagtggccagttttgattctcactagacactgtgctatggcctgaggatacagtgataaatatgacagtccttgtccataaggacattctagtgcagtggggcaccagtccatctgggtgtggcacagatgacatcacctatgacacaggcacacttgtgttgtcccctgaccatgcccagttttggtggcaagcaggggatagtaatattactttcaaggacattcgtgacaaacctcaaaagtgttccaggctgtaaggattttccctccattcctgaaaagcagaacatttgaaggaggcagtggagatctcttctgagtaaaccacaccaaacaatatctttcaggagaagaaaaaagaatgtcctcttcaattgacatcacactggagactgcttggtggactgggtcaggagctgggcttgagctctgcccgtcctaagggagagagaggctcgcttccatgtgagtctctgctcaccgaagttctttacaaacaccttggattggaccccgcgtggtgggactgtggcgcgtgctgggctttggaagctgccagcgctcacgggagctctctgagattctaagaggcaaactgcccaggaccattttgactctggaaaggcaaatatcaaccatggtcataagaggattagttaaaaaaaaaaaaaaagtcgttagatcagcctgtatattcctaaggataattaacagtgtaacatttcataaactttgagccacaagtacaaaatcccccataactcaccttttatttcttatgcattcccttttcatcctcatgttttgcattacttaatcaggatatatatgtaatgtataatctggttctttttaaaatttttttttttaattttttttttttttattatactctaagttttagggtacatgtgcacattgtgcaggttagttacatatgtatacatgtgccatgctggtgcgctgcacccactaacgtgtcatctagcattaggtatatctccaatgctatccctcccccctcccccgaccccaccacagtccccaagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcatttgggtatatacccagtaatgggatggctgggtcaaattgtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgactaggttgtgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagacatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcaatatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccattaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagcctttcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctactttctcttgtaggcatttagtgctataaatttccctctacacactgctttgaatgcgtcccagagattctggtatgtggtgtctttgttctcgttggtttcaaagaacatctttatttttgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgaccctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttaagtctgatgggctttcctttgagggtaacctgacctttctctctggctgcccttaacattttttccttcatttcaactttggtgaatctgacaattatgtgtcttggagttgctcttctcgaggagtgtctttgtggcattctctgtatttcctgaatctgaacgttggcctgccttgctagattggggaagttctcctggataatatcctgcagaatgttttccaacttggttccattctccacatcactttcaggtacactaatcagacgtagatttggtcttttcacatagtcccatatttcttggaggctttgctcatttctttttattcttttttctctaaacttcccttctcgcctcatttcattcatttcatcttccattgctgataccctttcttccagttgatcgcatcagctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccgctgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcgggtgcccctcccccagcctcgctgccgccttgcagtttgatctcagactgctgtgctagcaatcagcgagattccgtgggcgtaggaccctctgagccaggtgtgggatatagtctcgtggtgcgccgtttcttaagctggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgcttacgctgggatctgtagaccggagctgttcctattcggccatcttggctccacattccctttttaaaatttttgtagagacgggggtctcactatgttgcccaagctagtcttgaactcctggcctcaagcaatcctccttggcctcccaaagtattaaaattacaggcatgaaccatcatacttggcctataatctgctttttgcagttaaagttatccccaaactactttttcataatgtcatcataattgttattttaatttgtggaaaagaaaaaaatattattttagtgactgcataatattccattcagtaatcccatcttattttgtttaagcttgttgttagccaagttattaaacaagatgctccttgaactttactgaaaataattgtaaatgcttagcgttttcacaatgaaatcacctatttaccctaagtgtaaagctctgttaaatggatcccttagtgagacaactcatgctgatgatgcacaggatcccaggcctttggccaccccaatgggaaaatgctttcctagtgtcttttagcttaaagcaattattcaaaattggtacacattgtgggctcagataacccagaaattaaagagaactctgttggcggtactggttcttcttgtaataggtcaggaatgtagacattatctttattggtacatgactactgaagttctactttttttaaaacaattatctggtctctaagaggactaaattgtatactgcccctccaaatctaaggagagggccatgaaattagccagtgttctcacctttctgatcagggcagggtgatgggtttgcaggagtatgtggctgccatccctccttcttaggaagaaaatggatcatgggtcagtttaatttcttaggtctttggaaaaaggttacgaataatgaagctgggatgtattgtcctagacaagggtaaactgcagtagttaaaagttttaagtaaggttagctcctttttggagctgaatctgcatgggactagaaatctatattgtgcctattatttttattcttattttccgacctgataaaatgagttatttattcatatgaccttgggcaatgacataaacttcttcgatttcagttttttccattttctaccagaaatgattacatctggcttacctgtctcatgagattgcagtgagaatcaaatgaaatgttgtaaattgtaaaagcctctgacaagttcaaggtagatgctattattaatcattggtaatgatgatgagtagaatattcccagatagcatcatcagacagtgctacactctgtaggtgtgttaggctaggacatgatgagtgatgccaattaatgccagtgatttgttctctcatgtaaagctagccaagttattttactgtctgcctttacttgtagaaagtgtgctctcacagatgttggtaagactaaggtgttctgatttcacaagatgcaggtaatccatagaatcagtcaggaagaatgtccctagtatttttatgtgctacagtgataaattataccaagacccgtttgtcaacagcatttccagaaataagagaaagtgtcatcaaaaatgaaggacaagtcgtgactaaagaagcatcttccctatttgtttgaacagtcaagcttgctttaaatcgtatccaagttgtgtagtaaacttgcctgcagagagtaagccacacagatgcccacaacgtcactgagaggcacgtgacccagtttctgtggtctgagctgaaagataacccgggtgtgtgatggccacacctgcctgtaaaacattatatggtgggcactttttcaaattcacatttttaaagagggaattagatggttttcatttgttttgcttaggttttgtggtgtaatttttttctccagaggtcatctcagcagcatctccataaataattatcaagggattgggagatagttttgcactcactgtcttagaatacaaatcttcccatacaaagccatatagatttgtccagggaagataggaaataattgattgtgtcattgttctcttggcctgactttgctccggtggctatggcacacggggtgatagattaactctttcaggtgtatggaaagcatgttcaatgaatcacaacttcagcacacagagtattttgatggtatttggaaagaagcaaatattctctctttttttttgcgggggggaaagtgtctgatgacaccatccatactttttagaaaagactggagtgtgggtcattttcatatctgtaaggctttgaaaaaaaacttatggtaaagaaacagatcattcatgctagggaaagaaagctatcacagacaagctataatccacatatccactgagtgccagaaaagagaaaatgagatcaatcagggttacatctggggatttacatccagacaatgatgactgcttccgaagggaggaggaaggggttccaccatgggtagagttctagttgtttggaatggcgtcctcatgaacccacctgaagtgttgattccttatccacatattttttgataaagcttcattgtggtactatttttaaccatcactttgactaaatgcgagggttcatttgtgttaagtgggtgagcagttgacagagtagaccttttgtaacctgctaaggagggaacaaggtcatcaagacgctaagcattcaagaaccatggtcttctactatcacctttgcttttgtgtcattttttttttctcaaacgtgatgtgtaaatcaactgcaacagaattacctgaagagcttgtttaaatacagattcctggatccaattccaggtctgttgaatcagaatatctatggcaaaaccaagaatggattttttttttttttttttgagacagagtttcacttttgtcgcccaggctgcaatggcacgatcgtgcaaaggcacaatctcggctcactgcaacctccgcctcccgggttcaagtgattctcctgcctcagcttctagagtagctaggattacaggcgcccgccaccacgcccggctaatttttcatttttagtagagacggggcttcaccatgttggccaggctggtctcaaactcctgaccccaggtaatccgcctgcctcggcctcccaaagtactgggattacaggcgtgagccaccatgcccggccttaccacaagtgattctgatttgagaaccactctcctaatgctgggtagaggagtggttctcaaagtgtgttcctggacctgtagcatcagcatcacctcgggagcttcttagaaatgcaaattcttgggccctgccccagacctattgaatcagaaactctgggagtgggggccagctatctgttttagcaagcctgctaggtgatgttgatgctcaccaaaatctgagaagcactggggtagagtacatcagttcccttcagtatctctttacaacagtagggaaggcaatcgttaagacaatgtgaatcatttgcaacctgggtttgtttgtaaccatgaaatttcaaatttagaagaactttataggagatttaaaccagcaccccttctagtgctggttttctttcttctcctcccacgttccctcctttctttccttctttgaacacttaataagtactatgtactagggagtagggatgcaggggtgaatatgaatggcagcaccctatccttttggagtttacagtcttggggaaagacatatctcacatgattacactaataactgtaacattataactgctgtaagtacagtggtgggaggcacatgatgccatgagactatataatagagatttgagcaaatctgtacacctgttacaaggtaactcagcccagatggagtacttcctttctaggggaaattttgacatcctgttggagcctatttgactttaagataagcccatatgttagaaatttgctccttatattgagtcaaaatctgccacactctaaatgacacaaccctggttctagtatctgaatctccatgaaacgaatccagccctctgttccattgaagatcttcgtatagataaagatctctttcttctaggtttttcctttccaaggctgtgagattcctcattcacttggtcttcttcagaagtactccacttttttctttattttaaaaaatgtttgtaaaatattctggtatccagcatgagctagagccatggaatgatgagctcagaggagcatacctcagaatacatctgtgaccattcttgttcctgttatatttcgcatttatgaggctcaaccttacatgctttgtggacaattgtatcacacccctgactgacttgcactgagcttgcaactaaatgaaaccccagggtttggggttttttttcttcaaacttcgtacctttattcattcaatttattcaccaattttttattcatgcctactatgtatcaggcacatattgtttacttatatggatgtgtttttggacttaagtgcaagattcatttatccgtattgtaccccattttggatcctggttctgtcatccactaaactgtgaggaacttgaagttaaaagccatatttttttcagctttgtatcctcagagcctaactcagtgtctcatatgtagttggtaaagaaaatttaataactataatacacatacacacacacacacacacacactcacactcttttctaagtaattgaacatgttttaaggcaatgccctggagatttccctccaggatgtcaataacctcagccctttacccagcacccatgatttgggtggttttaactatttgattgtgtctatttgcatcatcagccagtctaagtttctttactgtgccaatcaaaatcatgcaagatgttatagttgcctaggtacaggatgtctccgacagccttctaatctaccaatctagtatgtctatctgaaggaaatgaggttagtctgtcttcacttgttctagtagtcaccacttccttttcgctgttgacaaatagtcttttaatatttattgacaagtcaagaattcaagagatggactgcctttagctggacaaggtaggcagtatttttctctgcagccaaaaatttatctcagaacaatgtctttactagaaacaccattcttccatttgtttgagaagtgttttatattctcagggtgagttcttatatttttatactttcaactagaccaacaccactgtaactcatccttgggtccctggatctccatggggtatacatgtattcttgacatattcctcctctccttctgatagggctgtgtccactaatacagatatgatttggtcagtagattaatattttggtattatagtttataaaatataattgagggagctctgataatttactgatttcttctaagtaatggggctggttctcgtaagaattatcatttatgatatggtgataagcatttgcttaggttggtcatgtataaatgtgttttaaaataaaaattaaaacttttattaccatttcattagaatgagcaccattcattgttaattccagggaagttttgttttgctttatttttagtaatgccatatcacaccctatgtggccctcagtctgttcaattgtaaaatgaaagatttggactaagtgatctctaatctatgatcaaactctagaattatattattctaaactttgagaagaaaagtctcttttaaaataaccttaaaattaaatggaacaggccaggctcggtggctcacacctataatcccagcgctttaggaggccaaggcgggtggatcacatgaggtcaggagttcgagaccagcctggccaatatggcaaaaccccgtctatactaaaaaatacaaaaattagctgggcgtggtggtgggcacctgtaatcccagctactcaggagactgaggcaggataatcgcttgaacccgggaggtggaggttgcagtgaaccaagatcgtgccattgcactccagcctgggcaacaagagtgaaactacgtctcaaaaaaaaaaaattaaatggaacaacacacacacacacgcgcgcgtgcacacacacacacacacacaggaatgcatgtaaaactggtgaaatctgaataaaaatgttggactgcagcaatgtcaatttcatggttgtggtatatcgtactatagggttgcaagatgctcccttttgggaaacccgagtgaagggtgtatatagggtatctctatattatttcttataacagcatgtgagaaataagaactaataatttgagataatctcaaatttgagatcttatttgagataatctaaaattatctcaaaataaaaagtttttaaaaattacatgataaactgttataacaggactttagaggtaagtggccattgcttgaccacatgctagcttaaagaaactatttagccttcccaaaactccattttcttgtcttctgtaaagtggggatattaattcctgcctgatgggattgttggaaggattatagagactgtgtgtgtgtaagcatctctcatggtccatactccatggtagggactcagtaagtgttgattaccttcccctgttccccttctttgttctagaaagaaactggggcacacagcctcactgcatctcccataggaaagatgacatctgacctgaagcaaaagacagtttagaagtgtaactcagtgagatgagccccgtagcagcatagtgagtaatgctgttacataactttcacaaatcacccggcagatcagctaacagggcttggcacagtttactgatgaaataaaataacaaggcagcttccaaacccagcctgagtcagggagtcccaacaccacagccagaggcagaatctagaatgactccacaggccttggagctttggtgtttcagttgattcagatgtgttataaatctgtataagtggaaaaaaataaaagcagctcctctctggctggccccatgaataactgtccccaagaggcctagagaagttttcctttccttgcagaatccttaatcatgtctaccaaatatgagttttccatgcagctgcatgaatgaggaagtagagagagactaaagagaatagtgcattcctacacagttcttggtcgtgaggatgtgattgttgaatgaatggccaaaatgtgtctcccctctatctccccaaatgcttatcgtttctcagggctctttcctcactcctgatctggtgaatgtttttgtatcgttgagttggccagaaacatagaaggcaaacttaccaggttttcagatgatactgtggtataagagactcaggggacagaatcacagtttttaaatgatttcagcaggttcggggctctgggccgagcacagtaagttgtaatgtaatagagataatgttaaaaatctgtccttcgaagtcaaaagcagaaatacaggctaggagaggcttatattggcaagagttttatatgaaaaaggtataaggatttataactctagaaagacaggagtcaacagtgtgacgtggttgtattaaaaaagaggttagagatcagaaaaagaaagtatcctttgacttggtataatttgcaccagtcggacaatacctagtctattgtattcagttgtagaggtcaagtttaaggaagatatagataaatttgaatggatcactgagggaaagaaggaaaagggaaggtcaaattaaaaagattcaaaagatacgctgtttaaagaacagttgaagagaaataaggatattcagctgattactgtttttttctcgggttaccatatggaagaagagtaaacttgtctattttgttctgaaagggagaaatgagattaatgggagagagagtccatggaaacagactttggctcaatagaaggaaaatttggagcagttcagtgatggaaagaactattttcattaaattgtgagcttcctgtcactggaaataatcaagccggggccaaaccagtgtctgtctgggattctgaaggatcccaacattgaatgagagcttggggtaggtgacctttaagatcacttccaactctcatagtctattatttaagttagcatgaatgccagggccacttacaacatgccagagccactttttcaacttttggctctgctactgaccagctgtgtgaccttcagctaggaaattaaccatttcttgttccagtttcctcatccattaaatgagagagctgaatgtagtgatgtctaagttactccccagcactctgtctccctaggccttctcataattatagcacgctggaagagtagagtttgggctgatagctgccatttgtttctaagttggcttgccaggagactgcttaaaagccaaaaaccattttgattctgagggccacagaacgaaactctcaatttgcttattggcaggagagtaggtgattgtgaacctggaatttgttcccatgagatctgtggcaggaagttcataaaataactgctaatctggtttctcttgaacacctgtacattctgactgagctcagcaatgccttctcaaacaacttagaataaatgaagcttttatattaccattgcagcacagtgttatcttttacaaagcaaacctttgtcgtttatttgcttaatgatctgtcagttgctattgacctgtgcttataatcttaagaacaaatgtatataaagcaacttacaatgtagcagatttgttctaaaagttttacatatattaatttaacagtttattagctgaaaatacaatgatgaatcagtagattagatcttttttcctttatggaaaggaagtatttaaaatctagtttaagtctgcctgaatggtagagtccagaattcagatccaggccctcattctctgaggcttcgttgttggatgactataatttctcttgtggctcatttgattattaatacttttcttctcttctgtattaagatgcttcacttccaccactattacattggagctctccttctggttccttctttgacttctgtctgacatccacatctccaaatcccatttcttcagttactttttccaaagatctttgaaacacagccatcagtgggagtgtcattgtttgctttgatatagatacagaaggtaatggacaagatttcaagtgtctcctgcagttactgaggtcagtagaggaggaaatatgtaaatttatgcttcttataaggatgtgaagaatttaaaacttcattccctggcttgcagatctggccatactcactgcatccagacacagtaccatattttcttccatctctttgttttcttaggttgaaaatgaaaacagctgttaaaaataagagcacatgagtcaatcttgaatcccaatgtaataattacagtttccatctcagttggtaaagtccctcccagtgtactaagccccatatcacaatccccttgtggagagaacgctgccaatggtattgtcaattttatagcaagactttaatttttgtttttcaaacctctaagattaaacattaaatcacttgccaagccaagaaaaataatgaggaaaaaatacttcgatttaaaaacttgattcttcatatctcaaaataataagagctatttatgacaaacccacagccaatatcatactgaatgggcaaaaactggaagcattccctttgaaaacgggcacaagacagggatgccctctctcaccactcccattcaacatagtgttggaagttctgcccagggcagtcaggcaaaagaaagaaataaaaggtattcaattaggaaaagaggaagtcaaattgtccctgtttgcagatgacatgattgtatatttagaaaaccccattgtctcagccccaaatctccttaagctgataagcaacttcagcaaagtctcaggatacaaaatcaatgtgcaaaaatcacaagcattcctatacaccaataacagacaaacagagagccaaatcgtgagtgaactcccattcacaattgctacaaagagaataaaatgcctaggaatccaacttacaagggatgtgaaggacctctttaaggagaactacaaaccactgctcagtgaaataaaagaggacacaaacaaatggaagaacattccatgctcacagatagaaagaaagaatatcatgaaaatggcctactgcccaaggtaatttatagattcaatgccatctccatcaagctaccaataactttcttcacagaattggaaaaaaactactttaaagttcatatggaaccaaaaacgagcccacattgccaagacaatcctaagcaaaaagaacaaagctggaggcgtcacgctacctgacttcaaactatactacaagggtacagtaatcaaaacagcatggtactggtaccaaaacagagatacagctcaatggaacagaacagaggcctcagaactaacaccacacatctacaaccatctgatctttgacaaacctgacaaaaacaagaaatggggaaaagattccctatttaataaatggtgctgggaaaactggctagccatatgtagaaagctgaaactggatcccctccttacaccttatagaaaaattaattcaagatggattaaagacttaaatgtttgacctaaaaccataaaaaccctggaagaaaacctaggcaatactattcaggacaaagacttcatgactgaaacaccaaaagcaatggcaacaaaagccaaaatagacaaatgggacctaattaaactaaagagcttctgcacaggaaaagaaactaccatcagagtgaacaggcaacctacagaatgggagaaaatttttgcaatctacccatctggcaaagggctaatatccagaatctacaaagaacttaaataaatttacaagaaaaaaaacaaccccatcaaaaagtgggcaaaggacatgaacagacacttctcaagagaagacatttatgcagccaacagacacatgaaaaaatgctcatcatcactggtcatcagagaaacacaaatcacaaccacagtgagataccacctcataccagttagaatggcgatcactaaaaagtcaggaaataacagatgctggagaggatgtggagaaatagggatgcttttacactgttggtgggagtgtaaactagttcaaccattatggaagactgtggtgattcctcaaggatctagaactaggaataccatttgacccagccatcccattactgggtatatacccaaaggattataaatcatgttactgtaaagacacatgcacacatatgtttattgtggcactattcacaatagcaaagacttggaacccacccaaatgtccaccaatgatagactggattaagaaaatgtggcacatatacaccatggaatactatgcagccataaaaaaggatgagttcatgtcctttgcagggacatggatgaagctggaaactgtcattctgagcaaactatcacaaggacagaaaaccaaacactgcatgttctcactcataggtgggaattgaacaatgagaacacttgcacacagggtggggaacatcacacactggggcctgttgtggggtggggggcagggggagggataacattaggagaaatacctaatgtaaataatgagttaatgggtgcagcaaacctgcatggcacatgtatacctatgtaacaaacctgcacattgtgcacatgtaccctagaacttaaagtataatcgaaaaaaaaaaaaagaaaaaattttcaaaaaaccttgattcttgaaacatgctcttttttcaaaatttaatttagattttgaccaaatctctatgttactattggaaatgtcagttactgttccatattcgtttcttttctttttatttatttatctatttatttttttgagacagggtctcactctattgccctggatagggtgcaattgtgcagttatagctcactgcagcctcaaactcctgggttcaagtgatcctcctgcctcagcctcctgaggggctgggactatgggcatgtgccaccgtgctcagctaattttttttgtagacatgtggtctcactatgttgcccaggctcgtcttgaactcctatcatcaagtgatcctccatccttggcctcccaaagtgttggaattacaggtgcgagccaccaccatgcctggccactgttccacattttttaaaatgcagcttcgaatggacttcgtggtatcctcactgtgaatagttttgcttgaactcttgtagaggctaagccttgaattcttttctcttttctcagttcctgaggtttatgatctagtaagccaatctcaaaagagtcatctaccacctattaattgattgttacctttgagagcagattgatccttttttagttctgcttagttccccatatcaactatttagtctcttactgaataatcccactgtctaaagctgtgatggttcctcctcaccccccaaatcagctgcctccaaatcaccaatgtaatgttgccctataaatgtgctattggcaggagagctttgtgccttataggaggagagtcagggaacttggccttttcactcacttcactttgcccttttatttcccctttctaaggcttgattatttattatttgattagattatttctgaagttcatttcctcatgaagatttctataattttgtaatcattgtgtcccccaagagccaattttatgtgctggaaatgaagacactgcatgcctagcatgacttatggaactctgagaaggccgttcagcccagctccctctatacaccttaagttccaccattagatattcattccttgtggtaggatagtacctctcagatatgacaccatttaaaatccagtatgtttagaagggcaaacccgtaaaactagtatgtaagacaatatagcatcatggttagaggcaagctctgaggtcagactacatttcacacctgggctgtgccactcactagctatatgatctaggcaattaattcatctttctgtgcctcagtctcctcatctgtaaaatgaggataattatactctcctcgagggtttttgtgaggtctcaatgaaatctgtaaagtgcttagatgaacattatcctgctttgtaagtgttagcaattattatcttcatttgcataaattggcatgttgtgttgatgcatattgtattgaaagctgataccgagtcacagagaaattgttttgttgggaaactggaaggagatactttgaacacaagaggcactgttaagggacggcctttctgagtaaggtgtcacagctggtagcgtaaaggcgctgggtgcctgtgggtggataggggagcatgtataagagagggtaaaggagacgggcctccttctagtcctaaccactatgctcagtaactgatagaattcatcagctaggacgatgaacaagtagtgtgatgtacacctgcaaattaactttgaattcagtacttgcttaactttctctgtgtcttataatcccatgccttgtcattttcagataatgctaggtctctgagccattacacttgaagagctatggggaaatctagagtgttttatcttgctgaatgccctttcttcttttctttagattacatgaagcagatgacatttgaagcccaagcctttttagaagctgtgcaattcttccgacaggagaagggtcactatggttcctgggaaatgatcactggggatgaaatccaggtaatatggggttcaaaattttggattctctctgtgtttgggtatttgggtgatacgaagtcagggtcattttattaaacaatcaaacagaaaagttgcaagtatggaagatgtggttccaaagaccatctctctcatgtctgcaagcattggtcaggaaactactgggcacctactacaaagaccaccagactgggcatgaaatagggcagccaaaaacatgacaactacagtggaaagagctgcctccactgttttctatgaaaagaattactctttcaaatgacctcgtgcttccagactagaatcaagtgtgagtaccgaggaatagtgcgaagtgcatgacagggctttagctagggtccgcaaacttggacttcagtcatgccaacttatttaacctcttttagtcttagattactcctctggaaaaaataagaataataatgtttaccttgcatcatcgtgacaagtgaagtgcagttggggaagtatttggtacgcagctgtctttattgaattatatgtaaatgaagtaatgaaaaaaacaaattcaaaaagcattagacagttttctatatatttaatttatcttttctagttttctgtgccctgtggtacattataattcctcatgatcctgactagatgccaatcatggcctaagcacttcagtgggcttggtcccagggacagtattataaatctaaggaaactgctttgtgatgtgaccccagcctccatgatgacaccagtcacatggctgcttcacccaagaagaggaggctgggtacgggcatatttacataaagtaacacggtatttaagaatgctatttttttttttttgagaggagtctcgctctgtggcccaggctggagtacagtggcgcaatctcagctcactgcaacctccgcctccttagttcaagcgattcttctgcctcagcctcccgagtagctgggactacagatgcatgccaccactcctgctaacttttgtatttttagtagagatggggtttcaccatgttggccaggctagtctcaaactcctgacctcgtgattccccctgcctcgggctcccaaagtgctgggattataggcatgagccaccacgcctggccccactattttttttttccacatctcctagggtacctcttttgggagctagtgaaattcattattagagaacaatatttggaggatgctgaatggtgccttgcctctgtgtggtcattaaacagctaatgctgaaaactcatgagggagctcttctttattgtttcaccatatgaaaacatgtgtttaccatcagaatcttctctttctctctctctctttttttttctgtctggtagattctaaactcatctatttcccaacctgagacttgcttctttcagaattttaaacaagtcttggtttctgatattttggggaagcacagccattcataagtgtgagagaactaaatagttatgtacttatgccattaagaaaaacaaaagtgtcagaaggggaggctgaagcacttgacactggctggcctgccatgtaagccaacatagttaatagatagatgagtagtcaaatgcttttgtgtgatacttgacaatgttcgaaacctaatggtgtttgtcttgccaatcttatgagatgggtaaggcagttattgttatttcaattttgtaaatgagaaaactgagggaagcatataacagctaagtgacttgcctagtctcattcattcaactactatttactgagcactgactctatgccgggcaatgtgctgggggctagtgacccagagatggacaagacagaatggtcctggccctgtggagctgatagtttcagagttacatgctaagtggacaaatgcaaaggcaatgatggcttctgatcctggccgagtgaaagaccaacaccaaccatgggaatatactaagttacacatttattttttaatagctccttgagttcagctatgccacttgcttcacttttttctttcacttggaaactaatgtgaacttacattcctccatgatgccattgaaaatagatatttaggccaggcgcagtggctcacgcttgtaatcttagcactttgggaggccaaggcgggcagatcacaagaccaggagttcgagaccagcctggccaacacagtgaaaccctgtctctactaaaaatagaaaaaaattagctgggcatggtggcggtcctgtaatcccagctgcttgggaggctgaggcaaggagaattgcttaaacctgggaggcggaggttgcagtgagccaagatcatgccaccctactccagcccaggtgacagtatgaaactccatctcaaaaaaaaaaaaaaaaaaaagaatatatgtatttaataaatcctttctgggagttgagtttgagtttgttttggcttcaggctgattatgtgctaagtggtgtaagttggaagagagagaaatgactcgtcccttgccatcatggtgaggcgagacacacatagaaaacatgcagaagacaaggcacatatgtgtgtggggtatatgtatatgggtctctatatagatggagattgtaaagcatttgtgcaagtggtcatagtaagctcctagttttgcaggataaaaaacattttaagtgggaaagcaaaacaaaacaaaaaaagcagaaaagagatcagaaatcactggaggtatcaagtgtcccactaagaagtttcacaggggctgggtgtggtggctcatacctgtaatcttagcactttggaaggccaagttgggaggactgcttgaatccgggagttcgagattagcctgggcaacatagcaagaccctatctcttcaaaaagttttgtacaaattagctgggaacagtggtatgtgcaggtagtcccagctatttgggaaaccaagacagtaggatcatttgagcccatgaggtcaaggatgcagtgagctgtgattgtgccactacactgggcaacagagagaccctgtctcaaaaaaaaaaaaaatggttttgcttctctcagaatttaagtgttttggtaaaataacagactaataaaatgtgaatgctggaggggcatttcaggattatttgtccagcaccctacaggtaagagaaagaacattcagagcagttggctgaagtcagaaaactagtctgttacagaaatgcattttaaaccggcttggagaagctggtaaaaggaaatggcctctaaagcttactgtgtgaggccaggtaaggattatagttcccctcagactctaagacatggtgcataacagtaaagcagtgtctaccctaagactcatagaaaaaagaggccaggggcccggagaagctaccaagtggttaaagaaaatggcatagcataactgagtttgagaaaatgacatcttttgtttaaagtgctgggtttatttgcattttttcttcctgtctgctaagaccttaatcttaaccctgtcctgaacccctctaccctaggggcctgcattcagacttccagccttgctccattaccttcatagtaatgactcacacagcaagaatggaaggccctcatagcgatggttattttaggcaagtgctcaggcaaagcaactatctcagaataacttgcctggcagactgttaaggtgaaaatatttgtatgccagtaaaaacatcaacatattttctacttgtcaatataaatatatcaaatgagatcatgagggaaagggctttgcaactgtaaagtatctctagctatgtgatatatttattatttgcttttaaaataccaagatgggctagagaacagctcataattcccacagaacagtttcaagacggaaaaaaaaaaaaaaaacaaaaaacaaaactacccgcatttttaggccttgtccacgtgctccagagttgtcttttgctgaaagatcttaagtgtgactccttttgactggattttttcacccacggccactcagtaatgcaaggggcctggaccagcagcctggtgagactgcggggcctgcttcaggaaggagggtggtctctctggaccccacaccttcctgacagctcagcatctgaaaggaagcactgtggtgtggccttcaaggggcgatcccgggtttgttggttttgatcaacctagtgacatgcttagtttcttgtaggagtgatagaatttttaaatctccaagtcctagcagttaagtatacaaaacactgcccttgccaacaccccccattaaaaaaaaaaaaaactgaagtatttttaggtcacttatgttaaaattcagtggatactgttctgaggggaagaggctagggaattccttcattattacaatttatttattagattagctactttctctagaaaagcccaagaccttaagactctgcttgtggaaggcagaccatggtagggaatgccagagtgggctctggggaggtgacaggcagcactcgatcagggcagggtggggctgaaagtcggaggatgaggatggtggttgggatgcgatgcacttgagcttcagcacccacaggctctgctgccctgtggctattccctgagccccactcccccactgtattagtccgttttcatgctgctgataaagacataaccgagactgggtaatttataaagaaaaagggttttaatggactctcagttccatgttactggtgaggcctcacaatcatggaggaaggtgaaaggcgcatcttacatggcagcagacaagagagaatgagagccaaatgaaaggggaaaccccttataaaatcatcagatctggtgagacttattcactaccactagaacagtatgggggaaacagcccctaggattcaattatctcccaccaggtcccccacacaacacatgggaattataggagctacaattcaagatgagatttaggtggggacacagccaaaccatatcacccccccgccactcgtaacccactcccaccctctctttttcctcgcagacatatttcctttaattccctaagttgtaacatagagccaaatttcttggaacattgtgtgggaaagactaaacaaaactataagcccacccaaatggaacattatttttctttggcctttatatatagcattttcatattttcaaacccatttcacacttatgctaaaattctgaccagtctctgcaaaaggatgaattgggacaattcttatgacccttgagtttcataatgtcaacccactgattttaaattctggcattggtctctcttcctcttggctcactcttcccataccacactttcggcagatgtgttccaaacaagaacttatcccattgagcagggtgggctggtggattattaattacccactgaatctattaggttggtgcaaaagtaattgcggttcttgccattactttcaataattgttggacctgctaatttccatggagttttgtgcatgttaggttactcttaaacaccacagaaaatggtgattcatctcttgactgcccccagagaaggctgaagaaaggtcaaaaacatccccaccagtgaattaccagggctagtggaaactctgtccccatcataacttttgtcacgccaggcagatccacttggcagatgacaggagccccacttgctgcccagagctaagcaccttctctgccagcaacccacaggcacagtgggactggatagctcgtccacctccaccctgagagtgtttctatttgcttcagtgaaagcgttacaccttgctgcgacagagccctgattaaaggcaagatcaaatgagctcacgggcatttccactagtgaccagtgacctcagagcaaatcttccttaattcccaaagcataatttgaatttttatgagaagtgaaaggaggaggtcagttattttggacaaatattatttcaaactcatagaacagatgtttcaagtgattccctacttttctgcctgcttcccttcctaaaactgtgcttccccttttgtaaatcttagtgtgcagcctatgattgcaagctgagctgtgggccttgaaagactcgtggtgaaagtgaatctgaacagcaaagctgctgcaattcaggagcaggggtaaagaaggaagggccagtagcatgagtggatgtgtagaatactgctcagattcacaagaaatagtttaattgagccaagcaaaattttaggagtgatgtgggaacacattttttaaaaacacttgaaaaatttagacactccctcccatattctttttttattttttcctttttctttgtttcagtcccattaattatctcataccctcccataaatgttccaaatatttgtttgttccaaaatattggttattgccttctttttcctttttcaaactgtatccagtcttattaaagatgctttttgtaagcaatcatcgtatattagacaggccatgagcagacaattgctaacagtatacaacaacttccaaactctcttcttcaatgaaccaaaatcagacagctgtataaaacccagtgaaatcttcatttgcttagactctcgattgcagtgagggttgacatttcacatgtagcatgttgtttaacaacttttcatgagccaatcttgactttcaggaaatgaaatgaaaatggcagaatcatcagtctggagatccacaatctaaaaaaggaactgctgttgttttgagagctgccctctcaataggggtcactggaaggtccagatggccacctgactgctaattaattttaggtgtcaggtcccaacaggtctctgggtttaaggaagttgagaccatactaaaggcagagagggagaagaagaaataatgaattttagttttcccacaccataaggtgtttgtgccaaggtagctatgtgtgtcaatgccaggaatccccctcctgggagccaagaggaagtttctcaaaactggaagaaaaggtgtttccccacattaatccagcttcggagacattctattagtgacatatgccccttccccccgaaaaaatgaaatgttctgtgtaataataacatagctttaagaaaagtaagacaacattctacatttttataaaactccatttaaaaaaaaatagtatttccaattgtatggttaccagaagtacacagttatcaaaaacgcacacacttcccctggcatctccagcatcgtcagctttctgtgcctggtctgttctggcatctccattttctgcaggattatttccctctttgccagtgccagcctttcccttttttccttctgcgtaccttctcttccttcttagcaggggccttttggggcttgggttctggctgtggagaagcaggtcaagcagacaaccttgctgatcttctctgtggtttatccttcaatgtggctgtatctcttggagcatcccctcagactttctccagtgctggatgaaggcactgcatggtgggatgcagtggtacctgggctctggtcggtctagacgtcattctcacttcttcacactgctcctcccttcgtttactaaacattaaagaggatgacaatggggcttgggggacagtggggacgaagagcatggagatactttgataccttgatcatgaagggcttaggaggaatgatagtcccaggggacacagactaagatgcaagccaccaaaaccaagccttgcaattccttcacaattttgctgaagatgtccttatccattattgaactctttcattttactgtatgccctaagttcttctagtttgaatatgtgaagttcgaatttggggaatttgttatttacattgggaaaacaacaaggtgagaatatcagcagatgttactgttccttgcggatgtttaagaatgttcagcctctaagattgtcttagttgagatttctgtggcctctgtagtaggttaaactattaacctactacagagttcatctggtccgggacagggacagccaatcaggacatttttagttggcctgatgctcagatgtagccatcaccgactgaccgactctgggctgtcttctgctgcgcagatcctgagtaacctggtgatggaggagctcctgcccactcttcagacagacctgctgcctaagatgaaggggaagaagaatgacagaaagaggacgtggcttggtgtaagcaatggttttgctctacaactgagctactcaaaatgggaacattctcttcccttttcttttagggcatttgttgttgttgttgatattcccttccctgggtgtagaaatgcctacttcgaacctgctgagtctcacttacaagaagactgttccaaacagactccaactttgaaagaaaaattacaatgtgtgtgcagttctgtttgttatgatggcctgtgatgaaggctcctccctccacttgactccatcagtgcttacacgtgacagagccctgatttatgtgttattccttgttgcagctcctcgaggaggcctacaccctggttcagcatcaagtttcagaaggattaagtgccttgaaggaggaatgcagagctctgacaaagggcctggaaggaacgatccgttctgacatggatcagattgtgaactcaaagaactatttaattggaaagatcaaaggtcagtagagataatccatgctcttactaattaaataagctgtacatgcagggatccaccacatagcaggaatgcatggtttcagaggataattacacttaagaaattgggaggaggtgatcacagctgcaacaggaacatgctggaggtaccattaggggcctgggccttcccgtggaagcttcatggacacaaggcagaggaaagtttgtttcttgcctttggcagtgcctgtgtatttgatactgcctgcacccccaacccccattgtagcacccttgacactgaattagactggcttctgctccacctcctctctgccgtaagctctcaaagagcagagccatgtcaccctggtttactcaagtacacccagggcctggtgtcacgcctggcatatacagactcagcaaatattcaaatcaattaatatatggattttcctctaacatgaaagcccaaaattttggcttggagtcatacccagtcaccctacaaacccaataaatgtaggtttgtagccccaactccaatattaggcagtccatgcataattggggaggtcactcaccttctgtttagctcagtgtcctcctctgaaattaggaggacccacaggagtgggattggcaaactgaagcccttgagccatattgggccaccacctgtttttgtaaataatgttttcttggcacacagccaggcacattcatttatgtattgtctgtggctgcttttgtgctacaacagaagtgaatagttggaactgagaccttacggaccacaaaggcacaaatatttactatttggtcctttacagaaaacagtttgcctattcccatacaagagaccttagatggcctctaaggaatcctacagaatgaaattctatggttctccattctatctggggcctctacaacccaacaaacacacccgtacctagtgacctagtgtcacttcagaggagaagcttgcaggctcatctgtgattgtttattgacagtcttcctagaaagttctcagattattccctcactcactcattcattcattagaaactgtggactaagtgctttccaagcgagacaatggagctttagcagtgaccgaggaacaccctattcctgtgctcaggaggcttagagtctcggggctgtcggctttgtggattagcctctgcagttcaggccccctttccactgcagcccagcttgcttcagggttcttagcacaggtcctgctgagaggaggtttgaggaggcacagctccagcactggtgtgtgtgtctgtgtatctctgggtgtctatttacgccatcctttccaaagccagctctacattaacctcagagtatttgatgttttctactatctgtgtctcttattcctccattagtacaactaatctagagttgactatatattgaaatactttgtactacttaaaactaccagtgctcaacttctgtgccaaaatttctgctatctggagctaagttgggcctaactgtagccgttctcatggctgaaactaaattgtcatcctttgcttaaatctctgtggctccggtgtatccacatatgatggaaaaagattttgccctgaattagtatttatttcctaaaagaagccgtaaaaggaagtaatgatcaagtctttttaaaatggaatatcagtgttacagctcttttagaatttgtctagcaggctttccagtttttgctggaaagcccaaaaaatgaaaaataaataaaatgaaatatcagaaacacattttaactaggcatccagtgctccacctttaaaacaaggaagtgcgctttcggctgcattaataaagggctttgtatttctaaaaaaaaacctggggagtattaaatggtgatctgtctatttcctcccatatgactcttgggagtaaagcccctgagctttagttctgctgcacaattatttattcattcaataagtatttattctacttctgctgagtacaatggctggaatgactcaaagaagacaacgtgattttacaaggagaggaggatacaaagcatgtcacagatgctgagacagaaggaaaaacatcttcctaccagcggtagaacaaagagcacagtggttcccaatgtgagcatagatcccatttcaacctcaagaagctatgtgggcccctcataatgagagcacaggtctagtgtcgggggactggaaaaaacgataatgccaacaggtacaataagagctaacagttactgagttcttccaaggggccacttccagagttgtaagcacttgtaatatagtaaactcatttaatcctcaccataattgcttttatgatctccattttacagatgataatactgaggcagaaattcggtaacttgctgagattccagagctagttgtggtagagtcgggctccaaacccaggccctctggccctcgcctttcaggcatcatcgctctgttcagctccttccttcacttcagtaaggcttatgaattaatgtatcaaacacatatgcatcacagcggcatctctgcatgcttgaaaaatagcagtgcatacacgaatgggacatggaacttatccagcccataaggaaacacctgcagaccccagctcaggaagctgtgtgggagttccaggacattagggtgaaatttgaactgggccttgaagagaggagtaggatgtttatgagcagaggtagaggaaggaaggcaaggtaaaggaacattgaataaaggtgcagagagggggcggaagcacattgtggtaagtaggcacagagggagagtgggcagagaggaatataccctcccacggccctcctgtgcctatcttggccccacccagatctgccatctgctgctagatctttattgcatattacccatgttcagcattgttctgaaatttccattagatgcttttcaaatacttcctctctttaaagttaattaactaataattaatttatctcctgacaaacagttttacactttagtgtcaagcaagtcatttttagaagactcttagattgtgtcatatttggatcatacaattgaaagggttttttcttaataattctatgacttgtgtaatattttacatcccaaatatttctgagtgatttgtaatattaataatattagtcattttggattatcagaataagaggccatgatctggtcctgcacaactctgtgaaatatttccgccagttgaaataagaacgaggccattcatctcactgtaagcaaattcccaagaagaacttaagaaagacacttgaatgttagccctgctcctgaaaattagggtctgatgtttgtccagtcatcaaacatctccaggcctcatttttttcatctgtaaagtggagagattggataccagctccacttgtgcttctgttctcagttctgtgattctatgacaaggctctgtgacctgcctcaatccacaaggctagccttctagtccacggagcaagctcaggcttcttctagctccggcctccttcactccattgcgtcttcctagctgatcatgagagttacctctgctctgaaaacaatgcaggtttccatgtcctacccagactgcaccaggagcttcactgtgctctccctcttctaaatcaaagaggagtactttcctctggggagtggaattatagtggcattttttcattcttcttcgtgatcaaaatgtattctacatttttgtcactaagcatgtcatcttggtcagaaaaacctattgtgattttgttttgtcttgttttaatcagggatggggacaggaggtagggtggcaaactgaatggaatttggttccattggcccaagaaaagaatgtactggagttcttaaaaagtattttggtggggagaggaggatggaattatactgagtgattaactcctagagaaatgaattaaaacaataaattgtgtttttagaagacaaactgtgcatatttaatgatagtgattgacagtagataggtggatcaccagccttttcttcttcatatgaagagttgcatgttcagagggaccaagcagaaaaatgcattttatcccagggcagaggaaagcttggggagtggataggtttggtccagttctgaaagggtccagtggttttcctttcttgtgaccatgggcaccaggctcattgtgctagtctgtcatggcctcttgagcttgccttggctgttaaatggctccgtggggcaccattcagctctggtctggctccagtgcccacaaacccagttttgccatatgtcacggttttttggctatttcctacctcagcgatggtggcccagccggcggagaaaagctgcttggagagtgtgcagccattcctggcatccatcctggaggagctcatgggaccagtgagctcgggattcagtgaagtacgtgtactctttgagaaagaggtgaatgaagtcagccagaacttccagaccaccaaagacagtgtccagctaaaggaggtaggatacaaagctgaggagctgggtgtgaatggtctgcctggctgtgttttccatggggctttatctgccatttctccctcccttcctcccttctttccttccttccattcttctgcccttccctccattcatccagcctttcttccgttcattcagacccaccattcatctgtctattcatccatccacccatctgatagttttactgatggttttcaagttagaaaaataataacctgtgtgtacaagtgaagcaacatactcaaatatattaaaggcaaacttagtcaccatcactgatacccactaatcctagtccaccccagactcctaggctacccccattccaaactccttgaattaactaatagaaatagcttggtatatatttttcctatagtttttatttattcatacaagtatatatcctcatttgtagaacattgttggtttgttttcaaaaatatagacttatgatatgaaatttgattaaaaaaaaaacttcagccaaattaaatctaaaggagtttaattgagcaacaaaccatttgtgaatcgggcagcccctagaatcacaacagattcacagacactccaggggtgcctcacggtcagaacaaatttatagacaaaaaagatcaagtgacatacaggaattggaagtgaggtacagaaacagtgaaattggttacagctcggcatttgccttatttgaacgcagtttgaacattcagcagtctatgagtggttgaagtatggccgctgggattggccaaaactcaactattgttataggtgcatactactaagttaggttttcaattttgtctgactattaagctaggttacagttcatccacaaggacttatatatataagaaaggagtccttcttaggccatagttagtttgcattaacaattcccccctttttgcaaaggatatgaacagccacttctcaaaagaagacatttatgtagccaacagacacatgaaataatgctcatcaacactggtcatcagataaatgcaaatcaaaaccacagtgagatatcacctcatgccagttagaatggcaatcattaaaaagtcaagaaacaacagatgctggagaggatgtgaagaaataggaatgcttttacactgtcggcgggagtgtaaacttgttcaaccattgtggaagacagtgtggcgattcctcagggatctagaactagaaataccatttgacccagccatcccattactgggtatatacccaaaggattataaatcatgctactataaagacacatgcacacatatgttaattgcggcactattcacaatagcaaagacttggaaccaacccaaatgtccatcaatgatagactggattaagaaaatgtggcatgtacaccatggaatactatgcagccataaaaaaggatgagttcatgtcctttgcagggacatggatgaagctggaaaccatcattttcagccaactatcacaaggacagaaaaccaaacactgcatgttctcactcataggtgggaattgaacaatgagaacacgtggacatggcagggaacatcacacatggggtcctgttgcagggtgaggggcaggtggagggatagcattaggagaaatacctaatgtaaatgacaacttgatggatgcagcagaccaacatggcacatgtatacctatgtaacaaacctgcacgttgtgcacatttaccctagaacttaaagtataataaaaataaaataataataataataataattccccccttttggtcattttctcaattttgagaaaatgaccaaaaccttagtcattgatgttactagcactattgtaaatgtacttatatggttttgaaacccactgggaaacagtagaacagtgggttttgcaaggagggaataaggactgagtagagagtaccttcttatgctggaacatcctatttacaggagaaaaacaaaacctggtatgttctaggatctatgtgttttcttaaagccctagcttgattatgtcacatttagcataagtggctctattttagcttggtttggtttgttggggcctagtgcatgagcttagtcccaaataatggcctcccatttaaaattttgtttaaaaataattccccctcttgggccaggttttcacttaggtgagagtgtgaccaaaacttagggccttagtgccactttcagttaccatcattttgggtttctggtctcagcatgtcattcatataggttatggagtcctcatggtcacatgtttctttcagcttttgtcatttcagttgaagggggaccatttgacatcctagagatggctacatgcaaacatttaaaacctttgagagaatacagcacaccaggaagactattattatgactattgggaggataatatcaagagtttggagtatgctccttacccagggtccccataaaccaaatcacctaaaattaaatagattaaagaatgagctagatgaagagtctactcgcttgactaagtggtcttttcattaatcccctacagctggatttttataatctacatatgatgtatttctccataggccacaagtgtcagcagctgcataggtacttttctgtttagccaattttattatttagcataactttcacaagagaatttaaagtatgttgtgtaacgacagcctttaaagtagaatttactgtagggcctattatgagggagacatttctaattattgccttttagtctaaaccatggaaaaaggacctaacaaatgatgtccttctagaagagtgaaggcctcctggcagtgttctctttaatccatgatgcggattaagaagagttttgactgattatgaggcaacgtgtgtaccactaaagtttctcacctacactgggccttcattttttatctattaaagtataaggctattcatgtataaggctggctgcaaaatccttcacaaataaaattataccctataagtgcacataatagacctccttttcatttatactgctcatagaggcatacacaaggaaaaaatattcaaagatcagagtcttgtgatagcagaagtcttgatccatgatcttgggaaaaactgttcacatcaaggatgtcatcttcttctggggagaaactgtcctggttagattagcttaaggggtccaatgggtgtacagttccaggagtgtgaaggaacccttctcagttgtgagattatggacccaaagttcaagtctccaaagttttgctgtagtgtggagggcaatgacagtctttctctgatgttttcagaagatctaatcttcaggttctagattatgaagggattgtcctcagtgaaccataaaaagctttctttacctggggaaaatacattgtagcataataatctactgttataacatcagccctcttgcatgggaaagcttttatacaactagaaaacatgcattgaaaatgacaattgaatgaaatccctttataaatgtttaaatggcccatcagatagccaaatgtacctgacgctttaattttttccccaggaatatggaagtgaatattggttctaaactgtttccacaatttataagtcaccatatcaatatattcaatttggattattttatcttttccatgatgagtcatggaatgcagaacctttaataacaaaagcttaaggattcaggaaggacaaggtggctgtcctagttcttcatgagtccatgcttaacactggacttacgtcctcttgaataccagttgtttctccaatttaggtgcacagcactgataactaatggtttatcataggtaatttgacttagaccatggagttcattcaaattgtatatttaaacaatttcagtattggctgatttagcatgataatctagagcttggttttgaaaggtttgtcaaataccacaggtttaaaacattggatattacaaaatagaatcttaggttaccataagtcattcatttagccaaaatgatgatacaaaaatttttaaaaggatgaaacatgactctgatggagaggggaacagctttccaaataagacccaatgaatgtagcatgaggccaactgactgtctccttgccttcccttttgtagtttacttaaaaggtaaacaaaaacctttcattatcttttaatattatataaaaatcatttttaaaagagaaaaccaaattttatgtttccattagtgtatttttaatgttaaagctagtttttaatatttcataaatatattcagttttaattactttgaccataaggtaagatttttataaaccttttataactcattagaattttttttctcagaacagaacaatgttccaagaaaactttgttatgcttttattcccatgtccaatttagggaaaaagcaataatgccattttatttagccaatatattcacacatagaatctcttacagttaattttttataaaccttccacaacctgttcaaacctttagctttgtataatttaaaacaatcctttaaccctctaacctaggcaaaaatttacatttccatatgttcttataatctcttacaaaaaatacatttaattctccttacataccttgcatgtaaacctatttttttcagtaggctcaattacatattacagtgttaactcatagcaacttttacttttggtaaaaaccttggtgagtaagggattttaattatgtactaggtgtggagcctaggacccagatagaaatgcagataaggtatgacttattccagcatcgaactccatgtgtcccaggccttagctagctgtaaagccagcaagctgtacagtgaaaagtcatagtggcagcttatgaagcaccttcaaattatacaacatttctggcataaattccttttaataaattatttcacaacttacacagaccatgtacgacatgtttagactttctgacttgcttaaacatccctctttttaaacaaccagtcattttactttaggacaataatttaccatacaacatcctctcttatataaaatctcttttctttataaccttctttatatagctagggggcatggttaattccatatatccccaggccttatttagaatttaatgtctccaaaataaattgaacaattttcaaaagtcaaagcagttagcaaacctattatctgacctgcataatttagacaaaatgtctttattttaacaataatttttaaagctgttttcatttcccaaaaattactgaagttaatgaactaaaaggtattatagtttttattttgctttcaaaatatttgatgtaagtgcttatttttgtttaagccaattagagttcttttatataaacattacacacaacacatatataattacatagacagacagacagaagaacattacacagtagttgtaagatttttcatttgctagatttttaatttcttaattggttattggctttatggtggagtccttggaagaacagggccaggaaaggggtctctggtgcctccagactgttagagcttgatattcacttttaattaagtggacttttaatcatagcactctttaataaagtatttttaaaatttcttattaaccaattttagccaggccaaatgactgatgtttctggcttttgaactttaccaaagtaggtaatctcccagatgctcagagaaaggaaaatttaagatagtccatggaggagaagagactagacagggtcatgcagatattcaaccagaaagaacttgcttcctaagcagggaattgcacctggaccaccagtgtgaaagggcaaaaccttagctactgagctacagcatggagcaatctctactgcccttcccagaaggcatctagagtagttaactttgagtttgcaaaggctttaactactcaagataatttttagagctaactatgacataaactctaaaattccattccctggaaggcagagaccaagagaaagtactgctatgtggttacaaagtcaagctcccaaggacataaaacaagatggagataagcagtgatttttaccattcattcgactgtttttatatatagagagaagccagaaatctgactggtaagaaattcttaccttttggccggcatgccaggctctgggctccctttccctgagtggctctagtgacccagcttgctgcaccatcctgctgggggccaagccacgtcataaaggaaaattattatttttttcattctggctagagcaaaatatgtatgataaaacatatacattagccactctgcttagcacccaatatcaaactggcaaagcttaaatttgccctcagatggccctcctcatctttaatcaaacctccgactaggagtttcaacttgtggtctctgggcaagatggttgccctgagtaacagaaaagataggaaaggaaaataagatgaaggaaagtattgcctgtgggagggtgcataaggtgaagagctcagggaggccagagcaagacccattcatttcagcgacactgaaaagttctgatggccactagttagtagcgaaaggatcttttccagcagtctcatcagctctcaggtttctcccttttccgggagggaggaaaaagctccccatgtcccacaatcctgtacatgcctaatcctgtcacccacagccatcagcaaagagtgcaagtcagattattccaaagggaatagcagttgacatcctgtagtgccaaaaccgttcctagccaaaagggactttactgagagccctcattttaaaaatgtacttcaatgcagccgggcgcagtggctcaggcctgtaatcctggcactttgggaggccgaggcgggcggatcgtgaggtcgggaaatcgagaccatcctggctaacatggtgaaaccctgtctctactaaaaataccaaaaattagccgggcgtggtggcggggtgcctgtagtcccagctgaggcaagagaatggcatgaacccaggaggtggaactttcagtgagccaagatcgcgcctgcactctagttgggagacagagtgagactccgtctcaaaaaaaaaaacaaaaaaaaaaaggaagaaagtacctcaatgcattgttgttctttcggaacattccactgtaaattatcttcagtaagattttgctgtttctgtaagacttcactgcctcccaggcctaatgtataagccagaaggaactcagttttccagaaattaaggagcccattttaacctaaaatattggctttactcccaggttctcttaacttagccaatgatttttcctacctaagcacacaagaaaaatgaaaaaaggggtagaacacagaaatccctgtgaattttcaaaagccaaattttataacccctgcaatattactgcttactaccagttcctttctgacccagtcagatatacgaggcctctgactgggtccaagccagttaattcctggatcaaatctgttcctggacccagtccagtttctgtcatgactacaaacccagtttggatcagaaacttgctcgaagaaactcagagagctcaaaacacaaatctatggagcttcaaattccgagagggagcttaccgcgatccccagccgctctgagagatcaatggacacaggtgggacctgcaggtaccttgtgtgttcactcagcgctcctgggagtcactagaagctccacttcggatcctgcttctgacaccatctgataaaagaaaaacttcagccaaattaaatttaaaggagtttacctgagcaatgaatgattcgcaaatcgggcagtccctagaatcacagcagattcacaaattctccgggggtgcctcacagtcagaataaatttacagacaaaaaaggtaaggtgacgtacaggaatcagaagtgaggaacagaaatagtgagactggttacaactcagcatttgccttatttgaacatttagcagtctatgagtagttgaagtatggctgctgggactggtcaacactcagttattgttacaggtgcatactactaagttaggttttcaattttatctgactcttacagttcatccacaaggactaaaatatggaagtatggagtccttctcaggctgtatttagtttgctttaacagatcaatatttctgaaagtatggtccccagaccagcagtgtcatcatcacctggttgttaaaaatgcaaattctcgggccccaccaatgatctactaaatcagaaaatctaggggtagtgcccaggagtctgttttaacaagacctccagaggttctggtgtaccctacagtttaagaatcactgaaaaagatataaattggcagcttggttttatacttgacatatcatgatgaacatccttacaagtcagtagataaaaccagatgtctctatttcttttcctttattctttatgcatatatacacatatataattgtgcattaacaggatcattttagaaatgttttggggtttcttattgcagcctgttttgttttacttgtcttcactcttccccttccccaatgccacctcctcccctcaagcaactcgtgttaacaacttagcatatgccattctgtattttccccattcttatctagcacataaaacacacccttagaggctagactttagattgtctgctttaagaaaaatgggattatattttatacattactctgcttatcagtttctcttccaaaaataccccatgaaactgtttccaaggtaactgttttagctctaaatctttctttgtaatggctgcatgatgtttcatgtatggatacaccatgatttattcattcatctcaatattgctggcattatgaataaagcataataaattaatatttttatgtatacacatatatatgtatatatatatacacacacacatatatatgtgtatatatatatacacacacacatatatatgtgtatatatatatatacacacacatataccctgatgtatttatttctatagtatattctcctaagacaagatagccaggttgaaagtacatttctcatgttaaaaaatgtttccattgcatttcaaaaaaaaggatttaaattttacatttccactaattgtgtatgataagggctttctcccccatactgctatcagctataggtgttatcatttgattaaacttttgccaatctgataggagcaaagtgggaacccatttttcctcttctgtctgcttaattgatattttttaaaaatagacacattccatttggtgaggagctgcaagttccacagcatgcttttgatccttacttcacttcagtggacctctccataactcacttcataaagggagcagtattttccctttaaagcataatgagagtgggccctcttaaaattcctgtttagagaaatctagaaatctagattatctcttctgcgtgagctgaaagtcggacagtgcatcttatattattcatatgtaacctgcctcactccccagttctctctagagcctccattttcagaacctttctttctgccttcttctgctccacccattcccctgtttattttaaacctccagtatttcctttaaaaaatgattttaaactaagcttggaaaacagaatgcattctgttgcaacaacatttgttgataacactttagggctttagcaggtgaggtatgatgctggaagcccaatggcctcattgactgagtgcaaactagagtaggagggaccccagttcttcaaactggatacctctcccagtacagggctctgcctatccacttcccatccactagcacctaaagcaacctatagcagagagaagccctgtgggccctggcagatcctcatagaattgtgaggaactctggcttcccttccaaagtccaggagtccagggagcatcctgacctccctggcgttttttgagaggagtgtcactcactaaagaagattttggaagcctgggggcccagcagcaaccacgtatcagagcctacctgtctggttcttgagctctggaagtgggagattagagtccatcaacagcttacaaagactggagtccccgtgggtgcaccgctgggtcttcctctcatccagttggtgtttctgctggtttctgtcctagcattacagctaccctaggaacccactgcaggaggaaaataagacagttgaaggtgtcacagatgtagggatccaagtagtgattcactttaacaacttgcatttgattgcttagaatgtatgtaatatgcaatatatatgcaataccgctcctcattctgagggtgtttaatgtttcccttcaccaaaatgcagcatctagaccggcttatgaatcttccgctgcattccgtgaagatggaaccttgttatactaaagtcaacctgcttcacgagcgcctgcaggatctcaagagccgcttcagattcccccacattgatctggtggttcagaggacacagaactacatgcaggaggtgggtgtggcaggggcatccgtggtggatgagggtaaagagagagcagagaaatgggtgctggccagtgagaccagctgctagtgtagctcagggaaatacgtcgcgtctctttagccatcatgttgcgggaggacacgttctgtccctccactggcttcatcttccatccatgtggatgaacatcatagacaagacatagctcagaaaaataaagtagcattaattgataactacttgatttgtcaaatcagtgctgtaaccttggctacacattggaatcacctgggggaaatactgatgtccaggctggcgtgcagtggcatgatcttggctcactgcatgcaacctttgcctcccgggttcaagtgattgtcttgcctcaacttcctgagtagctgggactacaggcatgtgccaccatgtctggctaatttttgtatttttagtagagatggggtttttactgtgttggccaggctggtctcaaactcttgacctcaagtgaactgcccacctcggcctcccaaagtgctgggattacaggcataagccaccacacccagcctatatggctactttttgatagaacttccctaccctgattcctactgtttctaatatgcagccaggattgagagccactggcttaaattaattccctaacgtaattaagagtaaaccaatcaatcaatcacagcttcatatttgaatttcttgagtctacttgacaggtttcttttttttttttttcataaggaaccttttccccagtaacaggaatgaatagcacaaactccttccgtattatagtgtttcctaaatgaataaggggtacggtcaccaaagctctaaaggacaccatgccatttcacacagatattctgaggagagattactgtgggccggacactgtaccagatcccacttcagggagcttgagtgagacaaattcttagataaattcactacaatgttgaaggtatgataaaggtatatattgtggccaggcacagtggctcacgcctgtaatcccagcattttgggagaccgaggcgggtggatcacttgaagtcaggagtttaagaccagcctggccaacatggtgaaaccccatctctactaaaaatacaaaaaaattagctgggcatggtggtgcacacctgtagtcccagctacttggaggctgaagcacgagactcgcttgaaccctggaggcagaggttgcagtgaaccaagagtgtgccactgcactactccagcctggatgacaaagtgaaaccgtgtctcaaaaaaaaaaaaaaaaaaaaaggtatatattggatgctttgggaccacgggcttggggaagaaaggagaactttttttttcataaaggttatgggcaggattaagtgatacattttagctaactaacccttgagttgtgagggatgaaagaggaacgaggaacaaaattgggcaacagtttagcagaagtctctttcgtaatactggaccctggtgacgggaacacaggcaaaggtgcagagaataagatacctgaactacttctgctttctgacccatgaacatgtcagccactgtccccacccatccctgaccctgcctctcttcccagccctgcagagagagggagagataagctgtggagcggtttacatctacttaaagtggaggtgccaccaaaaactagttgaagaaggctccagcctcatcccttaatcagtggctgcaggtatcaaagaataggagtgcccacgggagatgacagaatgcttgctcagtcccatggccttgggttttccaacttcttcctgctcccactgtgaccacgtgaccatttgtttcacagccctggtgatggggtgatgttgccttgggtacccccaccgaatagcagccgaggggactcatctctgatggcccctactctgcagtcccacttagccaggcctgtgggtggtgatcccagcccctgactgttgtctgtttctgtgtcgcttctggtttctagctaatggagaatgcagtgttcacttttgagcagttgctttccccacatctccaaggagaggcctccaaaactgcagttgccattgagaaggttaaactccgagtcttaaaggtaaaaccgttctcttgtttgtgggaagcataaaaagagaacgtgacccctgtttcttttgtaaagtggaaaataccaagttctctccttggctctaatctttccccactcctttctctcccaagtccagtgactgtcagtccgctgcagtttctccagtgtgacttccatgcctcttctgccatctagcggccactgctggtcctcagcatcattacccacagctacaggccccgcgtcccagccttcatagagatccaactcgacaaacacgtattagctgtccactataagcactgcatgggatgtaaaagtaggcaaggcacagcctctttcttcaaagaggttacaatatagtaaaatccattaaactggcgaataatttattgattttgaaaaatcagaacctcatggcaaaggaaatactccaaagaaaagaaatctaccatatgaaattgttttaaatgtacttcagagtgtttattaaaatagttttaataataggagctttcacatatatgttatattttaaagcctcttacctgatccccacaagaacttgtgcattaactagaatattcccccattgtacagatgaggaactgattctgtaaaagctaatgtgacttaattaagctcaacaggctgatcaatggtgagcttaaggataaacgatcatacacctagtccactaattttttttactgccttctagttcccctaaacattgccttggaacagaagatcaaagtcccacagagcctaggggtggtctctgaatttcagacttgatcttgatgcctcacaggcaagaggaaactctagcaactaaatcattgatattaaaaacaatattggggccgggcacagtggctcacgcctgtaatcccagcactttgggaggccgaggcgggcagatcacgaggtcaggagatcgagaccatcctggctaacacggtgaaaccccgtctctactaaaaatacaaaaaactagccgggtgtggtggtgggcacctgtagtcctagctactcgggaggctgagacaggagaatggcgtgaacctgggaggtggagcttgcagtgagcggagattgtgccactatactccagctctgggtggcagagtgagactctatctcaaaaaacaaaaaacaaaaaaacaaaaaaaaaaacaccaatattgctcatgataacacacataatgatgaaattgcaatgcaactaaaaaaaaaaagatagtgtcagtgtcaaatgctttagcgtacagaaagaaaggaagaaaaaatgtagaaaggtgttgaaatattaggacctcaggtttcaaagagattttgagtgcctttagttcaacttcatattcagtgttcagcaggttccctcaaggggtggtcccactagtgctccgacacctgcactggcaggatactttctacctctcaggatagcccattttagttcttgacagcaagaacatgctttctcatgttaggccaaagttctcaccactggttattccagttctacccccttcattcataaccttcttccacgtggcagcctttggttgtttgaatagagttataacttgccctaacttattatctccagtataaacaccttcatctctttaactattcttcacttggcctgaccattcttctcgctgcctatgactatactcttatttatctgtgatccccttgaagtgagatccacaattaaatcctggtctccatgttgggatgtccaatgcagaacagacagaatcgtcatctttcttgttctggatactgaacttctttggttaacatgtcacagtgttaatggagccactagccaggccttctcttcccttgttcaaatcattacaacccactgaccctggtttgaagatgtggagtaatagatgatcatggtttccatggacctacctgggacaggagtaataaaatacaaactcaccccccagttctatccccaacttctttataatgcagaactcaccattctgttttgatcttgcctcagtttccatacctgtaaaaggtaagagtgagatgggtcattatcagttataacctgtgcctgcagtgtgagggaattacatggaaagatctctgaggccttggaaatacaagagttctcagacattaggaggaaaagagaggtgaagtgggtggctgagttttttgagtaaacataagtcaacagattgtaatgttactatttaacatatgtttctttattgacagcaatatgattatgacagcagcaccatccgaaagaagatatttcaagaggcactagttcaaatcacacttcccactgtgcagaaggcactggcgtccacatgcaaaccagtaaggggatgagttaccctaaagagcttgctcttcttacctctgaagttcaaacaagttcttttgtgatgtgtactggcaaacagcagactagaccagggagggattggcagacatttttgtaaatggtcagatagtaaatattttaagcttcatggactgcactatttctgttgcaactattcagctctgctgttgtagcacacaaacagccattgactatatataaacagactttatttgcaaaaacaagatgctagccagatatgctgacccctggactagacaaaatctcaaagggcagtgatctgaatttgagccaaactaggggttgacatagaatacctaaggataccaggtgtttctcattatagtatgactcataggtccaacgtgtcctctgaaacttgaccactgtatccaaaaaagatattagctaacataattacaggatatttgttctgttaaatccagcaatgttgtttaatgaaatcaatgaaaccacttaaaacctctacaaacattgagcatccagtgagaaccatgattgcgagggtgtgacttcatctgtagagcagagcaatgggccagcagagactgaaaacagctctgggaggaggtattatttatatcctcatggtacaaatgaggaaacctgagtggttaagccactgagccgaggccacagacctggtgaccaccagagtgtgaacccagttcttgcttacctaaaacatgataggcactcagaaaatggtatcaagtactactaccactattattattactacttctacatttcaaaaataatctattaacctgaagcaaggcctgctccgttttggagcaaatgataaagaggtttttggaatttaaaaaagggctttttggcagctcggagagtctccaagcactggaacgttaaaatcctttgcataagttattttactgcaacatgtcattggtcatttttatagtctgtaagtgctgttttccttcacatcctcatagcgtattagatatatttgacatttatttgtggggcatatttctttcataggaaaggatttgattaagccaagggattgacctttggccttacatggcagaacagttcagcagccaaatgatgatggtgtccactgctaggtgggtttgcacacagatgttctgcttaggattttttttttcaatcacaaaggcagtttgggggcctcagatccaccttctctcaggagaaaggtaaggagagttctccttctcatcggctcccctctttccaagcatcaacatagtgtgctgtgcccaatctgtaagaggctcttgtaattttttaatcaggaggcattgatttcaaaagagcctgtgacccagaggttttggtaatggaggatattatatcagcatcaagagctttttaaaaatctggatttgcagaatagatgaatgaggggattatctgcttcctagaaggagtctttattttgctaaagtgcatttcccttggttctataagtagcagcttcctagatctgtggtactcagcctcagcccaagctgtgtattagaattgtctggggaactgtgaaaaaaatgattctgactccccaacacctaccttcagagataccaaattaattggcccagggaagtaaacctatggccctgttcaatcaattcaatataaaacacctgttttgtaaagttggtcacttcatgacagtatatatgtccatagaaagtactccttcccacagaattatttagctggttgaaaatttaaaggtctactgtttattgagtcagcaaatatgtattagatttgtatcacatgtgatccaggcattgtgccagcccagcatccctgaagtcctggagttcacagtagagagcaggagacaggcaaacaggatgccatgtgaggaacacagcagttgcctcatggggaagagttccaaggaaagtgccaaactctgcttatacagccaggaaggacttccagagtcatgctttcacccagtcctgagggatgaatgccaatcaggggaataggaatgggggaccacgtgggaaggatgaaagggtgttgcaggcatgaatctgtgcctctcatttagcagaggaagagacagaggcacagagcagtgatatggctcaccaaggtcccatgtctagtccagggcagtctccagtctcctgggcaatgcttttctcaaatctgtgcaacagtcctgcctctagaccctctaggggtctttgaagctcatgtctcttcaatcctttgcctttcttcttggttgggtataaaggaacccattattacccgctgtgatctgggctacagtgccccaaagtcccagcactgagagttgtctgaggtggtgcttctgatcacctgctgtaaatactgtccttccaggcaagagaccgcaaatcccatggctaagtccctgattctctaagagccacatgtgggaagccttcccccagcaccaccaggtgcaaggattactgagttaatcatgggatatgatttggtacattttgatccctgccctgtcctcatgccgataaaaggcaagccatttggaaacccttggaaaggagagagagttaagggatgcaccatgcctgagctatcctagaaggaatcaatgaatgtcagggccagctgaagagaaagagaatgtttctgaagagcccttgactacagagtctcccaacccccaaagtggccccattctgataaagttaagcatacatctaccctatgacccaacaacttcacttttaggtatatgcccaacataaacaagcccttaaatccacaaaaacatatgtacaagaatgttcacagcagttatatttatgattattatatggcgtagatatagttgcgccatatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaaaaccctagaagaaaacctaggcattaccattcaggacataggcatgggcaaggacttcatgtctaaaacgccaaaagcaatggcaacaaaagccaaaattgacaaatgggatctaattaaactaaagagcttctgcacagcaaaagaaactaccatcagagtgaacaggcaacccacaaaatgggagaaaattttcacaacctactcatctgacaaagggctaatatccagaatctacaatgaactcaaacaaatttacaagaaaaaaacaaacaaccccatcaaaaagtgggcaaaggacatgagcagacacttctcaaaagaagacatttatgcagccaaaaaacacatgaaaaaatgctcaccatcactggccatcagagaaatgcaaatcaaaaccacaatgagataccatctcacaccagttagaatggcaatcatggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagctgggcgtggtagcgggcgcctgtagtcccagctactcgggaggctgaggcaggagaatggcttgaacccgggaggcggagcttgcagtgagcctagatcgcgccactgcactccagcctgggcgacagagcgagactccgtctcaaaaaaaaaaaaaaaaaaaaaaaaaaaagaatggcaatcattaaaaagtcaggaaacaacaggtgctggagaggatgtggagaaataggaacacttttactttgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacatatgtttattgtggcactattcacaatagcaaagtcttggaaccaacccaaatgtccaacaatgatagactggattaagaaaatgtggcacatatacaccatggaatactatgtagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggagaggggagggatagcactgggagatatacctaatgctagatgacgagtaagtgggtgcagcgcaccagcatggcacatgtatacatatgtaactaacctgcacattgtgcacatgtaccctaaaacttaaagtataataataataaaaaataaaataaaacaaaaattatatttatggttgaaaattgaaaaaaaatctcaatttttatcaacctgagtgcagataaacaatttttgtttatccatataatgaatactacttaacaataaaaaggaatgagctactgatagatgcagcaacatggatgaatctcaaaaacaaatgcaaaataattatgatttcatttctataaagttcaagaacaagcaaaaactatcatgataggtataaaatcagtgctcatatcttgggaggtgcagactggaaagtggggtgggggaactttgggggtgatggaaatgttctccttgatctgggttatggttacataagtatatttacatatttaaaatcattgagctgaacttatctgtacattttactatatataacttaccttggtaaagtgctattgtgattaaacaaaaaagaaagaaggaaacatcttggtgatgaggggaaaaaaggaggctccaaacctgctaatgaggccttgagatgataaaaaaaaatcactgctgtcttctcccatgaagtgtataaaatgcgtggccagtacaaggaaagggaaaggaaccaccaatggctgagtgagttccacaccttatcatggacagtaatagatgtgtcgaggtcaggcatggtgcctagacagtgaattgaattgaagggaacccaataaaatattattgaattgagtaatttgcccctgggccaacatggtccttctcttatgccctccaagaagagaatcatgagtgggaatcgtcctttctgtatctcctctaagaacaggcatctcatgccttttcatctttatcttctaatctcttgctctccaggagcttcagaaatacgagcagttcatctttgcagatcataccaatatgattcacgttgaaaatgtctatgaggagattttacatcagatcctgcttgatgaaactctgaaaggtaagaaaggttacctggtgctgcagggacactccatagaggggagcatccctgaaataggactctgtaaggccagtcagggaggaaaagagaagaggaaatggacattggtgagggagggagacagacagtgaggagagggaaggaaagaaggaaggatactaaccttgattgagtgttatgattaagcacacacaaagctggcactttagatgttattttccctttttaatacacaaatatgaatgctgtgagatgggaattttaagtttcattttacagatgagaaagttgaggcttagtgagattaaatctcgggtctctcatgaagagctgtcttcctcttgctattccagacagaacaaagggaaaagggcttttcttaggcacaggcttgtaactgcccctgccccccacccaccaaagctgagaagaggcaattccagcagcaaggcttattaatggctctctcaacacattcccagactccactcagccagacagaaaaaggtgcagggtgatgatgcagtgccacgcaagtctcggtgggactccggcatccagtatcctcaggaatcatgccttgcctgggattggattgtggataggaaaactttgtttaaaatatgctggagagggctgggcacagtgggtcacacctgtaatcccagcactttgggagaccaagatgggcagatcacttgaggtcaggagttcaagaccagcctggccaacatggtgaaactccatctctactaaaaatattaaaaaattagctgggcatggtggtgtacacctgtaatcccagctactccagaaggtgaggtaggagaatcgcttgaatccaggaggcagaggttccagtgagccaagattgtgccattgcactccagcctgggtgacagagtgagactcggtctcaaaaaaaaaaaaaaaaaaaagctggagaaggccaccatcaaactgtggacctgaaacatatctggtctccttttggaaggtcttgagtatcacaaaagaccttcctcaatgaaaactggccaaggacaagcccaaggtcctagtagctaattctagggaatccagtgagaccagcaatatgaagatgtcagcacagtgtctacacaaaggaagggctcggtcaaggccactgccagcccaccatgggcacttttgggtgatttagaaaaagactcctttcctccagacactttattgctgtctgttagaaaattgtcacaatatattgattttgttagagaaggaaactctgcagctagatgctgaaaagttatgccgaatacacaaatctgttctgtctttgatatgaatggcacccctgagatgtgatatttttgggcactacagcccctgcacagccataagtaggaggcctgtggtcaaaaatgtcacctgctgttgttgttgttgttattggatttgcccctctggaggcctttgaaactgagctagatgcacatggatcttcattttggccctctcctctgcatgtgcagtaccgagtacctattacacattcaggactgtactgcaaggtaaagcagataagtgtaaggcctggccctgccctagaggatttcagtccaggtggacaaactggagccacccatcttagcagctaataaaatgtgctggggcctccctgagggatacaggtgacactactgcagaccctgagtgtcttgaaaacaaaggctatagtttattcatctctggattcccagggcctgtcccatgttaaatgtcctgcaaatgtttgctgtttgaataaatgaatgaatgaatgctacagaggctcagagtttggaaagagtttatagactttggtcatcagggaaggctccctggatgtaagctgggtcttgaaatggagaaatttggatagccagagaggctgaaaggggactttggcttctcaataaaatcagaaaatcatgttttgttttctgatatctctcagtgataaaggaagctgctatcttgaagaaacacaacttatttgaagataacatggccttgcccagtgaaagtgtgtccagcttaacagatctaaagccccccacagggtcaaaccaggccagccctgccaggagagcttctgccattctgccaggagttctgggtagtgagaccctcagtaacgaagtattccaggagtcagaggaagagaagcagcctgaggtccctagctcgttggccaaaggagaaagcctttctctccctgggccaagcccacccccagatgggactgagcaggtgattatttcaagagtggatgaccccgtggtgaatcctgtggcaacagaggacacagcaggactcccgggcacatgctcatcagagctggagtttggagggacccttgaggatgaagaacccgcccaggaagagccagaacccatcactgcctcgggttctttgaaggcgctcagaaagttgctgacagcgtccgtggaagtaccagtggactctgctccagtgatggaagaagatacgaatggggagagccacgttccccaagaaaatgaagaagaagaggaaaaagagcccagtcaggcagctgccatccaccccgacaactgtgaagaaagtgaagtcagcgagagggaggcccaacctccctgtcccgaggcccatggggaggagttggggggatttccagaggtaggcagcccagcctctccgccagccagtggagggctcaccgaggagcccctggggcccatggagggggagctcccaggagaggcctgcacactcactgcccatgaaggaagagggggcaagtgtaccgaggaaggggatgcctcacagcaagagggctgcaccttaggttctgaccccatctgcctcagtgagagccaggtttctgaggaacaagaagagatgggagggcaaagcagcgcggcccaggccacggccagtgtgaatgcagaggagatcaaggtagcccgtattcatgagtgtcagtgggtggtggaggatgctccaaacccggatgtcctgctgtcacacaaagatgacgtgaaggagggagaaggtggtcaggagagtttcccagagctgccctcagaggagtgaaagggacaatttggctgaagtctttctctgaaaaaagccaaagggttataggggtacacttaggggttgcatgcaagctgttaccaaaaaatttttaagtattttcttaatttgaataataaaaccagaggaaatgcatacagggcatgagcaactgaggcaaacctttgtggacatgaattgttctacgatgaatttttgctttagtattttaataagaattacaaagacaatggcatacttggggtgagagggagctgaggatgtctgaggagggaatagtattgcagggaagactgagaaaacagtaggatgacagttttgagtatactctgcacttttcaattgtgcaatcttcttgtgcactttaaggctttttaattttgtttgagaatgcaaatgtatactgtaagtctacctttactatctactatgcctacttcaccatctcttaaggactcggcatttgtccacagtcagactgcaagagagggtaggtcatgaacagtcacccgtgctggctgtagcccccacagaggcaatcatgcccaatagattcaagagaagctaagcggaaatggagggtggaaggtgtgatctgtgggactgtctgggcctgttactcatcctgctatcaatttcttattaattaatcttgatgattcttattaattaatcacatttgcaggaaattcagatgaggcaagaaaattttattggcctgggtaagactgaaagcattccaaattaggcttagactgtgcaaagggcttagctaagttatcgagcttaaaacccgtcaattaaacaaacattatttgaacagttactgcatgccacgcactgtgttgggcttagtaataaaaaaaagaaaagataagtgcttgttctagcataaattaaaaggtccaagggaatttaatctggaagagaacatatgccaatttttaaactatgacagcttttttttttctctttccattcaaatagtcctggttcattcccagaagggcacaaaatgaatgaataaataaataaatgaataaagacaaaagccaaggtgtatgctctcaagttccaaagatgttatcaaaagctgaaatcatttgtttggtcattcagcaagctaattgagtctctgttatataccaagcactggggataccatggcgaaaaacaactttgttccttcctcctagaacttacattttaatggaaatagacaaaacacatcttcttaacggatggtgacctataaccattaatgttgaaaatggaagagacttgcttccaaaagattaaaaggagttgttcttttctccttcagaaaaataccagatcatttcctaaaatctccagtcccaagtattacatcgtggtttccctccccgactttttattttattttattctatttttttgagatggagtctcactctgtcgccaaggctggagtgcagtggtgtgatctcggctcactgcaacctccgcctcctgggttcaggagattctcctctgtcagcgtcccaagtagctggaattacagccatgcggcaccattcccggctaatttttgtatttttggtagagatgggttttcaccatgttggccaggctggtctcaaactcctgatttcaagcgatccacccacctcgacttcccaaagtgctgggattacagcgtgagctacctggcccctccccaaattttaacatcagatctcaacatatttgttgagaacttgtttagatcatcactatcgagtaaatttatgtcagttctttagagcatttgcttcacacacagttcaaccatttaaccagaaattaaaatatcacccttttcagccctcccatgaagaatttctaggtcataaacatgaataatactcagtatatgtataatatcatatttaattgttgcaacttttcttggcgtgtttaaatcctcatgtctttgagggatcccaccacaggtgaaggaagtaaagaccacttctcccccagtctctgctttctgcagtgctcactcatatcctggcatttagcatggtgtgttgaaattaggtttacttcttgtctctccaagtggctcctctcttaaaagacagaaactagggtttagtcatcatttgtgcttcctgctagaaacccacagccttgaataatggcttcctgcctccttgagtcactttaatatccctggtgcataggacctggcatgcgtcaggctgctcgggaaatgtgggaactggacacccagaacactgctgtgctggggctatttggggcctgctgtcaggcagaaagacgttttgaattgggctttctgcccttgttgagttttctcttaagtaaagtccaaagtccaaggggcagatggccagatgcactgcccagtaaggcaggaagccaaagaggcagtgcccagccccacaaaggctgcccgactccctgggacagtagtgtggagtcccagcccaggctgacctcacaccggagcttcctagcttcctttctttgctcaatgcagggcttcttgcaccccctggaaagctaagagatttttttcaaccctaaaagagagtacctttcactgcattggatggatgaacatcagtgccctaactttatccatcatgtaggtcagggaggactgggcactatttggcaggatgtactccagaatataatcaaagaattttctgtacatatttcactaaagacaagtttttgggctggatgtggtagcttacacctataatcccagcactttgggaggctgaggtgagagggtcacttgagcccaggagttctagacaagcctgggaaacatagcaagatctcatccttacaaaaaataataatggtgtgtgcctgcagtcctagctacttgggtggttgaggcaggaggattgtttgagcgagggaagttgaggctgcagtgaactatgattttaccactgcactccagcttgggcaacaaaatgagaccctgtctcaaaaaaaaaaaaaaagttttctagaataagcaggatgattgtttaatttgaagatggaacaggaaactagagtgcatttaaaatactctgtcttcattttaacatgttgaatggaataactgcatatcaccatgagtttgttttgcttttcatacagacttgtatgtgtcatttgagtggtttccagattggagcgaggttattctgatctaaatgaacagcatttttttccttagcctctgtttgccactctgggtatctctcctatgggcaaagccattagaaatgcataaaacctcgagacatggtttttggcaaaaactccatgactttaaactagctcttttactactgacctttcacagagaaaaaatatttcccttgaaaaaaactgggcttgtcattttttcccttgtagctttaagcagagacataagtgccttgcattacacatagtaaactttctttaaaaaaaaaaaaaaaagattttggagactaccagggtaagattccaacttgtccaaaagctttctggccttacatattttattataaaaattctcaagtctggtaatcttctatgtcagagctagtgatttcaaaaggtttcacaattccccaagacaaaagtgattttcgttcattataataaggttaagtgatatgtgattcatagcaattttgatgtgaagaagggaaggacatcattgacttaataatagtatcagtcggtgcaacagttggcaacatgtgccttcacactttaccataaagagacgggtttgagggtttgccttctaaagtctgcaacttcaagaaaaaaaatcgacactgtggattgactttcccggtcactatataaagcaaataaacttaaaacactttgtaaccatgtatttactctgccaggtgcctatattccaataaaatgttcatccttg

SEQ ID NO: 38258 - DNA, 183520 bp, Homo sapiens; identical to SEQ ID NO: 38257

SEQ ID NO: 38259 - DNA, 83937 bp, Homo sapiens
caatgaaaacgaggggggcgcggaggaggaggcggcggcgtcggtggcggcggcgacggcggcgcggaggcgaaggcagcggcgggcgcagcgaggagggcgaggccgggggccgagagggcgggagggcgtagtggcggcccgtcggggcggctgaggcgggcagccgaagcagtggctctcggagggggaacaaagagcagcgactaaggcggcagaggagcggcggcggtggcggcgctgcagcagcgggcgggactggtatggtggttccacagggcagaccccgctgcactcacagggaggaggaggcggcagcggcggaggaaggcggcgcaccccgagaggtgagcgaggcaggccggaggcccggtcggggcgccgctcctctctccggccgcgcacggaccgccccccgtcggccgggctcggtcgcgggcaactttcgtttcgtgggcggcggtcccgctgctccgcaagctggcggctgttgggggccccttcgacgcgccgcgatcgcgccccgccccgggccgcgcccccgggccgagtccctgggaggggggcgttgattgacggcggcggcggcggcgcgcagaggggagagggtcggcgctgggctcccggatcccggccggtcccggctgccgtcgtcggaggaggcgagtccgtgtcccgggactcgtggccaagatgggtggcaacttttgagaagcgcctctgtgggtggcgcgctgtgtggagtgtggagcttcgcgctccgtggccacaattactgtcaagcgggaaaccaactgcttaccccctcccctaaaatgtttttaaaattcagtttaacgcagattttgagggagaggacggggtggattacaggttaaagaagcacttggcatgcaatgaggatgcttattttatagtattgcgaaggattcggagattgtactggtttctacaagcagttttctctggtaacccaaattgcatccctcctttttgtttttcagcactaatcgctattttctttggaaacttcctttgattctttacctccttcaccttccccgaagagcctgctaaccaacacctgtggccttctgtttttaactgttgttgccattgacagcgttgtgaatggtcatctcgctcgagctctttggatttgttgttactgtgtaagctgatgtgttttagataatctgcttcaatttgagttcccatacttacctgttttccaggtggattgtctcattgttagtgctgaatcttcttgcctacttgtatctgggaatttaactttgaagaggaagagagtgaatatgaataactgaaaaataaaatggtgtgtagtagcactttgtattttttacaatatactagaatttactactctagaacagattagtaggctgtaggagtggacgtgggccattgatcaaaagggtttaaaggcttttttggggaattgctgttaagacatttatcacagtctttatttaatttatttattgtttttgagacaggatctcactctgtcacccaggctggagtgcagtggcacagttctcggctcactgcagccttcgcctcctgggttcaagcgatccttttgcctcaccctcctgactagctgggactaccggcagacaccaccacggctaattttttaattttttgtagagccttgctctgttgcccaggctggtctccgactccagggctcaagcgatcttccttccttggcctcccaaagtgctgcaattacaggcatgagccaacatgcctggccatcacagtgtttagaatgtgatgacttttagagtaaaatttagaataaaaattgcttaatatctttagatctgtgatctactccaggtgttttgctttaaacaaaatacatgaacagctgctaatgagaagacagacctttctaggtggaggtgacttgcccatggtactgtaatgaggagggaaaggaccgggtttgtgtgcgtgtgagagcgcatgagtgtgcgacctaatcgctagaggtttgttcttttgggaggagggagggtatgttaatggttggaagttatttcaggtcacttctcagtcgatgaacgagatgctgaacgaaatgatcaaaaaagatgatgcaattgccaggcatggtggctcaccgtgtaatcccagcgctttgggaggttgaggaaggaggatggcttgagcccaggtgtttgagaccagcaaaaccctgtctcagaaaaatataaagtaacatatataaagtctgtgataactgtcacaacgtagtgagaccttgtcttgatcactttataaaaacggtgacgaaagacagattttcttgtgagactgaagattttctctgaaagtcaatcattaggtaatttccatagtgtcttgatagtggtgatgcagcccaagcggctcctcttgaatgcctgttcaatttgtaggtattttcaggttgcttaaatgttgttggcaaagtaaaactacaattattgggaaatttcaaacttttgagcagacataaggttggtttatagaacttggtcctaactacaaatgtgtaaaggcgttgtaggaatttgcccactgtacatgtagtttaaaagtatgcattttatgccaggcgcggtgactcacgcctgtaatcccagcactttcggaggccgagatgggtggatcacctgaggtcaggagttcgaggcaagcctggccaatatgatgaaaccctgtctctactaaaaatacaaaattagccaggtgtggtggcgcatgcctgtaatcccagctattcagtaggctgaggtgggagaatggcttgaacctgggaggcagagattgcagtgagccaggatcacgccactgcacttcaccctgggcaacgagtgaaactccgtctcaaaaaaaaaaaaaaaaagtatgcattttggtgaatgcttagacattccagtacctatatttgccttcttatattctttaaatgataaacctttttcatagtgcaacagaaaaggataatatatgtaagacatattggaataaatggttaaggcagctcacagctgtattctttgggccgttaggggtgagggatcagtatgttcagcacctttagaacccattcccatatgcaaggtccactggcttgggaagctctgcttgaaagcatttattactttggaaaagtcctaataggctcagctaaaaatgtatgttttactgggaaaaccaaagacttggatatgtagatatctttatacccattactcatacagtcattttataacaaaagtgtgattaataaaacgctgtgtatgtgaaattaagaattgctgagactgggcgcggtggctcatgcctttaatcccagcactttgggaggccgaggcgggcggatcacttgaggttaggagttcgagaccagcctgaccaagatggagaaaccctgtctctactaaaaatacaaaattagccaggcgcagtggcacatgcctgtaatcccagctactcgggagactgaggcaggagaatcgcttgaacctgggaggcagagcctgcagtgagccgagagcacgccattgcactccagcctgggcaaaaagagtgaaactccatctcaaaaaaaaaaaaaaaatgctgagtaaactgtaaacatatactgtatgcatagctggggtacattagagtataatggaatgtactgtattttggtacttgaataagtaattagcgaggtggggggttatttgatccaagatgaggactcatttaggctgtctccacttcgctcttctctgtccttcacctctccttcatccatttatattttcttggtaacttcagttacacgttaaggtatgtactggccatagtgttttaacactgagaattcaaagacaaataatactccgattttgccttctcatagtgtataggcttcataggtgcacagagtgctgtgggagaacacaatagagaatgattaaacttgtggagggtgtgggggcagtttacggaaaataacactgaataggaatttgccaaactggggagagggagtcatgtcaaacagaaggaagtgtgggtgcactgaggtgtcaagtgttagggtaaggctagtgataaggtgttactggaacagtgggaatgactcgagatgagcctgcaaaggtgtgtctggtctagattttgaaggaccagccttgctaagctaaaagggaagtgtatagccttatctgacagcagaagagagagccaaaatattgttagcagaggagcaaggcgatttggaggtcactttggcatccctgtggagaatagagtggaggccctacaagtgtatatttgagatagtatggagttagtgactttgaatctgttttcttctttttttctgagatgaaggctcacttggagtgcggtggcgcgatctcggcccactgcaacctccgcctcctgggttccagccattctcctgcttcagcctcccgagtagctgggattacgggctcctgccaccacgccgactaatttttttgtatttttagtagaggcagggtttcaccatgttggccaggctggctttaaactcctgacctcaagtgatctgcccaccttggcctcccaaagtgctgggattacaggcgtgagccaccatgcctggcctggatctatttttaacttggatatggtgtcttctgagtctgtggtcccttaagggactttagggctatgcccagttgctctataatacagggtcatttaaaatcaaagtgtcagtatgttttggaagaagttaaaagcagtcaaaacaatgaaagttataaaatgttactcatgaaagttcaggtgttgagaatacttgtcttctgagttaggcttaggcaggctatagaccttaagctggaaaattcaaccctatgtccacttgaaatcaaagccaccaagcttaaaaagttaccagtatcctgatggtttgctaggatatgggttgtaaacattttgtgaaattttggggggaaggcagttttctctctagtaaattattggaattggaatagtgagactagcttaaggtctaagaagttctcatacaactgttaatttatacagtcagttctgctgtaaagcaacatacaggttcctaaaaatcactgctttgcagaatcgtgcagtagaaatgacttacaaatggggttggggtacagcactctaaagctttatcagtgacacatttaaaaaaggaacctggtaaaaatgatagaacagttttacacgttgaatggttaagaaatatatagatactgtaataaatgtggcattttctttgaaaaagccctggtttgcttgtggaaagggatgtcagaaaggttgctgctggtgagttactgtgaagtggtagaagaattacttataatcagatggaaggttgtaacacgagaagcaaataggtgtggctcttaacccataataaactgacttagctggtgggtgtttgaagtgtgtttcatgtatttctacacagttcagttcggctgggtgcaagctttctcccttcatctagtgtttatgtgacagaatagcacataaataaacaggaaatatggattgtgctcaaattgttctctaatttgtgtatcaatcacagtggaacaaattcaccttttcttttctttttttttcccccctttttctttcttttgcttttccttttccttttctttcttgacagggtctcactctgtgtcacccaggctggagtgatgatgacttgctgcagccttgacctcccaggttcacccgagcctcctgagtacctggtatcacaggtgtgtgccaccacacctggctgatttttcttatttttagtagagatgaggtctctctacgttgcccggtttggtctcacactcctgggctcaagcagtcctcctgcctcggcctcccaaagtgctaggtttataggtgtgagccactgcacctggccaaattcacgttttctttttcttttcttttcttttttttttttttgagatggagtctcactctgttgcccaggctagagtgcagtggcgctatctaggctcactgcaggctccgcctcccgggttcacgccattctccttcagcctcctgagtagctgggactacaggcacctgccatcatgcctggctaattcaaatgcacgttttcaaaacaagttttatagttgattatacttgtttaatactagttttaaatagtactataactcagtttcaaaaatacttgttgaacaatctatgtgtcaggtaacatgctacctttgtggggcttagagtcttttgtcccaagtaggtttatagtgttgtggagaaggacaaatgaaccaatagagtactcatcgggttatacagtaattaagaaagcacaaagcattttgggcatgctaaggaaggagaaagtcattctgcttggaaaacccagggagtcatctcagaggtctttaagctggattttaaaggatggatagggatttgttaggttgagtaggacagggagaaggaacagcatattgggaacaacatgggctgtggagcataagacacagggatgagagggacaggaagagtggtcagaaacagcttgtgaatagttgtagggtttttcttaaagtgttgagatttcctgtatatgatagaaatccagtgagagtttaggtggatatgggtgagcaagtggttcatgtaacatactttttcaggaggcacataatgaaaatgtagaagctggattaaaggagttagagttcatttacgtcctgtgagagctcaagtacatcagcataggggatagaaaagcacaggataccagaattagggacagactagccatgagctataaaaataggaaagagttgagtatgattcagaacttgtttagcttagagaactgttggtatgatttaacttgggaaacagaagaacagatttggacgaggaaagtagaatagtttgatttttgatcctgttaagtttgacatacctcctggatacttaggtggatatgtctaacagatatctggaccagagagcggtttggggtttgatagatttggtcattgtatagttggcattggaagttaggggattactcaggaagagtgtgtgaacaaatgtttttcacccttttgacagaggtaagatctccatttgagaatcagttaagaattatggactctgctgaagggaatgaaagtatgcatatatgcaagtgtgaaacttatggaccacaagaggagaggactaagggaaccctaaggaacagctaatattttgttttggacagcattgaaatggttgaagagacaagggcagaacaggagagagtaacgctacagatgccgagagaggtcatagtgccaagaaagaaggagttttcagtagtcatcattgtgcccaggtttagggtgggatgagatctggaaatgggttgataggatttgacaggtgggggaatgaatgcagggaaaatttttatgggaccagggcatatataagtcagatagtagattgggcggaggagcaaatgggaggttaagatgaagaaggttatagactactatttgcaaaaatttaaactagaagagaaggaaagaagggtaatagtttaaagaggagacagggtcgagagaaggtaggcacctgtgttagtcaccagctttgtttccttaagtccaaaactttggaaataaatttataatgtatattgcgtgtatgtttccaaacgttcccctgatctattggttgaaattattgcatttttatttggtgatacaaaattgttttgcctgcggaattttatgtgatttcaaaaacaataaaaaaaactctttctcattagcgatagagattatctgatgtaaaatcataatattacaattttcagccttcagttactagaagaagaagatttgtcctcattagcggtagagattatctgatgtaaactcataatattacaattttcagccttcagttactagaaggataagatttgctttcatatgccatatactaggtttgcacttatgttgtgctccattgcccaaactttggttaaatatttgatgcggttttaagtgtaaaatagtagcaaagaggaaatcattagacatggtcattttctttccaagttattgctacaaacacatagagacttaataaattagccagtggctctgtgtatccaaatacagagtattacaggtgattaggtgcattgagtggttgtatatagttttactaggcagattttgattatacggagatagatgtgttagtaatctctcctaattaaaaaccaaacagagatgaagatatgacttgactaagttaaatcaaaaattgtattgcactcagccttttgggaggcaaatatttttcttctgtaaggttatgtattgttgttaagtaaacacttcagcatcataaaacaatatttgatgaagctaactgccatgttttagaccagtagtttcctttgttaatctaaaattatgacaatgataactatagtttatagactaaagaattgtcatttggtttttagttttatggaaactatagaaactcaaagatttaggggttcatagccactgaagaaaaaaaatgatattgaatgccggtggtgcagtgggctctgctgctttacatgtgtctcatttaatcctcacaccaaaattgtgacatagataccaccaatttataagtgaggaaatttaggcattaaagatgattgtaaacccatcatttcaagccaggacttgatgcaggtctgactctagtttgtatttttctttttttttttttttttgagatggagttttcactcttgtagcccaggctggaatgcagtggagcaatctcggctcactgcaacctctgcctcctgggttcaagcgattctccagcctcagcttcccgagcagctgggattagaggtacgcgccaccatgcctggctaattttttgcatttttggtagagacggggttttgccatgttggccaggctggtctcgaactcctgacctgaagtgatgtgcctgcttcggcaccccaaagtgctgggattataggtgtgagccactgcccccggccccagtttgtattcttactgacactgtgccctacttccttttttttttttttttttttttttgagagagtctcaatctgtcatccaggctggagtgcaggggcgccatcttggcttactgtgacctctgcatcccgggttcaagcgattcccttgcctcagcctcccgagtagctgggactacaggcgtgcgccaccacacccggctaattttttgtattttagtagagacagggtttcaccatgttggtcaggatggtctcgatctcctggaccttgtgatctgcctgccttagcctcccaaagtgctgggattacaggcgtgagccactgcgcctggcccctttttcttcttaacacactctcatggtattatgacttggaatggtcttttgaggttaatttgataatataggaaaacccaattgttggcccaaatttataaccgtttacactagtagttgatcatgttgacataatagtactaagtggcagaatctttgttaatatttgtgattctctttttggttatggatcaaaaacctcccaagagtccacataagagtacttttcatgctagtcaaaaattcagttctaaagcatttcattattttggaaaaggcagtctgttatacatctgtagtcaaaaagcagtgtatagctttcaaattttctgaaacattatcagtggccttagagtaagattctggtgttgttaaaggcttcttgatgctttgtaaggtcaacattttatgaataattttcttttgtagttttaaggggaaaagactagtggatcaaaactgattgctcatacattacaacttcccaagtcattgtgtatctgaattggcagcctagagtaaatattgaatggctcaaaagaccaagattcccactagatagtagtacttagaatattatggttcattccaagagcgggggcagtaaatagattttggaaagtctggcaaaaggtaagaaaactgcaaagattcatgttggcataaatattaaggtgctgaagtgataaactaaatggtggttgcttgtctcatggtaagagaacagatttaggattgatgacttccccactgcttacctttttaatcttggtgagattttactacacaaatcatggttttgacttaataccttacattagtgggcagactttaaagagatttgcggaactgagacagtgtcactcttctcactaaattttactttgttttttaaaatagttttcattaaaatgtcatttaacatgtgataggtttattactgttaaagagttcataaatattttttaaagttctcagttctaatttgattcttactgataattgatagctataacccacatcaatgaaagttctgaggtactagttaattttttttttttttttttttttgagacgaagtcttgctctgtccccaggctggagtgcagtggcgcgatcttgactcgctgcaagctctgcctcccaggttcacgccattctcctgcctcagcctcccaagtagctgggactacaggcctctgccaccacacccagctaattttttttgtatttttagtagagacggggtttcaccgtgttagccatcctggtctccatctcctgacctcgtgatccacccacctctgcctcctaaagtactgggattacaggcggtaatagttaattttttttttttttttttttttgagacggagtctggctctgtcgcccagtctggactgcagtggcgcgatctcggctcactgcaagctccacctcccaggttcacgccattctcctgcctcagcctcccgagtagctgggactacaggcctccgccaccacacccagctaattttttttgtatttttagtagagacggggtttcactgtgtagccatcctggtctcgatctcctgacctcgtgatccgcccacctcggcctcccaaagtactgggattacaggtggtactagttaattttttttttttttttttgagacggagtctggctctgtcgcccagtctggactgcagtggcgcgatctcggctcactgcaagctccgcctcccaggtttacgccattctcctgcctcagcctcccgcgtagctgggactacaggcacccaccaccacgcccggctaattttttgtattttttagtagagacggggtttcactgtgttagccaggatagtgttgatctcctgaccttgtgatccgcctgccttggcctcccaaagtgctgggattacaggcttgagccactgagcccagccaagtactagttaatttttaagactgcaaaagggtcccgagacggtagtgttttgagatctgctgtcttagtgtattgtggagggtttgggactgtaaagtataggtgaggaggttaatttgggaaagatgatgcatctgagacataaatgaggggctcatgatcccagcaacatattatttggataatgaacagaagatcttggtcttgcaagtgatagaattcttgagaatgaggctgtggtagaatagaaagactagctttggagtcagattgtccctggttcaaatcccagctctacaattcagttactaagtgtgcaatcttgggtaaattgcataaactgtgggtctcagtttcgtcttctataagataaaggtagaatctacctcatgggttgctgtgagaattaaatcaaggtcatacaggtaaattattgcatagtagttgaaagcacaaactcgaatcagacttgggttaaaataacagttgtgtcatttagtatccctgtgacctcaggaacgttattctccggaccttctttctttatgtaaagattataatagtgtctgctcacaagagttctgagggttaaatgagataatgcatgtaaagtgctggatagacctggcaggtaatgagtgctcacagaatagttggctactatatgcctagtgcagtgcatggcagataggtgcccaacacacttttgccattacacctatctatttgatgtttgctcttattttgccgtagcgtgtcactaagatagattttttatagtttaagtttgtccccttgcttcttacctcaggctatcccagaaccagtatttttagttctcttggatattaaagtcctttctattttctctagattttgccttttaggtaatagtttttcttattcctagtaagataggcactgcttttaaggcttcttttgcactcttagaaaatgtttgcttttatactatcctggcttctccctttaaattcatataagcattacctgaatatttgccaagctctggagttataaaaatatttaagatatgtaaatggaagaagcctgtgttacagaatgtgagataaaaaaatactaaggcaggtttaatgaatacaacagtagacatgttttcgaggtttagcatagctcagagctggaaacagtaaacttctgtgtttgggagggatatggaggaaggttgtaatgcatgttttaaagttgaatgtctgagttggcatttgaaggatgactaggggccttttggtgtctggggcgtttcaggcagaagacatggcattgctaaggcatgaaggtttgtgaggggtaagtgggaattagggagatccaagatgatactaaggaggtatacagagatcaagtcaaactcaacttacttgttttgtaaatgagcctgggtttcctgtttccaagggtattgagatgaacaagatatagttttaggggcccggtgtggtggctcacgcctgtaatcccaacacattgggaggcccaggcgggcagatcacctaaggtcaggagttcgagactagcctggccaacctggtgaaaccccgtctctactaaaaatacaaaaaaattagccaggcgtggtggtgggtgcctgtaatcccagctactctggaggctgagttaggagaatcacttgaactcgggaggcagaggttgcagtgaaccgtggtcacgccattgcactccagcctgggggacaagagcgagactccgttttaaaaacaaaaaaagatacagttttaggaacatgatgtacttgtatttctaggactgtcactttggacggtatatttagtacattcttgcactgctataaagaaatgtgtgagattaggtaatttatgaagaaaaggggtttaattggctcttggttccacaggctgtgcaggaaacgtggctggggaggcctcaggaaacttaaaaccatggaggaaggtgaaggggaagcaggtagtcttcacgtggccagagctggaagaagttggggtggagatgctacacacttttaaacaaccagatcttgcgataactcactttctgagacagcaccgaaggggaaaagccacccctgtaatccagtcacctcccactaggccccacctccagcactggggatacaatttgacatgacatttgggtgggaacacagacccagaccatatcagaccgtatctaggatggattagagatggggagagtggtggaggaaagactatgggtgtgagactgttggaatagctcaggtaagagctgagggaattaaggcagagtgggtgagagatttaggaagtaaaatgggctagagttggagactggatatgaagactgtgactaggtaaggaagggtcaaggatatgctcatatttttggtttggaaatctgggtgtaagcataggagaaagggcaggattgaagaccaagatgataatttgtttttttagtatgagacggagtctcgctctctcacccaggctggagtgcagtgacgcaatcttggctcactgcaacttctgctacctgggctcaagcgattcacctgcctcagcctcctgggtggctgggactacaggcgcacgccaccatgcccagctaatttttgtatttttattagagacggggtttcaccgtgttggccaggatggtctcgatctcctgaccttgtaatccacctgcctcagcctcccaaagtgctgggattacaggtgtgagctaccacgcccagcctagtaaagttttttattttatgtttttattttttcaaggcaaggtctcacggtcacccaggctagagcacaggtgccatcatggctcactgcaacctcaatctctagagctcaagcaatccttccacctcattctcccaggtagctgggactgcaggtgtgtgccaacatgcccagctaatgtatcttattttaattaattaattaattttattattattattatttttttttgagagggagtctcactctcgcccaggctggagtgcagtggcgtgatcctggctcgctgcaactctcacctcccgggttcaagcagttctcctgcctcagcctcccgagtagctgagactataggcaagtaccaccatgctcagctaatttttgtatttttagtagagacaggtttcaccatattgatcaggctggtctcaaactcctgacctcgtgatccacctgcattggcctcccaaagtactgtgattacaggtgtgagccacagcgcccggcctattttattttatttttatttttttattttgagacaaggtctggttctgtcacccagactggaatgcagtggtgcgatcttggctcactgcaacctccgcctcctgggctcaagccgtcctcccgcctcaggctcccaagtagctggaactacaggggcatgccaccacacttggttaattttggtatttttttttctacagaccaggttttgccatgttactggtcttgaactcctgggctcaaatgatctgccagccttggcttcccaaagtgctgggattacagttgtgagccactacacccggccctgattttttttgtttttgcttttgtctttttgagatggagttttgctcttgttgcccaggctagagtgcaatggcggattctcgtctcattgcaacctctgcctccgggttcaagtagttgagattacaggcatgcgccaccacacctggctaattttttttttttttttgtatttagtagagatggggtttcttcatgttggtgtaactcctgacctcaggtgatccacttgcctcggcctcccaaggtgccgggattacaggcgtgagccaccacacccagcctaattttttatttttacgtagagacaggatctccctatgctgcccagtctggaactcctgggctgaagtgatcctcctaccgtggcctagtaagacctttttgataccttggtgttttttttttttttttttcactagctactctttgttaaattcctcctatgcaattcatatggtttgctttgggagattatcacggggttctgataccaagatacctgccatagtatcatcagcaatttatagtagtctcaaaatgtgtagttatgatttaagttttgcctgttagtcaagagtagttatcttttgcagaagctttttgttgttgctgttttttgtttgatttcctacaaggaaagactaatgatagacatttgccactaaggacagctcctaaatgaggtttatcgtctgtaaacctttttttttttttttttttttttttttttttttttaagagatggtgtttttctgtgttgcccaggctggagtgcagtggctattcacaggtgcaatgatagcacgctatagcctcaaactcctgggctcagcctatcctcctacctcagccttccgagtagccaggacttctatccgtaaacttttaactggccaatatgtgaaggaaacctgactagaaagagaaacaaacaaatgtgatgacattgggaggcagcagattttgggtttgaagtgagagtagaagtgccttaactgaattgaggctgcgagaaaggcttgtgactatcgtctaatggaactaagtgggtttgtttatactagaggcacaggcacatatttttaatttgtagaattcaaatcatacacttggcaaaacagcaggcgaatatattaaagaatgtggtaggcctgccatctcagtcataattgtaatttgaaattccagagtatgtgtatttaaaaatagcatttattaaattattgtctttatatgacatttaaatgttcattatctaaaagttttaatatacctataaatgaattgtcatttagattgtattcaaagagggactgatttttgggtgagtgtcttttggggctttttgttttgtaataatggaaaatagcacagttacttttttttttgcgacagagtctcgctctcgtcacccaggctggaatgcagtggtgccatctcagcttactgcaatctccatctcccgggttcaagctattctcttgcctcagccttctgagtagctgggactacaggcacctgccaccattcccggctaatttttatacttttagtagagatggggttttgccatgttggccaggctagtctcgaactcctgacctcaggtaatctgcctgcctcggcctcccaaagtgttgggattacaggtgtgagccaccgtgtccagacaggcaggttttttttggcatatgtttgtaatttgatttcctttctttggataattccttttccatttttaaatataattaaattttttggagggcaggcacagtggctcgcgcctgtaatcccaccactttgggaggccagggtggggaaatcgcttgaatccaggagttggagaccagcctgggcaacatggtgaaaccttgtctctacaaaatacaaaaaaaaggccaggggcggtggctcacgcctgtaatcccagcactttgggaggctgaggcgggtggatcacgaggtcaggagatcgagaccatcctggctaacacagtgaaaccccatctctactaaaaatataaaatattagccgggtgtggtggcatgcacctgtagttccagctactcgggaggctgagacaggagaatcacttgaacccgggaggcagaggttgcagtgagccgagatcacaccactgcattccaggctgagtgacagagcaagactttgtctcaaaaaaaaagctgggtgtggtggcctgcacctgtagttcagctacttgggaggctgagatgggaggaccgcttgagcctggggaggttgaggctgcagtgagccatgattgtgctactacactccagcctgggcaacagagtgagaccctgtatctgaaaaaaaaaataattttaaaaataaaaaatttttttgagcgacaggttctctctctgttgcccaggctggccttgaactcctgggctcaagcaatcctcccacctcagcctgctgagtaactaggattaccggcatatgccactgctcctggctccatttttaacatatcactgttttccttcttccctttccatcaaaagcatggcttggaactcatttctcttaatctgttttgaaatttgtagtttcattcagctgtcttctcttgtaatgtgtgaaaattatgaactgcaataaagacaggatctttggaaagatgagttgtattgtattttagtctacttgtgaaagctgtggatttcagaatggtctttgaagaatactcagcaaaacttcattattgttttgtttagtcttgctttgtgtaaggcattcatggttctggttttgtgagaaaacagcttgtgagcagacccactgtggaggctaggtgggaaggaggtgggtaacatttaacttaaccttgaattatagatagaatttcagtgtgaaaatggtatcactaaatgcttggagatagggaagagtggagcgtatctgaaggatggcagtttgtctgccagttgcatcaaaagatatagaaggaaatattgggacagaagtctggaaaggtggaatattttgaattctcaactgcggagtttgaattcttctcagcagtagagatcttaaaggggaagagaagggatgatatagaatcatcattttaagtgggtataggaccagaaatcattacagctaaacattcaaattttattactatttttattcttatttatttatttttgagacagagtcttgctctgttgccaggctggagcgcagtggcgcaatgtctgctcactgcagcctccacctcccaggttcaagcaattctcctgcctcagcctcccgagtagctgggattacaggcatgcaccaccatgcccggctaatttttgtattttttagtagagacagggtttctccatattggtcaggctagtcttgaactcctgacctcaggtgacccgcctgccttggcctcccaaagtgctgggattacaggcataagccactgcacccagccatttatttatttatttaagatggagtcttgctctgtcgcccaggctggagtgcagtggtgcgatctcggctcactgcaagctccgcctcctgggttcacgccattcttctgtctcagcctcccgagtagctgggactacaggtgcccgccaccaatgcccggataatttttttgtgtttttagtagacacggcatttcaccttgttagccaggatggtctggaactcctgacctcgtgatccacccgccttggcctcccaaaatcctgggattacaggcttgagccactgcacccggccatttatttattttttgagacaggatctctgtcgctcagactggagtgcagtggcacaatcaaggctcactgcagcctccacctcccagtctccagcgattttccctcttcagcctcctgagtagctgggaccataggcgtgtgccaccacacctgactgattttttttatttttattttttattattattttgagacagagtcttgctctgtcgcccagcctggagtctggcacaatctcactcattgcaacctccgcctcccaggttcaagcgattctcctgcctcagcttccctactcttagagtagctgggatacagtcgcgtgccaccaggcccagctaatttttgtatttttagtagagacagggtttcaccatattggccaggctggtcttgaactcctgacctcgtgatctacccgcctccgcctcccaaagtgctgggattacaggtatgagctaccatgcctggcccttttatttatttatttatttatttatttttatttatttatttatttttgagatggagtcgtgctctgctgcccagggtggagtgcagtggcgcgatctcagctcactgcaagctccgcctcctgggttcacgccattctcctgcctcagcctctccgagtagctgggactacaggcgcccgccaccacgcccggctaattttttgtatttttggtagagacggggtttcaccgtgttagccagatggtctcgatctcctgacctcatgatctgccctcctcggcctcccaaagtgctgggattacaggcgtgagccaccgggcccagcccatttttattttttgtagagataggggtttccctatgttgcccaggctggtttcgaaatcaaatggtcctcctgcctcggcctccaaatgtgctgggattacaggtttgagccacaccatatggctgaaacttctcgattttatagtcagaagtcagcttcaccgtaatcccagcactttgggaggccgaggcgggtggatcatgaggtcaggagttcgagatcagcctggccaacatggtgaaaccccgtctctactaaaaatacaaaaatcagccacatgtgttggggggcgcctgtaatcccatctactcgggaggctgaggcaggagaattgcttgaagctggaaggcagaggttgcggtgagccgagatagcgccactgcactccagcctaggcgaaagagcgaaactccatcttcttcaagtctgcttcacaaagagcttgttttactgaattttgcagtgtaattaggacttggctttaggaagaataatctaagtggtatttaggttagttgtaatcctaaaagcataagtaccaattagaagaggccattgtaatggctgaggaaatgagaattaaagtcctaaattagagtggtggtagcaaaaataagagagttgtagtgtgagtgcatggttttgaggtttttgtttgctttccagttgcttaagctgtaagatcatgcatttcttatttattctttattcatcgtgcctggcagagtgcttgtcacattgaaggtactcagtaaatatttgttgaataaatgattctgtaaagaaaacttccttaagaaagcatgattccactgtactgaattgcttttggattttttttctatgaaaacctgattttggttgtgaagaaaaaaatagaccagttcattagcgtaatttgctaggcattacacaagacattgggagatacaaactgtttagaggtgatatatgctgtggtaaacgtatggtgtgcatgcagagtggggagtactgaacttgtttccgtgttgaggagggcttacagaggctgtaacatgtcgtctgagttcctgtgaagagaaagtaggagtttaggatgaaggttgtctttgataaagagattagcatgtattgaaagacttatattttaggctggatgcagtggctcacgtctgtaaacccagcacttcgggaggtcgaggcaggaggatcccttgaggccaggagttcaagaccagcctgggcaacatagtgatgcctcccatctctacaaaaaaaaaaagaaagaaaaaaacagaaaatattagctgggtgtggtggtgcctgagcccaggagcctatgattgcaccactgcactctagcttaggtgacagcgagacattgtctcaaagtcttagaactaggtttcctctaattaggacattgtagggtagcatgtgtcaaagggctggagataagtgagaaaatagttagctaagttgaggtagtagaggactttgaggtttggactttaggcaggcaggcagggccatctaaagttttaataggagagtggcatgagcaggtgcatatgaggaaggtaatcgatggcagtgtggggaggatgtgtaatagttgaagttgagaaatgaggagggtctgtattaacttcagtggaagtagattggcatgaaagttagtgtcactgccttttcatatgcgccctaacttacagtagctctaaggagcctgattactaaaaaaaaagggggtctttctgcacgtgagtttatttcttcctccttacctcccttcctttcctctgttgctctttgttttctcctttatggttgggaaaagaagtaaagcacaaagaatggagaagaagaaaatgtgaaaagcatagtaaaaggagagagagatgtcaaattcaagattaaaaaaaaaaattttctttttgagatcagggtctcaccgcgttacccaggctggtggagtgcagtggcttgatctcatctcactgcaacttccacttcctggtctcaagccattctcccacctcagcctctcaagtagctgggactacaggcacacaccaccacgcctggctaatttttgtgtagacaggatcttccatgttgcccaggttggtcttgaactcttgggctcaagtgattggcctgcccaggcctcccaaagagctgggaaaattcaggatttttttttttttttttgagacggagacttgctcagtcaccaggctggagtgcagtggcgccaccttggctcactgaaacctccgcctcccaggttcaatcgattctcctgcctcagcctccgagtagctgggactacaggcacatgccaccacacccggctaatttttgtatttttaatagagatggggtttcaccatgtgttggccaggatggtctcgatctcccaaccttgtgatccgcctgccttggcctcccaaaatgctgggattacagacgtgagccaccgcgcccagctccaaagtgctgggaaaattcaggatattatcttgtcagttaagattgcctgtaactcagtctcatttcccttgaagaaaatctggcccactaaaataaatagttaaacgtctgagaggcttttaacaaaaaaccacatttttatacctggtcagagtaacatcacgcaaatcactaatgtaaacatgaactaggtgttaaatgtcttctctcattgtccataaaattttttttattgctgatttgtggatccaacatagggatcattcattgcatctgattatattccttaattctcttcaaatctagaatagtgctgacaccagtttgttgaaggcaacaggccagtttacttgcagaaaatcccacattctcattttatctgattgctcctttggtgtcatttggccagttcctctagttttcaaatcaaggtgtaaacattactgacgtgtgtttcatactgcaccacatcaagagaccccaatatctggttcttcctccatagtattggtaagattggtgaagggggtaacaatttattcctccattaaacgttttctaccttatgatcagaaagtaatctatgtagaatctgtgtagtggtggcttttagcatttcattaatgccaatattcatctaatgcttttaacccagtataatcctttttgttttttctaagggtttcactcctttcgctcaggctggagcgcaatggcgtgatcactgcccactgtagccccgactttcctggctcaggtgattctcccatctcagcctcccaagtagctgggatgtaccaccatgcccagctaaattttgtatttttagtacagactgggttttgccatgtttcccaggctgatcttgaattcgtgggctcaagctatctgctcacctcagcctcctgcagtgctgggattacaggcatgagccactgtacccggccgtttttataatccttgaataatgtcgaatgggaattataaaatgatgttgcttgaaaaaaattctttcatacttaatttattagctatcattgttttgtaaagtagggctttttttttcttttttcttctttttttgagacagtctctctcttttgccaggctggagtgcagtggcgcgatcttggctcactgcaacctctgcctcccgggttcaagcgattcccctgcctcagcctcctgagtagctgggactacagacgcctgccacaaagcccagctagtttttgtatttttagtggagatggggtttcaccatgttggctaggctggtttcaatttcttgacctcgtgatccgcccgcctcggcctcccagagtgctgggattacaggcgtgagctactgcgcctggccgagtagaccttttcttaaacgagggctgtttgattacactgaatccagttgctgctgaggtgtaaccacttaaatctttctttttagttacgtgtctccatattgtaatagctgcttcagatagtgactgacttgcagtccatatgctgtctcttcccccatctccccctctctcctcgtcttgattactatagtagtttcgtcttttacatcattgccagctctttttttgcagcacagaaaggattatgttatctctcttttgttttggcttgattttttgaggttctcatagatttgtattgattcagtgtgtttcatttcattgtgattatgattcttactgctcaaatggtcatagtttgtcctgtgaggaccccttctagctggcttctgtatcatgttgacatgatgactccattagacttagctttttggcactgaaagatgtcccaggctcattttatacatttcctgcccatcttttgattggccattttacaaagaactttgctttcttggtattagagcttgaaattgagagtttaggagtgccattattccggagataatattacttctgcaacacttcagtagatagaaataaattaaatcacaagtctatattgatattctcaagccagttttagtatttgtgtgtgtgggggggaggagggagttgatgggggaagggagagacaaggtctcactctgtcacccaggctggagtgcagtggtgtgattgtagctcactgtagccttgacctcccaggctcaggtagtcctgagcctcaggtggcatgtgccaccacacctgggtgatttctttttagtttttgtagagatgagggaactccctttgttgcccaggctggtctcgaacttctgagcttgagcaggcctcctgccttggcctcccaaagtgctgggattactggtatgagcctggccagtgtttccgtttaatttccttgatttataaacgcgctctttctctgaaaatcttggttccttttaatttaacttaatttagttgtttaaaacattttcttgtagagacgagttcttgccatgttgcccaggctggtttcgaactcctgggctcaagtgatctgcctaccttggcctacaaagttctgggattacaggcgtgagccatattgtccaggttgtcttgggttcctaagatgaagctaaaatgagctactgagagaccaactttccagagtttattcaggaatagcagggaattgtaatcagggacacgtgtgctgtaaggaatcgtaggtgcatccagagaggttggggtaagaggaaacttttaaagacaaagaggaagtccaagtaagttgttttgaaacaaagactgttggttacaagggcttattgcaggagttgatgttggttcattggtagagaaagctgtgtcaggcaattgtgcaagcaggttatctgggacactgccattttgaggaattccttgcatagtgaggtctccatttggttagagcttgacattagtcactccattttgatactgataacttttgcattaatgtcattaacaatgtgataatgagtacttatttagcaaaagttcgtgggctgtatgtttccttagtaattgctcatctggaaaaagtcctttcatctggccaagtgttagaatatagaatattttttagttcaggtaaaatttacataaaatgcaatgtacatgtacaccttaaatgtataatttgagtcttgataaatatgtatatccatataaaccatacaccaattaatatattgaatatttccatcactataggggcaaaatgttctgatttttatcgccacaaatacatataaatggaatctcttgggtctcttatttaatgtttgagattcattcatatttgtgtgtatcagttaatcgattcttttttttttttattgttcagtagtatttagtggtgtcaatatgttaaaatttggttatccatttgctttttttttttttttccctgaaaaggaatctcgctctattgcctagctggagtacagtggctcaatctctgctcaccacaacctctgcctcctggattcaagggattctcctgccttagccccttgagtagctggaattataggcatgtgccaccacatccagctaatttttgtatttttggtagagacaaggtttcaccatgttggccaggctggtcttgaactcctgacctcaagtgatctgcctgcctctgcctgccaacgtgctgggattataggtgtgagccaccgcatccagcctatccatatactattaatgaacatttagattttcagtttttggcaattatgaataaagttgttatgaacaactatattgtcaacctgaaataattgaaatgatcagaatccagtttcaaagagtttttaaataagagtttttagatgaacatctgggaatgactaactggggaatatggactccagagcactgggatctgggcttcaaagttaaaagttaagggcctgggccgggcgcggtggctcacatctgtaatcccagcactttgggaggccaaggcaggcagatcaccaggttaggagatcaagaccatcctggccaacatgttgaaaccccatctctactaaaaatacaaaaattagctgggcatggtggcgcctgcctgtaatcccagctactcgggaggctgaggcaggagaatcgcttgaaccagggagtcagaggttgcagtgagccaagatcacgccactgtactccagcctggcgacagagcgagactccatctccaaaagaaaaagaaaaggtgccgcttatttatataggcaggaaacaaagacatttaataggattacaacattttctctgcaaggttggggtttatgagttacaacagtttagttacagattgttttcttttccatatagcttgtttgttttttctttccaagagtgtgtttaacattccatctttttattttttattttattttattatttttttttttttggagatggagtctctttctgtcgcccaggctggagtgcagtggcgcaacctcagctcattgcaacttctgcctcctgagttcaagcaattctcctgcctcagcctcccgagtaactgggactatgggcacccgccaccacacccagataatttttgtatttttggtagagacagggtttcatcgtgttgctggtcacgaactcccgagctcagacagtccgcctgccttggcctcccgaagtgctaggattacaggtgtgagacaccgcgcctggcacattccatcttccaaaaatgtggtagtcatgaagtttttgtgtgaaagaggaggaaagagggaaattaatctgtaatgaatatcagcagttaagaggaagaggaaagacatcttccctggcactcactggttagtcatttacgacattttacagaacaatgtaggtaagaaataaggtaatttataatcagagaagcaaaagctacagctgcctaggttacagttgcctgtttaagtgactcaggtttcataatcacattctcttaaggctcaaaatatttaacaagttccaacagcctagattttgaattacttatttttgcaatatacatatcttttggggtgtgtatattttcatttcttttgggtaaatactcaaaggtatatgcgctgacttacagactgagtaattacttttttaaaatagtttcaagttttattttagatccaaggggtacatgtgcaggtttgttacatgggtatattgtgtgacattgaggtttgggacataaatgatcccatcacacaggtagtcagtacattctcagcccttgcactcctttccctctcctccctctaatagtccctagttttattgttcccatgtttgtgtccatatgtacccagtgtttagctcccacttacacagtatttggttttcttttcctacgttaattcacttaggataatagcctccagctatatccatgttgctgcaaaggatattatttcattcttttcttgtggccatgtagtattccatgatgtatatgtgccacattttctttatccagcctactgttgatggcagctaggttgattccatgtttttgctattgtgaatagtgctgcagtgaatataccagtgcatgtaccttttttgtagaaagatttatttttctttgggtatagaaccagtaatggaattgctgggccaaacgggtagttctggttttttatttatttatttttatctgtctgtctatgtatctatctgtctattgagacagagtttcactcttatcaccgaggctggagtgcagtggtgtgatctcagctcactgcaaactccatgtcctaggctcagacgatcctcccaagtagctgggaccacaggtacatgccaccatgctggctaatttttgtattttttttttgtagagatggggttttgccttgttgcccaggctggtcttgaattcttggctcaggtgatccgccctcgtaggccccccaaaatgctgggattgtaagtgtgagccactgggcctggcttagttctatttttagttctttgagaaatctccaaactgtttttcacaatggctaaactaattacattcccaccagcagtgtataagtgttccctttttggggcagcctcgccagcatctgttagtttttatctttttagtaatagccattctgactggtgtgagatggtatctcgtggttttgatttgcatttttctgtttagttatgtggagcattttttcatgtttgttggctgcttgtatgtcttgttttttgagacagggtctcactcttgcccacgctggagtgcagtggtgttatctctgctcactgtggcctggacctcctgggctcaagtgatccttctgccttagctcccaaagtaggctgaggtgggagagggcatggaagctctgcacccctgcgctgttcctcaccctgtatacaacttcatctgtctgttcatctgtatactttaccatatccttataacgaaccagtgaatgtgtttgcccgcattctgtgagccgttctaacaaattaatccaactccaggagggagtgttgggaacccagctttatagccggtcatcagaagtgtgggtgatgaccttacttgtgtctgaagaagagaggggcagtattgtgggactcagcccataatctcagtgggatctaactccaggtagatactgtcaggattgaattgagctataggacactcaggtgtgtggtatatgctggagaattgcttggtgtgtggggaaaaaccttcacacatctggtcacaagcgtttgtgttaagtgtgagcatagaggaaaaacagtttgtcttttacagttgcttctcaggtaccccttttcttttccccttagatgttcattttgaaggttaagtagagatggcttttcttttgcttactggggtggggcagggggttgtggcatatctgctggttaggggctgttaggatgggtggatttcagttctggtttttactattttgtaactacaaatccttttcccaggggcacactcaaatgtttgattgtccctaatttcactgaacatgtttgattcctgactgaaaaatagaccagaggctctccccctttcttagggttctcttttcaacaactatttcttttcacctctctcctaaccagaggaggttcaaatatatttaagtgctttaaatgtaactttttctgcttggtctttgtgggtatcttcattccagttggttttcttcactttcatttcttttcactttacttcatattctgctaagtctcttataacccctcactgtgattcctatccccagctcccgctaacccccagcatttctgcaagtgtgaagtagactggattcctgaaggttttttttctccctctagattctggcagacattcaaagtttatggtatacgtgcaggccgctctttaaatgttcctggatagtcttttcatggtttgtaattctgctttgcaccactaactttcccaggatggccataggttttgtatgtttaagctgtttcataagcagatctgaaagcatgtctttctaataaatacaaggaatgttttgtgtttctttaagtgaaataattattctaagatcatgaaaaagtgctctgagaaccgaaacaggtagagatttttgtttgattgtgccaggatcagtagtgatgtctggcatttgattggtaagatgttaactagttaggtgctatatgcctgctgactcttgactctggcctagctattttaaaaaaaattcttttgtaattcttgaaagttttcaggtgttttttggaatacttttattattttaggtagtaatcttcagtgacatactatactttttagagagcaagaagtacttgttgatttcacagccttgggaaagatcctaaactgcatgtattcctatatcctttcctttacctaatctgcagtgctatactttgttagactcccagaaaaatggattgggtttttcagtgggcatatgtccaatttgctatgtttcttttattctagccttttttttttacttcctaattctcaatctcagagatttggaaaatagagaagcactgaagagatcttcagtgccttggggcttaaaatgatgagtactttaaattttaagacagccagtctcacaatacgaaaaaccaagaaagggaatggttggctgcctaggtggaaatcaagactgtttgatagaatgaccacaggtacagggcatggttttcagatttcttagtccagtaacacttcctgaagtatgatcaaactgaacattgattcacactaagcttacatgagattgataaatcagacttctgaactttcatcaataattctaatgattaataggacaaaaatactaatctcagctggtcagagcaatttcttaccattattaaattctatctgggaaagctaatgaagatcagatagttactttgtaagtggagtctggtcagaacagtggcatttaggtgatcttaagggatgctgtcatcaagctctggtagcatagaacagagcattttatattttctaggttattactgatacatgcgtgtcattcagaaagagcactttccttaccatatggttctctagacagaaggagcacttctttgtgtttgttcttttgtattgaatatttttttatccgtctaaaaacagcagttattatatttctatattgaagaaactaacgtataagaccagtttgttttatctcaccatttatattcttaagaagctttttaggattacttacttccttctgtgctttgattaaacagtcaaaacccatttctatgtttgaaaagtaggccgggtgcggtggctcatgcctctaatcttaacactttgggaggctgaggcaggtggatcgcatgagcccaggagtttgagaccagcttgggcaacatggcgaaaaccaatctctacaaaaaaaatacaaagattagcctggtgtggtggcgcatgcctgtagtcccaactacacgggaggctgaggggaggatggcttttgagcctgggaggtgaaggctgcagtgagcagagatggcaccatcgcactccagcctgggtgacaaagtgagaccctgtctcaaaaaaaaaaaaaaaaagtagttctatttcctgtcagcagggaggcagcatagcataattaaagtagctttaacttttaatcagactcatttaaagcctgactctgctgtttcccagccttgtaacagtgggcaaattgcttaaaccattttgagtttctgttttctggtaaaatggagataattgcaactctgcaggaagaactagaaaaaactaaatctaaagagttaggaggaaaaccaagaaaaccgatatcctggaagccaagcagtgtgtttctaggcgggggcgatcatctatatcaaatgctgatcataagcaaaaagaggtcagagaagtgaccattggaaataagaatataagatcactgggtttcttcttttaaaaaaaaattaaaaacaaaatatttttagagacagggttgtgctttgttactcagagtggagtgcagtggcatgatcatggctcactgcagctttgaactcctggactcaagtgttcctccctccccagcatctcaaagccgttggggttataggcgtgagccattgtgcctggctactgggtttcttcttgatagtttttggtgaaaggttgaaaacacttacgaacttgaatgggtttaactgggaggagaaggcagagaacatacacaattcctgaggattgtttttgctatagagagaatgagagaagcaaagtagctggagcgagaaatgaacttaagactttttaatagaggaaagaatagcacatatatgtgtgctgaaggtaaagatccaggagggaggcataatgtgatgagaggaaggaagggattgccagagtaatgtccttgaataggcagaatgagggggtggatcgaattgcacaaatggcttacgtgctaagggcagggatagatgggcataggtgggagttcgtagaaagggcccttctggcattctgtttcactgcgaaagtcaggtcatcagctgagagggaggatggaggagtaggtgttagaggtttgaagacagaagtcatctaggagaaggggatagactaggaatttacagtattatttctgggcagtatacagagtctgaggaatgattgctgactggctcactttaaacttacatggtcataggcttttctccagctatgtttagctgcatgggtatacagagtaggtagacaattggttaaaccaggattatgatttatccaaaagaataaaagcgagacaagaacaagggctttgagggaatatgcatgggagtgatgttttatttcacctaaatattttagaatgtatctataatggacaagaatttaaaaaaatcacatacaaccgtaaaactttttttttttttttttgagacaggattcactgtcgcccaggctggagtgcagggacacagtcacatcttactgcagcctcaacctcctgggttcaagcgatcctcccacctcagcctcctgagttgctgggactatgggtgtataccaccatgcttggctaatttttaatttttttggtaagagatggggcccagggtggtgctggtctcaaactcctgggcccaagcctcacaaaagtgctgggattacaggcatgagccactgtgcctgaatcacaatacttgtttaatattaactgatatttagtctatcttcaggtttctctcattttcaaaatcagaaaaaccagatttgtttaagttggaattaaacaaggtctgtacattgcatttgattgctgtgcctcttaagtcatttattccatatgtttcattttactcctctttttcagaccattgatttgttcaagatatttggtcttttgtcatctagaacttctgtattctgcgtctggatgtctgtattcttgtattatttttactttaaaaaaatttttaattgtaaaattcacaacatgatagttactacataagcaagtgtaacgttctgtagtattaaatacgttcacatggttgtgtcctgtggtgttattttaaacacgttcctctagatcccttactttgtgtaaactagtatcagatctagagaggctggatttgattcaggttcagtttttaactttgttggtgaggggtcaaggacataggtggtttatgtgtacttctcatggtgtcttattgggaagcacgtaatgtctggttgtcctaacgatgagactgatcattgggtttaggtcttgtagcccaagggttctcaaccctggtactcgtccatggcctgttaggaactgggtcgcacagcaggaggtgagcggcacgtgagcaagcattactgcccaaggtccaccccgtcagatcagcagcagcaatagattctcataggagcacaaaccctcttgtgaactgcgcatgcgagggacctaggctgtgcgttccttatgatgcgatctaactaatgcttggtgatctgagatggtacggtttcatcccgaaaccaccccaccctccccaaatctgtggaaaattgtcttccacgaaactggtccgtggtgccaaaaaggttgggaaccactgttgtagcctgactatccatttaaaaattttccactgattttttttcacacttaatggttttattaaccattgatcattgcctagatccattattttcttagagattgtaaactgattattttctaattatgtaactctttttggatttattagctagaattctgttaaaaacagtcactcacctagtttctgccagaaatgcaggataaatgtttgattcttttattatttatttatttatttattttttgagacggagtctcgctctgttgcccaggctggagtgcagtggcacgatcttggctcactgcaagctccacctcccgggttcacgccattctcctgcctcagccttccgagtaactgggactacaggcgcctgccaccatgcccggctaatttttttttttgtatttttagtagagatggagtttcaccacattagccaggatggtctcaatctcctgacctcgtgattcacccgcctcggcctcccaaagtgctgggattataggcgtgagccaccatgcctggccgattcttttattttctaattttcaggtgactgagttttttgatttttagataaaattatgaattcatgaagttcatgatgactcagttgcagtcatttttctgatgttcagattgtctcatagttggtcagtggaagcttcttcaagctggcttctgtgtcccccacagctgctgcacccttgttagcttcacagcttgtttgtatctgtcttgtcctgtgcttggaataatcaatttctgcaagaagctcctagtttctttcagtgggaaatggtagagattgtaatatgggtgtccacttttaaaagatgtgggtcgggcatgctggctcactcctgtaatcccagcactttgggaggccaaggcgggcggatcatgaggtcaggagttcaagaccagcctggccaatatggtgaaaccccgtctgtattaaaaatacaaaaatgagcccggcatggtggtgcacgcctatagtcccagctacttgggaggctgaggcagaagaattgcttgaagaggttggagtgagccaaaatcgtgccactgcactccagcctgggtgacagagtcagacttcgtctcaaaaaaaaaaaaaaaaggtgttgtggcttttgtttatttgattttttagaatactgattggtttcttttcttaacaggcatgcccaaagaaaaatacgagccccctgaccctcggaggatgtatacaattatgtcttctgaggaagcagcaaatggaaagaaatcccactgggcagagcttgaaataagtggtaagacatggaagcatgaatttatggtatggaaattaagatatggtagtaaactgagttttctaatgccaatacaggaaagaaacattgattttatattttacaaatgtaatgtatttataaatgattgtattttagtaacttatcttagaagcaggaaggttcaatgaaaagaatatgatttgagtcaaagttcaaaagccattcattgaatattttctcagtatcagtgtcctcttacaaaatacataaatgtaaaataataacaaggatgaaatgaaaataacacatgtgaagtgctagtgcccagtcacgtatttgttctggtatttgattctctgataaagtaggattgagcttttgcattgtcaatgatagatttctggtggggtaggaatggctgatctgtataggttttgggtaggtttgtttctccttattttcttcattggcttctgagtctgagtcactgaggacagccttattcagaaacacaaaatcttaagagtttgaagaagatctcaaatttcccttccccttttaatgcaatctggacatattcaaagaaatatatgagccctcagatgtgaaggatatcctttccccagcatctctgccagtgggcacacagtctctttttaaatattttgaagatggtgaagggacattacttctcagggcaaccagtgctaatgaagttttgtgttactgttggcctattatgcttccccttactttcctttcagtttgttctgatttttgccttctaaaatagtacagaacaaattttgtcgtctttcacctgaccgcccttgatttttaaaaatttaatgcagcagacatactgagcatatgctgtgtgtaaaacattttacctggcgctggcccacgtgcgtggaagatctataaagtcccgctttttatggagcttatgacattagggagtgagagggagtgcacaagtataaataactaatagacaaaacataacaaatctaggtataaaagtgctatataacaggaagcaaaaaggaaataaggataatagcattcctcctttgtcagctcaaaatttctggttaacctgttgagtaaacttaaatgcctgcctttgcagccatagtagaggtcagtacacacacgggtctctcctgttttccctcttctgatttcttttttttttttttttttagtttttattgatcattcttgggtgtttctcggagagggggatttggcagggccataggacaatagtggagggaaggtcagcagataaacatgtgaacaagggtctctggttttcctaggcagaggaccctgcggccttccgcagtgtttgtgtccctgggtagttgagattagggagtggtgatgactcttaaggagcatgctgccttcaagcatctgtttaacaaagcacatcttgcaccgcccttaatccatttaaccctgagtggacacagcacatgtttcagagagcacggggttgggggtaaggttatagattaacagcatcccaaggcagaagaatttttcttagtacagaacaaaatggagtctcccatgtctacttctttctacacagacacagtaacaatctgatctctctttcttttccccacatttcccccttttctattcgacaaaaccgccgttgtcatcatggcccgttctcaatgagctgttgggtacacctcccagatggggtggcggccgggcagaggggctcctcacttcccagaccgggcggctgggcggaggcgccccccacctccctcccagctggggcggctggccggggcggctgccaggcagaggggctcctcacttcccagacggggcggctgccgggcagaggggctcctcacttctcagacggggtggccggtcagagacgcttctcacctcccagacggggtagcggtcgggcagagacactcctcagttcccagacggggtcacggccgggcagaggcgctcctcacatcccacacggggcggcggggcagaggcgctccccgcatctcagacgatgggcggccgggcagagacgctcctcatttcctagacgggatggcggctgggaagagacgctcctcacttcccagactgggcggccgggctgaggggctcctcacatcccagacgatgggcggccaggcagagacgctcctcacttcccagacggggtggcggccaggcagaggctgcaatctcagcactttgggaggccaaggcaggcggctgggaggtggaggttgtagcgagccgagatcacgccactgcactccagcctgggcaagattgagcactgagtgagcaaaactccgtctgtaatcccggcacctcgggaggccgaggcaggcagatcactcggggtcaggagctggagaccagcccggccaacatggcgaaaccccgtctccaccaaaaaatgcaagaaccagtcaggcgtggcggcgcgtgcctgcaatcccaggcactctgcaggctgaggcaggagaatcaggcagggaggttgcagtgagccgagatggcggcagtacagtccagcctcggctttcacaactttggtggcatgagagggagaccggggagagggagagggacccctcttctgatttctagaatgctggactttattaaaccaagttcagctcagtaagtaggtgtggtcatggagagtgaaatttctcttcttctcacctgtcagatttggctttctgtgccaggggagcccaaagagaaatatgcactaattttgtagttattctcaaagcacagtcagtcaccactcctatttttcccttttaattttttcaggattggcatttgactatatttacctctccttttttcagcccttattagcagtttttgcattacaattcctttgcttgtaaggaagtgtcccctatcttacagcattaggatacgcaagaaagcactcaggtcattgagatacatctctgaggctgaggagattctcctccaccctctcctccttccaccacatgctgtgaactccttggtgactttgagtcactgttctctgcttaccctgaactttgggaagaagttctgtatacacatatagggaaaaaccctcaacccatgttttttctttgctctcacaccaccacagtcatcaacacaaaagaagacttctgtgaccaaaggtgtgggtttcttttccccacacagcaagcagcagacaccagttaggtgccctccaattcaattccaacactgtcttcctggaggtagcatcagatcccacggtttgtggactcagtccccaagactgccctctcccacttctatcaccagtcccatgtttgggcctctagagctttgaccagcttcaggttggggttcccacgaccccctctttgggttcagttaatttgctggagtggttcacagaactcagagaaacatctacttacgtttaccagtttattataaaggatattacaaaggatacagatgaaaagatgcacagggcaaggtgtaggggaaaaagtgcagtgtccatgccctccctgggcacaccacccttcaggaggaacctcgtgcattcagctatctggaagctctctgaaccctgttctttcgggtttttatggaggcttcattacataggcatggttgacagctgtagaaatgtgattattagacaagcaaggcatgtctgctcagacttttcttgggctgtgtagcattccttcttctaaggtatggggcaggaccctctctggaatgacggtcttctgacccacagtgagattagagtcctgccttgggcaggggaaaggaggataggagaaggtcatagatcctgtttcctgaggccttaagcactctaacattataacaaagactatgggagttaggaaccaggaaccatggatgaaaacctatatatatatatatatatatatatatatatcaccgtaatacaacataggaaggaagaggggagacgcctctaaagtaacctttcttaatttattgttattattattatttagagatgaggtcttgctctgttgcccaggctggaatgcagtggcatgattatacatagcttactgtatccttgaattcctgggctcatgtgatcctcccacctcaccctcctgagtaactgggactacagactcatgccaccatgcccagctaacattttaaaaattttccttagagataggggtctccctttgttgcccaggctggtcttgagctcctggcctcaagcagtcctcccgcgttagcctcccaaagtgctggtattacagacataagccaacttacttagcccagattggcttctttaacttatttatttcatttttatagatttaggaggtataagtacagttttcttttttatattttaacaatctgtttattatttatttatccctccatagaaccaccactcacaccaaggagattatttggagtgggtcaccacctggggcctggactctgaaatctaaggcttcctcctccctcactttatggcttaggtggtggcatggttcaggcaaaactcgtgtctccttttggatactgcagaagcaggacctaagcatacccataaaggtggccacacccatcagggttgattggcaggctggaagacaatattctcccaatgaaggcacttttacctctataggggggtgggaattggttggttggaagtggtggtgttgggacagggaagagttatttccatggaaaacttatttgcaggttacagagagaaatgaggggagtttgcctacactgggccatctgtggggccagtgggggctgctgtatatcttgtatatctttgctaccgaaaggggaaggttgacgtaggcattaaagccaaagaggcccttagcaattaggcccagtacccctgcgatgattttggagtggttttctttctcaacattgtcgataatggaggtgattaggtagaggatcactgctaagagggtttggaagaaatgactccagggccaattgatgaatggtattttggtgtgcagatcacacacgtagctgacaaagtagcagcaagtatcatttcagccaccaacagggaggaatagtctggtgtggaggcacttgaagtagatcaggatcaccaggcacaatgtaatcttagcaaacctggaggattcccttttgggtgcgcaagaagttggcctcagcagcgggggtccgagaggccctcggaatccaccatggcatgggccggagtcgctggggtccgagaggccctcggaatccaccatggcatgggccggagtccctggggtccgagaggccctcggaatccaccatggcatgggccggagtccctggggtccgagaggccctcggaatccaccatggcatgggccggagtccctggggtccgagaggccctcggaatccaccatggcatgggccggagtccctggggtccgagaggccctcggaatccaccatggcatgggccggagtcgctggggtccgagaggccctcggaatccaccatggcatgggccggagtccctggggtccgagaggccctcggaatccaccatggcatgggccggagtccctggggtccgagaggccctcggaatccaccatggcatgggccggagtccctggggtccgagaggcccttggaatccaccatggcatgggccggagtccctggcgacgcagaagatgtgctcactgattcgtggggtggaggacactgcacacccagccatctggctaggaagggggcgtctggggcagagggagtcacaagtacggttttcttaccggatatattgtgtagtggcaaagtctggccttttagtgtactcattgccctaatagtgaacattgtacccaaaaggtaactttttcacctttttcgccctcccgtgttttggaatcttcagtgtctgtttttccattctgtatgtgcatgtgtacccattgtttagctcccacttgtaagtgagaacatcggtatttgactgtttctgagttgttttgcttaggataacggcctccagttctgtccaggttgctgcacaagatatgctttcattcttttttataactcagtagtatttcttggtgtatatatacactgcattttctttatccagtcatccattgttggacacttaggttgaggccgtatctttgctattgtgaatagtgctacaatacacgagtgcaggttatctttttgacatgatgatttctttccctttggggatacccagtagtgggactgctggatagaatggtagttgtatttgtagttctgtgagaaatctccatactgatttccatacaagttgtactaatttacattcccaccaacagtgttcaagcgttcctttttcttcacatccttgccagcatctgttgtttttgactttttaatagtagcctttctgagtggtgtaagatggtatttcattgtggttttaatttgcatttctctgatgattattgatgttgagcatttttttcgtatttgttggcaatttgtcttttgaaaaatattgtttcatgttctttgcccacttattagggtttttttttttttttttttttttttttttgacagtctcactctgttgcccaggctggagtgcagtggtgtcatctcggctcactgcaagctctgcctcccacgttcacaccattctcctgcctcagcctcctgagtagctggtactacaggcacccgccaccacacccggctaattttttgtatttttttttagtagagatggggtttcaccatgttggccaggatggtctcgatctgctgaccttgtgatccgcctgccttggcctcccaaagtgctgggattacaggtgtgagccaccgtgcctggcctagggttgtttttttcatgttgagttgagttccttgtagattctatatagtaaccctttgtcagatgtgtagttgccaatattttctctcattctgtagtgttaattatcattattattatttttgctgtgcagaaacttcttaatgtaattaagtcccatttatctatttgttttgagataagatatcattgttctgtggcccaggctggatggagtggtataatctcaaactcctgagctctagtgatcctcctgcctcagcctcctgagtagctgggactacaggtgcacacaaccatgcctggcttttttgttttgttttgttttggagacaggatctcactttgtcacccaggctgtagtgcagtgatgccatctcggctcactgcagcctcgacctcgtgggttcaagcaatcctccttcctcagcccctcaagtagctgggactacagtgcatgccaccatgcccagctaaaggcaagtttttatattttaattttttgtagagacaggggtcttgtgtttcccagcttggtctctaactcctggcctcaagtgatcttcctgtcttaattttacaaaacactgggataacaggcatgagccactgtgcccagccagcttctttaacttagtaatagatgtttatgttttctctgtgtcttgtcatggcttgatagctcattcttttttagcactgagtaatattccattgtctggatgtaccagtttatttacccagtcacctactgaaggacatcttggttgcctccaagttttggcaatttttggtaaagctactataaacatctgtgtgcagttctttgtgtagacattaagttttcagctcctttgggtaaataccaacgaggcatgattgctgaattatatgggaatagtgtgtttagttttgccaaaaagtaccaaactgtattctaaagtggctgtatcattttgccctcctaccagcacatccttttccggatttggtggtgttagtgttttggatttttttgccatcctgataggtgtgtagcagtatctcgttgttttaatttgcggttctctaatggcatatatattggccatcttttcatatgcttttttgccatgggtatatctgctttggttaggtgtgtgttcaaatcttttgcccgtttttaaattgggttgttttcctattgttcagttttaagagttttttttttaaacttttaaaaaatgcggatatgtcttttgcaaaaatatctcccggtctgtgggttgtcttactcttttgaccgtgtctttcacagggcagaagtgctgaatttaaatgggactttgggattctgtttagtctatatatcaaattaggaagaacatcttgacagtattgtgtcttcatatctgtgaacatagaatatctccatttatttagttctttgatttcttcagaattttgtggttttcctcatatataatttgtaaatatttagttagatttattcctctttctctctcttttttttttttttggtgtaaatggtgtatttttaattctgaattccatttgttcattgccagtgtataagaaagtgactaacttcagatcttttaagtattcgcttatttgtgatttaaataagttttaaggctgggtgcagtgtctcacaccagacccagcactttgagaggccagtgtgggtagattatacagtagaccagcctgggcaacatggtggaacatcatcttttttttttttttttttttttgagacggagtctcgctctgttgctcaggctggagtgcagtggctggatctccgcacattgtaagctccgcctcccaggttcaagccattgtcctgcctcagcctcccaagtagctgggactacaggtgcccgccacaactgccggctaatttattgtattttttagtagagacggggtttcactgtgttagccaggatggtctcaatctcctgacctcgtgatctgcctgcctgggcctcccagagtgctgggatgacaggcgtgagccaccgcacctggccggaacatcatctttattaaaaaatacaaggattaatgtagttaattctcatttaatcccttcttaggccaggcgcggtggctcacgcctgtaatcctagcactttgggagactaagggaggccgattacctgagctcaggagtttgagaccagcctgggcaacacagtgaacctccgtctctactaaaatacaaaaaaaatttgccgggcatagtggcgtgctcctgtagtcctagctagtcaggaggcctaggcaggagaattgcttgaacccgggaggcggaggttgcagtaagccaagattacaccagcctgggcgacagagcgagactctgtctgagaaaaaggtatatatatatatatatatatatatatatacaaaaaaattagccaggtgtggtagtgtgcaactgtggtcccagctacccaagaggctgaggtgggagcattactttactttagcccaggaagtggaggttacagtgagctgagatcgcaccactgtactccagcctgggtgatagagtgagaccctctctcaaaagaaaaaaaattgtctgggtacggtagcttacgcctataatcccaacactttgggaggccagggcaggcagatcatgaggtcaagagatggagaccattctggccaacatggtgaaaccccatctgtactaaaaatacaaaaaatgagctgggtgtggtggtatgtgccagtagtccctgctgctcgggaggctgaggcaggagaatttgttgaacccgggaggcagtggttgcagtgagctgagatcatgccactgcactctagcctagcaacagagcgagactccatctcaaaaaaaaaaaaaaaaaagtcagccaagcaggaggattacttggactcaggagtttgaaagcaccctgagcaagatggcaaggccccagagtgagaccctatctctttaaaaacaaacaaacaaaaaaaaactgcatttcctcctccttaaatttttttttttgtagttattcattattaggctccttgtagtttagttttcctttactgagcttttctaaattttttgttcttttcttgcttctatcattttttaaatatctttcacctcattttgaaatactaggtaatagttttttgggcatgtttggagtatgcttttatagcaacttattaaaataatttttttgggatttgacttcagtactttttctgttcttttttttttttttttttttttttttttttttttttttttttttttttttttttttgagacggagtcttgttctgtcactcaggctggagtgcagtggtgtgatctcggcttactgcaagctctgcctcccaggttcacgccattctcctacctcagcctcccgagtagctgggactacaggcacccgccaccacacccggctaattttttgtatttttagtagagacagggcttcaccgtgttagccaggatggtctccatctcctgacctcatgatccgcccgcctcggcctcccaaagtgctgggattacaggcgtgagccaccgcgcccagcctgttcattttcatttgaattcagtttttctaaacttagaagatgtgactcagggtagttgtactaatgtctgtgctcccttttctgtagttttcagagtgttcacaactgtgggaacttgctttctgagactttctggttctgttcctctctctcatttttatctttttccttcatcttttttattcctatcctactaattttaattccatttttggagttttttctcagtgtggggccttgactggtcagttccgagggtccctggggcagagactgttggacgcttccattttagacttactgtggacaccctgtactcacttgtcactcattgggactatatcccccttggttgtagtgatgttctgaaactggtgctttccagtgtataccagtgggtttccctttttttagttccattaaacacatttacatttaatgcagttattgatatgattagggtcaaataagtaatattataccatttcactcataaaagtcttacaacaatatacaggcagtctctggctcacgatggttcgccttttgatagtatgaaagtgtcatgcattcagtagagaccgtaattggagtacccatatgaccattctatttttcactttcactacagtattcagtcattacatgagatattcaacacttgattaaaaataggcttagtgttagatgattctgcccaaatgtaggctaatgtaaatattctgagcacatttaaggtagattaggttgagttatgatgtttggtaggttaagtatattaaatacattttcgacattttaaacttacaatgtttttattggaccctaaccccattgtaagttgaggcgcacctgtatttctgtttctcctctcctggcctctatgctattgtagtcatgtatgttatttctccatatggtgtaagtctcaaaatacattgttattttactttaaacactcaagtaataggaaaattggttagtatttttccgtatacttagcatttccaatgtttttcatttctttctagtgcaagtttctgtaattttccttctgacaaaaagacgtaatggggtctgccagtgatttttttgtttttgtttattttttgtattttaggttttatgtctggaaaagcctttctgttgacctatttttgaaagaggtttttgctgagcatagaaatctagattgacagttcatatgtttcggtactttattttctttcttctttttaaattaaattaagaattttttttttttttaagatggagtcttactctcttgcccaggctggagtgcaatggcacaatctcacctcactgcaacctccgcctccctggttgaagtgattctcctgcctcagcctcctgagtagctgggattacaggtgcgcaccaccacatctggctaatttttttatttttagtagacacggggtttcaccatgttggccaggctggcctcgaactcctgacctcgtgatccacccgccacggcctcccgaagtgctggattacaggcatgaaccaccacaactggccaagaaattttttttttttttttttttttttttttgagacagagtttcgctctgttgcccaggctagagtgcagtggtgcaatcttggctcactgcaagctccgcctcccggattcacagcattttcctgcctcagcctcccgagtagctgggactaacaggcacctgccatcacgcctggctaattttttgtatttttagtgaagacggggtttcaccttgttagccaggatggtctcgatctcctgacctcgtgatccacccacctcagcctctcaaagtgctgggattacaggcgtgagccaccatgcccggccagagaaattttttttttttttggtatttttttgtttttgagatggagtcttgctctgtcccccaggctgaagtgtagtggcactatccggccagagaaatttttttagcagacggggtctcgctctgttgcccaggctacagtgccccctggctgtttacaggcactattgtgatacactgcagcctcaaactcctggcctcaagcaatccttctgccttcctagtagctgtgacgatttggaaggcgtatgtcatggtgagttcttccgtgttgctctgtggccttccagcgtgcattgtttctgagaaaaggtcattcttatccttgtttcttttatgtatgcctgttttctgtggctgccttaagagtctctcgccattactcttttaagcagtgtgataatgatgtgtcttcgtgtagttttcttttgttcttttatttctcttgtgctgcttaggttttgctgaggttttgctgagctcgtcggctctgggtttctggtttgggctaccaatttttttttttttttgagacagggtctcgctctgtcgcccaggctggagtgcagtggtgcaatctcggctcaccgcaagctctgcctcctgggttcacaccatcctcctgcatcagcctcccgagtagctgggactacaggcccgcgccaccacacccagctaatttttttatttttagtagagacaggatttcaccatgttgaccaggcttgtctcgaactcctgacctcaaatgatccacccaccttggcctaccacagtgctgggattacaggcgtgagccactgcacccggccgcttgttagtttttttctatatctgcaaatgcatagttattttgatttcctggtaggtatactaattacacctagttcttttagtgtttgctaatcacccacgtgatttcagaacacataaattgatttctcttgtctcttagcatttagcaataaaggatcctgggtattttataatgaaatcacttatcaaaacagggctcttaacataggtcaggataatcccagccttcctcaagtcactaagctgcttaaaagtaaatgcaagtttttgggtacttatgagtatgtacaattttgtggggaagaagtagatagatatgagattatcaaaaggtgacttccttttgttcattgacctcttcctgaaaattaggatccttaatttcttgtattgcgtagttcaatggtagagatatatctttctctagtacattatgttcttttacttctgttactaatcttttaaactctgaatttttttaaatttatttatttatttatttatttttgagacggagtctcactctgccgcccaggttggagtgcagtggcacggtctctggtcactgcaagctctgcctcctgggttcacaccattctcctgcctcagcctccctagtagctgggactacaggtgcctaccagcactcctggctaaattttttgtgattttaatagagacggggtttcatcgtgttagccaggatggtctcgatctcctgacctcgtggtacacccacctcggcctcccaaagtgctgtgataacaggcgtgagccagtgcacccggcctgcactctgattttttaaacaaaaatgaagtaccatgttttgaagtttgctttttttgcttcatttgttgtgaacatagttccacatcagtgtatgtaactatttcattctaaaagagaatatggctaaggaatgttacatgaatgaaacgtaattcagtatgctcgattcatgatcgtttatatttctaattttccccaacaatatatgtcttagcatacctgaacaagtgttttcataaggtaaatcacaaattgtggaattgatggggcaaagacgactcagctttaaaattttagtagatattaccagattggcttcaaaatagttgcatgtttcccaaaatgaaagaatgtgtctgtttcccccttcttgtcaatattggatattagtcttttttattttgctatcgtaaacatttttttattactgagtttgaagatttatttttaatatgactttttttttttgagagggagtcttgctctgttgcccaggctggagtgcagtggcacgatctcagctcactgcaagctccacctcccaggttcacgccattctcctgcttcagcctctcaagtagctgggactacaggcgcccgccaccacgcctggctaatttttttgtatttttagtagagatggggtttcactgtgttagccaggatggtctcgatctcctgacctcgtgatccacccgcctcgacctcccaaagtgctgggattacaggcgtgagccaccgctcctggccatgactttgttttttaagtgacctattcttatccattgttcattttcctgttgatttctttgttttcttttctctcattataaaactcacaggaaatcatgagggcaggcacatgctattatttaccattctatccccataccagcatggtggatactgaaaattgactgaataatggttagcttcccatataagttggtgtcttcaccatatagaaagaagttttacattttaatgaattcaaacctgacaactgttttcatatttgaattctagtgtttgagttatgctgataactattctgtttcatttctttcctggttttttggtacttagaaatttattccagaatcgtgtgtgtgtatggtaggcatccgagttctccttgtcttcctgcctctacctcatatatgatttattcctttacttggctttttttcctttcccttattcccagactttgtggttttctttctggctaccttctaccttcttgaattgtcagcttatttttctggcagatggaattatgatcaccctgtatgggaaaaggagctatacaaattggcaggctttgaaaatgaaccgccataaatccgtagaagttgtatgtctccattcaggagctctgtttgcttctttaggcatacccttcccctctcttgagtgaagagggcaaagacacagaaaacttagtagggaaccaggcgcagtggctcacgcctgtagttccagctacttgggaagctgaagcaggaggatcacgtgagcctaggagttaaaggctactgtgagctatgagcaagcacaccactgcactccagcctgggtgacagaatgagaccctgtctcaaaaaaacaacaaattgttttatattaaatgccttattcatattgaatatcagctgtgtgttttcagttttatgaatggaaaattaagtaaataaaattttgttctacaaatagcttgtggtatggtgtctgttctgtttatagcaaagtaagggaaataccttcttagattaagatagattttattatacagttttactgaagtttagttgacattcaaaattggcgtgtataaagtgaataatgtgtatattttgactgtgtacacccgtgaaaccatcaccacaatcaagaatgatcatattcatcgatcctgaaagtttgtgatccttccttccccacctctcctgtttctccattccttcccctatttctaagcaaccgctgttctgctttctataaccatagattagtatgcattttgtggaatttttgtataaatgatgttatacagtatgtacccttttttctttttttcatgaaaatggacaccttgcattttttttgttgtttttggtgattttggtctgctcttatcctctatacttatcctgtagttcatccatagtgttttgttggtttttagtagttcattcttttttattactgagtagtagtccattgtatggctacgccagcatttgtttatttgttctcctgttgaacacacttgggttgtttccaatatttgactattacaaataaagctgccgtgaacattcccctttgtgtgggcataacttttatttcctaaaaaatggaattgatcatatggtaagtgtatgtttaactttttaaaaaactgaatctggtttgcaaagatgtcttgtttcatattcctactagatgtctttgatccatgccctcaccaacacaagtcttaaatttagccattcttctgggtatgtagtgctatctcagagtggtttaaatttgcatttccctaatgactcccaattttgagcatcttttcatgtgattatttgccatctgtttatatcttctttggtgaagtgtctgttagatctttcactcggtttgaaaattatgttttatttctttctctctctttttttttagacagagtcttgcttggctaattttgtatttttagtagagatgggggtttcaccatgttggccaggatggtctcgatgtcctgacctcatgatccacccgcctcggcctcccaaagtgctgggattacaggcatgagccaccgcacccagcccaaccatttgattttaatgtggttatttctatggttaaatttaaaattcaccatcttgctatttttttattcatatcatttattctttgttctattttttcttcactctcttgttttgaaataataaagcttcttctattttttcttcactgtcttgttttgaaataatagagctttttttaaatcattccattttacctcctttgtttgacttttagcgataactcttcgatttattagttagggtttatggtgtcttatacttaccacagtgtgctgtcaagtactagtacacctctttacatgcagataatagcccaacagtacacttttgtttcctcctcccatccattatttctttgtgatgtgtcacttctgcatatgtcataacacccacgttatcttatttctaatattgctttaagtagtcaattacattttaaatagttgtagagaaaataatctcatacatacccacgtattcactatttctggtgttcgtttctgttaatgtagatttccatctggtattttatttcttctgcttaaagaattttctctaatttcctatcaggtagatcaactggcaatgaatcatttcaccttttctatacaggttgagtattgcttaactagaatatcccttgggatcaaaagtgatttggatttcagatttttttattttttatttttgaatgcttacatatatgtatgtgatgagatatcttggggttggaacccaagtctaaaacttgaaattcatttatggttcatacatactttatgcaaatagcctgaaggtaactttattcaatgttttaaattttgtacgtgaaaccaagtttatgtacattgaaccatcagaaagcaaggaagtcactatttcatgtcattgttcagaaagttgcaggttttggagcattttggattagggttgctcaagctttgtcagaagttaatttgccttcatttttggaagctatttttggtaatttgctaggttgacaggattttttttttccttacagtaaagtttttactcctggccaggcgctgtgcctcacgcctgtattcccagcactttgggaggccacagtgggcaaatcacctgaggtcaggtgctcgagaccagcctggccaacatggtgaaaccccatctctactaaaaatatgaaacttagctgggcgtggtggcgggcgcctgtaatcccagctacccaggaggctgaggcaggagaatcgcttgaacctgggaggcagaggctgcactgagctgagatcgcgccactgcattccagcctgggcaacagagcgagactccatgaaaaaaaagagaaaagaaaagaaaattgtgctcctctgtcagtctctcttattgtttacagctgggagtctgctgcattttatctttgctcctcccatatgaaatgtttttcccctctggtggctttttagattttctcttttaagccatttggttaagatgtacatgtaattttcttttatgaaattttcatacgtttgagttcatggagttgtttgtttgtttgtttgttttgaactggagtctcactctgtcgcccagactggagtgcagtggcaccagctcagcccactgcaaccgccacctcccgggttcaagcggttctcctgcctcagcctccctagaagctgggattacaggcgcccaccagcatacctggctaatttttgtatttttagcagagatggggtttcaccgtgttggccaggctggtcttgaactcctgacttcaggtgatctgcccgcctcagcttcccaaagtgctgggattacaggcatgagccaccgcatcctgccctcattaagctttttgtatctgtgagtttagagttttcatcaaacatagacattttctgctgttttttcttgtgtaataccttgagatacaattcacacactgtacagctcacccatttaaagtgccagtttagtgggttttgtatattcacagagttgtgccacatttgccacaatcagaacattttcatcatcccaaaaacgaacgctgtacccatttagcagtccttcctctgacatttaggaacgaagtctagcctcagttctgtgtgaacttgggggttgctgcctccaccatcctttcaggtgtttttttccctctggctcaggtagtttctcacatgcatgtgtcgatcaataccctgttgacaacttgagccagggagtggggggccccatcagatctccagacttctctctgttctcttctcttctctctgatgttctgcctcttgatttctaatcaccttggcttccctggactttctgtctctggaactcagggaggatcactgtcctctacctgggattcccctccttgggctgcctcctgtaagtgctgtccaaggagtaagctgagacagttatagggtctaccctgtttgtttcccacccttcaggaatgactctcctgcattggttggtgtctcatcttagaaatttgctgattcatgtatattatctgatacgatggttgtcacaggtggcatggtaaatttagttcctgttactcttatcttggttggaagtctcaaggtcgcgttttcttcagccaatagaaaattaatcagttctgaaagactggtatgtttttattacatttgtttcattctctctcagattagatcctgaaccagtaaggagattatggggaacattcttagattgtagaaaccattgacaatttatcaagaagtgtcaaagtgcagatttactgttgcattgaaaggttttatcattctgttcttagtcactgaatcttatgcctactactatttgattataaaggtctgacttactatctgaagcgtttctgggcaagtgtttttacttgttaccatataatacaaaatgctgcttagccatgtggttcttcatgcagttatcactagggtactcagttcttaaaactcagctaagagtaccttgtgttcctttttgtttttaggcaaaattcttgttttctggagatatgaacagcctctgagatagtagaatttgtgttattttgcataagtccaaaccagtcatgacgttcagatattggatttatcattactataaattaatcatatttccctctcatatctgagatcattttaaaggataaatttggccgggcacagtggctcatgcctgtaaccccagcacttttggaggccaaggcgggcagatcacaaggtcaggagatcgagaccatccttgttaacaccgtgaaaccccgtctctactaaaaatagagaaaaattagccgggcatggtggcgggtgcctgtaatcccagctacttggaggctgaggcaggagaatggcatgaacccgggaggcggagcttgcagtgagcccagatcacgccactgcactccagcctgggcaacagagcgagactccgtttcaaaaaaaaaaaggataaattatttttgtgctcctaaaaataaagatgcactctaagtagtattggtacattaactttttattttaacctgctaagtgaggagcttataacttaatcatagcaatgaatcgtagaataggtaagatttcctgttaaccccttctcacaagtttttggataataatttaagttactcataaaaacatctaaatcttactgaaatctacagaacaaaatgtagagaaaactatataatccgttcctgtatttttttctcttacaggaaaagtaagaagcttaagcgcatctttgtggtcactaactcacctgacagctttgcatttgagtgacaattccctgtcccgaattccttcagacattgccaagcttcacaatctggtgtatttggacctgtcatctaataaaattcgtagcttacccgcagaactcggaaacatggtatcactcaggtatgcagattcaacttaatacatactagctatatgacccctaaaacaaaatataggccgggcgcagtggcttatgcctgtaattctagcgttttgggaggctgcgagaggatcatgaggtcaggagatcgagaccattctggccaacatggtgaaaccccatctctactaaaaatacaaaaaattagccaggcgtggtggcgggcacctgtagtcccagctactcgggaggctgaggcaggagaacagtgtgaacccgggaggtggagtggcagtgagccgagatcacaccgctgcactccagcctgggtgacagagcgagagtccatctcaaaaaaaacaaaaacaaaaaaacatttgttgtgttaggaaacaaaactgttcatttaatggtatttgaataaaaggaaacataactatatcctttataactttatagttttgtttttgggaaaattgaatgtcagctaataataaattaagtagatcattggctgaattttttaattactgtattttgtgtaatagactttatttttgaatgagaaagtttggacagagagtgggtagactgcaaggtgcttatgttatcccacatacttcctcatgacaaacagggcaccataccatccttaacacagggtccaggaaaccattgccagttggtgaaacctttttgccatcccagggcttgtatgtttgatagtagtaaagcctggacttgaaggagctataattattaaatttgggggcctgtagcatgaaatatatagcatttggattcacatgtgtaagttcaggttggaatcttaactttgccatttatgagttgtgtgatcttggacaaccttcttgacccaggataagggatgtttgagataatgggtaaaaaaacactagtaccttgcctggcatatactgtgttttaagaaatggtaattgcagactgcatgtggtggttcatgtctgtaatcccagtactttgagtggctgaggcgggctgattgcttgagcccaggtgtttcagaccagtctggtcaacatagcgagaacctggtctctacaaaaaaaaaaaaaaatccccagataattagctgggcttcgtggcatgcacctgtagtccctgctacttgggaggctgaggtggagggatggcttgagcccaggaggttgaggttgcagtgagcagagatcatgccactgcactccagcctgggtgacagagcaagaccctgtctctaccctcctcccctctagaaaataagaaagaaaagaaatggtcattgctatgtttattttgatagagatgagggtctcactatgttgcccaggcaggtcttaaactcctagcctcaaaagatcctcccatcttggcctcccagagaattgggatttcaggcatgagccactgtggctggcccatgattattattattattttacttctgttttataaggtagataagatctaaccaagttaatataaagctaaattccatgtattatgttaatcccaatggaatattttgtactatttcatgttaactgactttttgacatggttccactggctttcctgctgccttctgccattagccatgtagtaaaaaggaataaggaccttttgaaaggtctttgcctctattgctcctactccagccttttgacttttttttaggtttaattgagtttgttctatgactgtttttagtcctctgaaacaaatttacttgaaggacctcctttttctttttctttttttttttttggagacggaattttactcttgtcgcccagactggagtgcaatagtgtgatctcggctcactgcaacctctgcctccgggttcaagtgattttcctgcctcagcctttcaagtagctgggattacaagcgtgtgccaccatgcccagctaatttttgtatttgtagtagagacagggtttcaccatgttggccaggctagtctcaaactcctgacctcaaatgatctgcctgcctcggcctcccaaagtgctgggattacaggcgtgagccaccgtgcccagcccgagggacctccttttttctgtatattgtatttggaaataaacaggagccagatatcagaacttgctcttcttgttgagtttacagccacacagaccttctggcttgctcagtaaccaagattcatttaaatgtcaaaaaccaaagattatagaaatagatttcttgcacacttaaaaagtgacaaataggctgggcacgatggctcaagcctataatcccagcacactttgggaggccgaggcgggcggatcacaaagtctggagatcgagaccatcctggctaacacggtgaaaccccgtctctactaaaaatacaaaaaaaaaaattagctgggtgtggtggcaggcacctgtagtcccagttactcgggaggctgaggcaggagaatggcgtgaacccgggaggcggagcttgcagtgagccgagatcgcatcactgcactccagcctgggcaatggagcgagactccgtctcaaaaaaaaaaaaaaattgaaaaataaaactgcatgcgttacattgccactgtgtccgtattgggtctctggtggttctttccccgcgtgtccccccggctcacccttgaaggttcctttgatatttatatcatgattatctctgcaaaacaaatcatattaagaataatcatgaacagttaatacagctgctgttattttttaaatgcaactttagttgatagcaatcataagcttaattatgcagctgttacgagctcttttgagtcgttaacgaaatgatcattttagttctcttttaagaattcacatggtaggctgctttatcatttccactttcttaaatgtgtagtagaccccatgtgtactagaccagtgatactcagtgtggtctgtgacctggtgccagtttgcaaactgtcttgccagtctgcagtgagattaatacagcagttgaggaattttatatgtctgttaaatctaatactttttaaaaattgggtcttacattttgtccttttcccccattatttcattttctctagtaatttgtttcttgtattctctggcagtttttttttttaaaccacatgttatttaagaaacgcagtactagacattgaaatataacgtaacattttttcattcttaggtgcttatgttcctagaaactatgttgttgattttaactgttaaaggctaacatatttttctgacttcctggaatttttacatcaacagggagctccatttaaataacaacctgttacgagttctaccttttgagctgggaaaactgtttcagttgcagactttaggcctgaaaggtatgacttccatatttgtacttcttatggtttgtgtatatgtctttgaatctaaagaagccaagaagctttctgctaggggattcttttaaagactcattttcccccagacttcatcagtttcttagctatatcgcaatggttttatcttctctgttcagctgtagactatctactagtctttgttttctttttttttgctccggacccagcccttcttttctagcctctgttttaataaaccctgtgttctggtgatacatccctgaggctatgctttatttcatcatgttataaacagctgtttttcttagattcaaatctcaaaaaacatggagcctctcatatagtacagaaaacaggaagtcgaaaatgttgaccatttgaacctgctgatgatcaagatttaagcatatttaaaaaaacttgatttatgaggacttgtgattatagggccataattgatccagcaagaactattaggaaataaatattttttaagccaacaatattgaaagttatattttgacagtatgtcaatgcctataaattttttatcatgttaagcagttcttcaccagccttgggtaggtgtgtctagcctactgtacagttgcttcttcaaaaaagtcactagatgaagtcgtcaagatttgcacccttaggccgggcacagtggctcacacctgtaatcacaaaactttgggaggctgaggtgggtggatatcttgaggccaagagttcaagaccagcatgagcaacatggcaaaacccaatctctaccaaaaatacaaaagtcagcttggcatggtggttcccacctgtagtaccacctacttgggaggctgaggcatgagacttgcttgaacctgggaagcagaggttgaagtgaggtgacattgtggcattgcactccagcctgggtgacagagcgagactctgtcttaaaaaaaaaaaaaaaaggaattgcactcttagtttcttaaaaatacagttatataaaaggttttagtcctgtaaatattttatatatcataaaagaacagttttttttaaataaatagaaatatatgttttaaaatgtacggaaagtcatattcaacagatatcaacattgtaaatggtttgtaattttttttctgtgtgggctgaactagctaaggcttctaaatataaaggccagtgaaatgcaagatgaagatgcccttttctgttatatttcccagtctagctgtttctaaatttgaagaacagaaaagtactgtgtggcaaagtgtccatatactgactgccagaattaacagtgaatactttatcatttttgtgtataatttttttaatgcaaaagaaatggaacattacagaatgttgagaccctctttgttcttccagtcttcctcatggcggaggtatgtttttccaattcaaggttttcctaatcttacactatatattttacaaactgtaatttgtaattcgtactcactaaggcttttcacaaactttatttgaagttagggtcaccagtcacaaatttgcttttttttttttttgagagagagtctcttgtcgcccaggctagagtgcagtggcatcatgatatcggctcactgcagcctccttctccctggttgaagcaattcttctgcttcagcctcccgagtagctgagattacaggtacccaccaccatgcccagctaattttttgtgtttttagcagagacgagatttcacctgttggctaggctggtctcaaactcctgacctcaagtcatttgccctccttggcctcccaaattgctggggttacaggcgtgagccactgcaccaggccataaattttcatactgatttaatgtacaggaaagcctctaagtgtaaatgcctgcagcagtagggcagttctttatgactccttcatttttgatgatcccttgcttttccatttcagatgctttactttatcacctctagacatctgtgtttatttcttggaagtgtagtttcaaagagacatttgcttatctcacatatcctgctggacagcattacacatctgtaatagcagtcttcttttactggttttacttcctttggacaaatccttttattttttctgagcttttgcagtttacactttaattctaatgttgtgtcggaacattgggtggaatgatccgtttgggggtagagctgctgctttacttcttaaagcaattgtatcatctttgccctctgaaaactatcattgatttctcccggcatccgcttggaagagagaaaataatatcacttagttcagagtcatgtttgtttgctattatacgtcatacattcttgcagaaccaaagtatttctgcctcatgaatcagttcataccattttctttgaagttgttgcagaatggctggcaggcttcactttttccccccacatttttaaatactcttcaaaattgtgccgcagtactacagttaaaggcaggactgtgaccttaggtgcccattcactttttttccttaaactgtttattttgagatacttgtagattcacatgcacttacaagaaataatacagaacaatcctatcccctttacccaactccctccaatagtagcatctttcaaaactatagtttcacgttatcgtacatagaacagtcaagacacagaatattttgtgaaataagccagacacagacaaatacaacatgatctcatttatgtgtgaagtctttaaaagtcaaactcatagaagtagagtgtagaatggttgttcccagaggcttggggacgggggacagagtggaaaggagaggtgttggtcagagggtgcgcagtttcatttacacagggggaataggtctggtgatctgttgcatagcatagtaactatagttaataataatgtgtattttttaacagctaaaagaatggatattaaatgttttcaccacaaataagtattcgaggtggtggatatgttgattagcctgatttgatcattccacaatgcataactgtgtggaaacatcacattgttccccataaacatacacaattatatgtccatttagaaaaggatgtagaacatctctatcaccagaagatccttttgttacactcttatagccacacctactttgttcctgccccagctcactgcttctaagttttgctattttaagaatgctaccatcccgggcgcagtggctcacgcctataatcccagtactttgggaggctgaggcaggcagatcacgaggtcaggggatcgagaccatcctggctaacatggtgaaaccccgtcactactaaaaatacaaaaacaaaattagccaggcatggtggcaggtgcctgtagtcccagctactcgggagactgaggtgggagaatagcgtgaacctgggaggtggaggttgcagtgagccgagatcgtgccactgcactccagcctgggcaacagagcgagactccgtctcaaaaaaaaaaaaaaagaatgctactgaatggaatcatactgtatgcggtcttttgagatgggcttttccactcaggttaattatttggatatttgtcctggttgcatgtattgatagtttgttcctttaaatagacaaaagtagtagtctatgatataaatgtctcgtggttagtttaaccatttacctgctgaaggaaatctgggtggcttctaatttggggctgttacaaataaagttgctgtgaacattcagtgtgcaggttattgtgtgaatatagttattcatttctctaggataaatgtccaggagtgcagttactgggtcatttgagggttgtatatttaattttttaagaaattgctaagtggttttctgtagtgtaagtactgctttacattgtaaagtgattcactttctctgcatcctcaccagcatttggtgttgtgactgtttttatgttagccattctggtagatgtgtagtcatttcatggttttgatttacatttccccaataaagatacccaacatctttgcaggtgcttatttgtcatctgtaatgtttttcttctgtgacatttcttcttgtcattgtccatgttctaattagattatttgcttttttactgggagtcctttatatattctaggtacgagtcgttggtggaatatgtggtttacacatatttctctcagtatgtagctttttacaaggtcattgcacagcaaaagtttttaattttaatgaagcccagtttatcagttttttcttctgtggatcctgattcttgtttcaagtctaagaactctttgaatagctctaagtcccaaagattttcctcttaggttttcttttaaaagttttatggtcttatgttacatttaagtctatgatccattttgacttacgattgagttaaaagatgtgaggattagctcaaggttctttttgtgtgtgtgtggcctgtcgatgtccagttgctccagcagcattattgaaagatgatcttaccttcattgaattgcttttgcatctttggcaaaaatcagttgagcatatctgtgtgaatctgtttctggattttttattctgtttcattgatctatgtgtccatccttccgccaacatctgcaaaaccagttctgaggccccaggaaggaatcggctctttgagcctcagaagggtacagctgtgcgtggccacagggaacacactccaggctactggggtctagtgatgaggcacttttgtcaggacgtggtccacagagaggagaaaagaaatgttctttagtctcagaggccaagacagacgcatgggaggagagggagatggcaaggacctggataactggaggcgtgatgaatggagagtctggtgcaggatccatgccacgggaggaggcccctgtggagagtgagaccttgggcggttagggctggccggactgggccccctgctcctcacagtgtgacctaaagccgcggcctggtatctagtgctttccagcgtagcccaggaaggcgcgccctccttcggcagaaacaccttaaaaaaaaaaacaaaaaacctgctattgctttttagacagaaacaatatggagacttttatttcattgagttctgctctttagtatttccttccttccttcttgtgtttgctttttttttttcctagcttcttgaggcgatagcttagattattgaattgaggcttctgtctttattgagacttttgtcttcatgcatttaatgtagaaattttcctcccaaccctgctttagaagctatgtccagcaacaaattttgatatttgtatttttattttcactagctcagtatattttatttgtttgtttattattttgggacgaggtctggctgtgttacccaggttggcttccgactcttgaggcccaagcaatccccccacctcagcctctgaagcaggtgggactacaagcactttacccccggcttggttctcgatttttaatatgatttcagtgtggtcagaaagtgaacgttctgtgtgatttcaattcttttccatttgttgaagtttgtttgatggcctaggatatggtccatcctggcatatgtttcttgggtactggaaaagaatgtgttttctgtttttgggtagaatgttctataaatatctattagctcctgtatattaacttaatgtctgttaggtcgatggtagtgaggtttttgtcgtgttctgtcagttgtggagagagaagtgttaaagtctccaacaataattgtagactctgttttccttttagttctctcagtttttgcataaaatattttgtgcttctcttgtttggaagcacacttagaattgctgtgtcttcttgagggattgagcctttattattacataatgttattttctatctctggcaattttatttcctctgatgtccactttatctgatattaatataaccactcctgctttcctttgatcaacttttgcattatatatctcttgccattcctttcttgcctctattattacatctgaagtgagtttctgtggacagtatatagttgggtcatatttttaaatccattctaccagtcttttaattggtatatttagaccatttacatttaaagttaattagtaagttagggtgtaagtcgtaagtctgccattttatttttttgttttctgtttcttcatcttttgtctttttctctttgcttctgcctgcctatgggttactgaaacattttttagattccattttgatttttctgtagtggtttgagtgtgtctgtttgtatagatgtttcatggttcctctgggtatcacactagatgtataacttaccacagtctattgggggttattttaccagttcaagggaaatatcaaaccttagctctctttacatccttttattcactgccattgataacagttcagaatattttctttacataaatttagaatcacattagttttatgattttttttttttttttgagacagagtctcgctctgttgcccatgctagagtgcagtggcgcgatctcggctcactgcaagttccgcctcctgggttcaaacgattctcctaccttgccttccaagtagctgggattacaggcacccaccaccatgcccggctaatttttgaattttaatagagacgaggtttcaccatgttggtcaggctggtcttgaactcctgacctcatgatccacccacttcgccctcccaaagtgctgggattacaggtgtgagccaccgtattgggccaaaattttttaaactgtcaaacgtgatttagaaaacttaaggaaatctcgtatttgcccatatttttttgtttacctatattgttttcttcttccaaagtccttcttttatcatttcctttgtatttagagaactttttctagtggttccctttgggtagatctgctggcagcagattctgttagttttttgtcctctgagattgtctttatttctccttcattcctgaaggatgttttcactggatataagaatctgggtttgacagttctttcgacacctgaaaaatattttgctgcttccttctggcttccatggcttatcatgacaaatctttcgtcattccaatttgtttttctcctgcaggtaaggtgtcatttttctccggctgctttcaagatgttttttctttgtctttagttttcagaagtttaattatgatgtgtcttgctgtggattcctttgggtttttcttgtgtaggggttcactgtgcttcttgaatctgttggtttatatttattgccatattgtgagaatcttcagccattattgctttgagtactttttcagccctgtcctccgtgtcctcagcgtccaaggctctgatgacatgaatgttagatcttttgttatagtcccacaagccccagagactttgttctttttgttgttgttggtggtggtggtggtgttggtctgtgttcttatctatctatcaatcaatcagtcaatcaagagacgaggtctcgggctggagtgcagtggcacgatcttggctcactgcagccttgacctcccaggctcaagcagctctcctacctcagcctcccaagtagctgggaccacaggcatgtgccaccatgcctggctagttttgtttgtttgtttgtagagacgagattttgccatgttaacaaagctggtctcgaactcctggcctcaagtgatcctcctgcttcagcctccaaagtgctgggattataggcatgagccactgtgcctagccttcatttattttatttttcagttctaatattcccatttggttttaaatgttttatttgcctgaactttgtttctttgctcagtcttcctgttttcttgtgtgttttgtgtgtgtgtgtgtgtgtgtgtgtgtgtgtgtgtgttttcaagcatgtttttaatttctcattgaagcatttttgtcatgattcctttgtcttggttgggtaattctgtttctgtcatctcagggttggaagttgtgtttatctttttgcatttgatatcttcgtgtcttggtgtgatgagctattttcatttgaaactggactcactcatgttatgaaactctagatcttgtttaaaccctttagtttggttttctttgcctagcactgctgtgacaagggaaccaggcactgtctccttactgccagtggaggtagaagttcaggttccacttggccttcgctgacacctgggagtgggggctcctcgttgcttctggtggaggtggtagttttggctcttcacgcggcctccacaggcaccgcactggcgtgtcctctttattgcagggagatggtgaaagtcttgactctccttggcctcctctgacaccacctcagagggaggaagggagctccatatcgcctcctttctttctcttgcagcagaagtctaccagcctctccacttgctcatgctggcatgggtagagatgggaccacgtttttttctttagtgttaagcttgagtacagtggttcttatctaaaacttttgtccttttaggcagcccttccctggtcctttggcttttgttgggattcttttgggtctgtacccattggtatttccatgttactggcttcttagctgcatgtctggcatatctgaggcaaaaagtgaacccagggaactcatccctgtgccgttcgtcaggtcctgcagtctttggctattctgccttctctccttttttcagagttttgtgtttgctttacacataatatacagtgcttttagttgtacctagtgggaagaatagggaaaagtgtttttactccatctaccctaaagtaacttctcatttacttttttgttctttctcaggactcagtatagttttaattccagaattttattgttattgactttattcatatatattgttttctgtttccaagtagtgaagagcagattaattttcaatttaaaagaagtcctggccgggcgcggtggctcacacctgtaatcccagcactttgggaggccgagtcgggtggatcacgaggtcaggagattgagaccatcttggctaatgcggtgaaaccctgtctctactaaaaatacaaaaaattagccgggcatggtggcagctgcctgtagtcccagctacctgggaggctgaggcaggagaatggcgtgaacccgggaggcggagcttgcggtgagccgagatggtgccactgcactccagcctgggcaacagagcgagactccatctcaaaaaaaaaataagaaaaagaaaacagcatcactgtaggtctggttagaatgagctgtttacctgataccgagaagttttcagttgacttcattttctcaagatgtgtttcacaaagggtcctgataagcttcaggttgtaactgcttatctcacgggattgtgactcagtgaaaacatgaaaaggctgtggtgggtataaagaaccacacacacgtgagagaatggtactcttgtaattgccttcctgcaaatacctactttgcacttagagcagcacatttttctttttataattcttagaatcctagaatcttaaaaccgaaagatcttaaagataaatgaactttgccatttttcccatccatgcaactcagcttctttgaaggatactccactgcctcacagcacagggtgtctcaaatagttaacagtgtttgccaacctcttctattcggccttggcctttcctgttaaatttttttttttttttttgagacagagtctcgctctgttgcccaggctggagtgcagtggcgcgatcttggctcactgcaagctctgcctcccaggttcacgccattctcctgcctcagcctcctgagtagctggactacaggcgcccgccaccacgcctggctgtttttttttgtttgtttttgctttttttttcttttatatttttagtagagacgaggtttcaccgtgttagccaggatggtctcgatctcctaacctcgtgatccgcccgcctcggcctcccaaagtgctgggattacaggcatgtcttccttctgctctttgagtccagtcttttatgagagaataggaaaaaacacttcctttaggttttgatcattcttatctaccatatcctttagtttttcttcatttggtatggttaacatctttgaccattttatctgccttcttcaaactgcagaatttgtctggttttcttaaaatggcgctgtggcatccagaataatacacaatgcttgtgtaggatggataggaactttgctccatgaaaccctgcgctgcactgttgttatttgtacttttatttctcatgtacataagaaacccttctgagaggatttgagattcttgtaggtatatgtaaatcattgtttttgctctcattttggaacaaagcagttattgaatttacagatggctcatggccctgggattttttccccctccttagtgagttaattcttaagccaagtcagccccattttgttgctttgttcagtatgactttaaaaaatctaagtgcaagtgtatatttgtcattagggtgttttgttgttagctttgtgacattgtagagttttgattctctgatgcattacgctggctttcatccttcccttcactgtttcctctgcccacccactctcccagtcacctgcctgccccgttcgtgttttgctcactcttgtttgttataaccatctgtattattgaaagtgttggcaaggcagggtcagatatagagcactgctagtgcatttctgattgacatcagcccattaacattatgttttgaatgtgtatatagaacatggtatgaatcatttttacttatatcagaaactgaaaaaacaatattttctatagtctgacatcttactagtaactataacatagttatggatgatctgataattttgatacattttaaaattttgaaacattttattacttagtttcattttacttatttcaaaaatatttccaggaaatccccttacccaggatatattgaacctttatcaggaaccagatggaacaagacggctgctgaactatttgcttgataatttgtcaggtactgcaaaaagaagtaagtggttatttgtttaaacctttttattaggaagacgtgtaagaatattgcttaattctgtattttctattcaactagttacaacagaacaaccacctccaaggtcttggattatgttacaagaaccagataggacaaggccaactggttggtagtcttttattttttaactgttatttttgctcagtctctataagcctaacagtattgtcagcatgcttagattacaggtagcattaagacaaaatgtttaaggttggtttggtttgggaggtaataaaaaagaattcttgctcacatgacctctatgtatactacattgtgctatatagaaagtgtgctataaagcagtgcttctcaaacgggcagtttatcccccagaggacatttggcaatgtctggagacaattttgatggtcgtaactggggagaagtgctgctggcgtctggtggatggaggccagggttgctgctcagcattctatagtacacggcacaggcccccacaacagacttcacctgaaatgtcagtagtgcgactctggttgagaaacccttctgtagtgtactgatgaaattcacttaaaatgaatacacccaaatttttctctatgagaagtttccaaatcctagcatgttccaaatggatttgacactaccgagttataagagagccaaacccttacttagaggaaagtggaactaatgactgctcatctccttttaacctaaattctatgtaaatagtttgggagctttcatggtgcgtgtaacaaaatttggtctgtgataccgttttcattttgcatgaattaacaatagttgtgctgtagaagaaaatgaggcatgcctattaaggatactacctatccagtttccacatcttacattaacagttggtagcatggtagaaggagtatagaaatgaggaatgttaggctcagagactgaagggctcacgagcttagacttttcacttccagaccttctgtgcctacctctgtagcaggtagtacattgtattctaacttgttcacttatctatcctgcttgcattatccgtcttttatttatcccccatatgtggcgtacagtagcttttcagtgactatagattgaatgaatacggtcaaacttaacatttaagtgaaaaccattactgaaattaattatatatttttttctgccacatgtgtgaataagtaaagttatctttcctacagccttgttttctgtcatgtgctataatgttctttgtgataaatatgcgacccggcagttatacggctactgtccatcatgggcgctaaactgggactacaggaaaaaggccattattcaagaaatcttgagctgcaatgctgatatcgtaagtcttcaggtaagtcagacagaagacagtcaacctagcattgataaaggaaggagcaactaggaatacattacgctgacacatttgaagttttagcttcagtagttcttaaagtactgcttttttctgttattagtgaatcctgggagtactgcctgctttgctttgcagtgctatgttgcaaaataggcaaatgtgttaagctgggatttatgcgtttgccatgaccgctaaatactcaccttcctcctccctccagcgtccctgcactatttttgaattgggtggcaaagttactgaaattctagcgtggtcaagctataacttgcattgccgaccatgttgctagaacaattaaggcaccgtgtaaaaaggactgacttggtacacgaacattttgggttctcagtgcaactctcatagtcactcatatgatcttgaacatgttactttctgcccaagggtctgaagttatgatttgtaaagttcgtcgacctctgtggttcttgttccacctcagttctaagacataaggaaatacacatgcatagaagtgtgtctttcactcactgttcttaaacaacaatgagttgcccttggtacctagtacctgtaaaatgacaagtcgctgttccagttggtttcagataaatagtgttgaaaagatgttactttttttttttttttttttttttttttgggtggtggggagacaggctctttctctgtcccccaggctggaatgcagtggcatgatctcagctcactgcaacctccgcctcctgggttcaagtgattctcagcctccgtagtagctgggattacaggcatgcaccaccatgcctggctaatttttgtatttttagtagagatggggtttcgccatgttggccaggcttggtctggaactcctgggctctagtgatccgcccgcctcggcctctcaaagtgctggggttacagacatgagccaccatgcccggcccggaaagatgttacattctttaatctgcagaccagtcctttgaaattatttcaagctctcaaactatacatagaagttaatatgcagactaatttttgtcttatgaaataactgtgctgtttacaacttttcaggaggttgaaacggaacagtattacagtttttttctggtagagctgaaagaacgtggctataatggattcttcagtcctaagtctagagctaggacaatgtcagaacaagaaaggaaacatgttgatggctgtgcaatattcttcaagacagaaaagtaagtcatcttattttttaaaaagaacgttttctcagtatttgcagggtgggggccaagggtgtggaaactaattggcaaatgagagaatgaggcactatattattactgaagcaaagaatactgtttgacctagggggtttttgtttgtttttaatcatcagaaataaccttgttttggagacatgcttaaagtactgctgtttcttcaggtgtttactagggtttaactcccaattgttaattgaaataccatgtagttaaaattccctctatgacggtacagggattcttaaacccatactttagaaaagaattgtttaaaaattacaaggtagaatattccaacataaaacttaaacagaagatgactacattttcttcagttgtaaaaatatttcaagttgttatttgtatcaataacagactgagagcaactttaaatggatgtgggaagcttgatgctgaacgtggaggattttccgtaatgtgatttaagtgccatcgtatctgttaaggaagtttgggaaaactgcgtttcccacaaagctaacctcttggtattcccaactctgtgtgtgtgtgtgtgtgttgtttttgttttagatttactttggttcagaaacacactgttgaatttaatcagctagccatggcaaattctgaggggtctgaagctatgctgaacagagtcatgacaaaagataacattggggttgcagtactgctagaacttcggaaggaatcgattgaaatgccgtgtgagtgcccttcacttcctgtaaaattgaccagctctgactagacatcttcaaaagaatagaaaacagaaatttcattgtgtattcatggtcttgtctaacacctgaagaaactcagtgagaagttgtctttcctaaaatgtatctctttttctctaccacaaagcttaacatgagaaagcattgcccattaaagtattagaagccttgaaaagcattaaaaaacctttttttttttttttgctcctaagaatttttcatataaaataaatgttgaagtaaatattaattaaaataactgctcaggggtaagaactccatacacttttgtaattttttggcagcaaggatattctgtaagctaacttcttttcctgatctatttaaaataatcattttattagctgggtgtggtggtgggcgcctgtaatcccagctacttgggaggctgagggagagaactgcttgaacctgggaggcagaggttgcagtgagccaagattgtcacactgcactccaacctgggtgacagagtgagactcctcaaaaaataaataaataaataaatataaataaataaatacataaaataattattttaaaggtcttgagttttggataaatggaccacttcaaattgaaagcatatttcaagtgaccattatgctgggagccgaaacttgtgtcacttgaggaacagttggaactggagaaatttaatgtgaagtatagaaaaaatggaaataggacttaacgattgtcttaaatctaagaaagagggtttagatgtaattttgtgaggctcgatttaggacatccaaactaagaccaaaagtttcagggagacagaattttaaaaatcaagctgtcccaaatagggctatttttgtacaagtagtgaatgccctgtgctggaagcatcagcccaggttgagatgtgtatttctcgggtttgttgtagggcacattcagtcatccggtgggaattttaggtgtcttttctattctgggactctgagagattatttgctttcagacgctgtaagaatatatgggctgatgggcgggttttgtctctttctttgtttcgtttttatctaatgtagccggaaagccacatcttggaacagaaaaacaacttattcttgtggctaacgcccacatgcattgggaccctgaatactctgatgtgaagttggtacaaactatgatgttcctctcagaagtgaagaacattattgataaagcctctcgcaacctcaaatccagtgttttgggagaatttggaactattccacttgtgttatgtgcagatcttaattctttgccagactctggtaagaaaataatgtgattttatgtagaatattttttgacataagatgatttagtaatgttttgtttctgatcattccaaattaagtccaaataaaaattcagtttgtaatggcagctatgagcaggttttaaacatcatgttggggtggaggggccattttgaagatgaaacgatattatggaaacttgaggagaaggatgttaatcatcttgaataaacacataagcaataacgtgaaataactctttaaagaacgtatgtagttccattttattactccaaagtcagagataattatggttattaagacagcctctttgggattccagcgtgtggtaatataatcatagtttaaatttgagttaaaattatagaatctcaattttgcatgtatttataacttgattagaaaaatacacctcaggtggaaaatgagctcctttatttgcacacatatcagtcaagcgattttgacaaagagcaaggatcttgatttttattaaaatgtagaatacagaaagcctgatctggagcgctctttccgtggatagtatacaataaacagtagcccttgtaataacaaactgtttctttctttttgtgtttcaactcatttatacacacaggaatactcttccttggacgtgaatgtacgcatgaacacacacacacgcacatttggaagcacgttcttgacatcacaatagatagagcccttaggaagaaagaaactggctgggtgccgtggctcacgcccgtaatcccagcactttggggggcccaggtgggcagatcagttgaggccagcagttcgagaccaacctggccaacatggtgaaaccccatctgtactgaaaatacaaaaattagccaggcgtggtggtgcacgcctgtaatcccagctactcgggaggctgaggcacaagaatgacttgaaccccagaggcagaagttgcagggagccaagattgtaccactgcacttcagcctgggtgacagaacgagactataaataataataatatgataataaaagagagagaaagaaaaactgagttaaaattcaatttcagggaaaatcaaagctatctgaaatctgtaattatttcatctcatcaagttatctggggattactgcccctgaagcagttgagtagtagtctctgacaatttctctacatgctttctactttctgtgtagctacaaagtatctgaggagtaaagagaaaatctggtcaaacattaatatccaagacccatttcagcattgagaaatacagtattataatagcaggcaggtcagaaaatgtccagccttgctaatttgtgaataaaatgtaaatgaaagtatattttcatagcccatcttatgcttagtaaattgggaaaatacttcaccagggatgtggacgtttggcctgtaactagctggtggtattctcttccatagttggcagcattataaaatggcacattcagtcctaatcttgggattttataccaagtaaataattgagcgtaagccagaagtctgcatactaagatgctgatcgtggtgttatctttaattctttgtaaaaagtggaaacaacctgcattttacaaaataagtaaccagtaaatattatccaccagcccaattgcattgtgcagccattaaagaacgataattgggaagacacatgttcataaagcaaattataaactattcaatactctgtgatgacaactgtgtaaaaatagatttgggcaagtcctggcaaatgtaaaaggaaacattttggaacgtgggaatatgtatagtttaaaacttcttactattgcatgatcttttaaaattactttttgtatatatttgacaataaaaaaatttgtcttcattgtaggtgttgtagaatatttgagcacaggtggagtagaaacaaatcacaaagactttaaggagttgaggtataatgaaagtctcacaaacttcagctgtcatgggaagaatggaaccaccaatggaaggatcactcatggtttcaagttacagagtgcctatgagagtggcctgatgccttacacgaattacacatttgatttcaaggtgtgtcttgagactgataagcttttcaaacctgtcttttactggcaggtgttctgatacatcattatgtctttaaaactgtggctgtgtgttcaggctggaatgaagcagtcttgaattcattgacagcaatgttctttgttttttgtttgagacaaggtctcactctgttacccaggctggagtgcagtggcacagtgatggctcactgcagcttcaaccatgccggctcaaacgatcctctcacctcggcctccctagtagctgggactacaggcgcctactaccacgcctggctaattcttgtattttttgtagagatggggtctcgctatgcccaggctgatcttgaactcctggcctcaaatgattcttccacctcagcctcccagtgtgctgggattacaggcgtgaaccactgtgctcagccagtaatattcttttattactcttttttagaagtccatgtgatcagtgtcacatccttactttgtagatatttattctaataattttcaggataagaagtcacatgaaataatctgtaaaattcctaagttgactttttcaccttttggggacaattatgtttcttatattctcattactaatagctagatatgcagcaccataattatctagtttgagtggcatttgtggtaagatgttccttctcttacattttaatttaactgaaagtaaactcttgcatgccaaaatgtgatttatattagctatttttaagtgtttctaagatacatcttttttctccccctagagacagtcttgctctgttgcccaggctggagtgcagtggcgtgatctcggctcactgcaacctccacctcccaggttcaagtgattctcatacctcagcctcccaagtagctgggattacaggcatgagccacctcacctggctaatttttgtatctttggtagagacggagtttcaccatgttggccaggctggtcttgaatacctggcctcaagtgatccacccaccttggcctcccaaagtgctgggattacaggcatgagccaccgcacctggtcagacttacaccatttttaacgttagtgattgtttagggctgtcactttcttgtgttcaactgtcctttttctaaaaagagatatggtctcactcattttgcccaggctgaagtacagtgatgtgatgataacacactgcagcctcaaactctcgggctcaggcaaccctcctgcctcagcctccccgctaacttggactacaggtgtccgccgccatacccagatcttttttttttggtaattttttgtaaagacaaggttttgctatattgcccagcccaatcttgaacccctggcctcaagcaatcctcctgccttagcctcccaaagtgctgggattatagacgggagctaccacatctggctcagctgcccttttaaactactttttgcatttctgctttcttaaaaatttcttaactcccagctttctatttctaagctgctggaaaagtaatcatttagattagactgtcagagtgtaaataagagtttagatagtatctcaggagcctttgcaccttagagcatagaaagtaaacccctgtttatcctcaggtgccccttcctttcaggttcttcaggagacattgaagagaaagcatgggtagcagccacagagtgggaatgcttagcgttttctttctctttctgttgctgatgcagtggcaggaagaagacacttgaatgtgcttcagtacatttggccaagagcatgtagaggggaggaccagaaccatcagatgggaacagtttagtagatgccatggcggggtgctgctgagagaaaagggggtcaggtagagacagtcctgccctcatggagctgaggtgtgatgagagagacaagtctcaaccacacaaatgagtagataattacaccttgagatggccattagcaagggaagtgaatctgtggtgagaggtagggtagtaagtaggtaggagcaggattcaggaaggtctttggaaagcagttgaacctgacattgaaagattaagaaggaattgacctcataacaagtagaagaaagtgttccaggcagaatggtggaggggggcagtgtgtgtgtgtgtgtgtgtgtgtgtgtgtgtgtgtgtgtgtgtgtgtgtccgtccgtccgtccgtcctggggcaggaaagaacttggtacctataggtcccctcacatcctcacccctttctcattccaaaggctagtgtggaagcagggaaagtggcacaaattaggctaggaaagagaagcagaggctgcatcctgaaaggccttttaggtcttgttaaagatccagataagaagaatgcttcattctgctagatttgacattttgcacggggaccatttggtgtatgtagtacagacctcatcctacaagctagtaagtttcacttgttctgttctgttcaccaaacatgacataaaggcatgtcttgaaagcactgaggattttagtgttgtcttatacggtgcttatctttttttctgttgtttttcagggtataatagactacattttctattctaaacctcagctgaacaccttaggcatcctgggccctctggaccaccactggctggttgagaataacatcagtggctgcccgcaccccctcatcccctctgaccacttctcactttttgcacaactggagctcttactgcctttcctgccccaagtcaacggcatccaccttcctggcaggaggtagtcaagcaccttcagaggacagccttgattcacttgtaaacttgtgaaaatctgaacataggggagtgaggtatggccactgaggatttttgcttgcttaagaatgatttggactttcaatctgattatttgataaggatatagtatgaaagccaggtgctagcaacagacaaattctgagcccaatatgctttatactgctagacagggattggtgtgtttgcacctgtctttcatttgtcataagagattttcctatttcttctacccaatagaatattttcatgcctggaaataggaaaatgtgtgaacagcgtattctcttcacacagaaatctgtagcactgcttttttgaggccagtagcaacatccagagatcattcttccatactttactccctcctttttcagacttgtttgtaaagtacagaatctgaatttagcctttatgattgtatatgatccacagaagacctgatttatgaaattttgtactaaaatcatttggaaatgattgtattgtaaactgaggctaaatttttttttaaacctgtttcatgtgttataaaggccagcttgtaaaagaagctgcaacagactttctctgctcatgatttgcactcttagggttttgttagcccttttgtactactttctttttaaattgagaacatggttctttacatataaatctgcttcaaccttaggatgttttcagaccagaggcaacttattcatgaatttttatgaaaactatctactaggacagataagctgaacagtgatgatctgtagacatttatggactgaatgtaatggttgatatatgtacattctgatatttttaaatctttaactttttaaagttaaaaacctacagctgcttaggtccagcttcttaactctttttgagacacttcctgtcctatctccactgtgcctgcctaaatttgttctcaccaagcactgcctgtgcatgcagagaaaatctgtgcatcctcttttatatttttaaaatactgtttaacatttgtgagaattttatgaaaatgcttttgtatgagctgtggctttttcccattgtgaagcattgaatatcacattttggaacatgttatagggtgagtccctggatctttgctcaccagatccaagcactgcttctcggtgtcattgcagtgtgctgcttgtcacccagaatactactatcatgtgaattctttttgtcgtcagtgtcttttccttagtctttttgttgttgttgttgttgttgttttaatcattccttttttaagaagaagtaattttccatttatgaagcagtatgaattagatgtattttcaaaacaggtccctaagacaattcttcagatcatttttaaaatgactaagtcattttagtatgtcaagcaagataaaaattacatcataccgtctattttgcccatagtgccatttagagatgaaaaccagctttaactttgcaaagtgaacatgtacatggtctgctctcatttattcattcttctctcaaaagtcaaatgaatgcagagggagcttggtcaaactgcttttgtttcaactgcaggcaggggagcaaaaggacgccatgtgagcattaggaaaaaaaatactcactcttactaacaatttttatacagaaaatgagtcattttggaaatgattcttatgttttttttttttctccttttagaaaattctccaaaaggttttgatgttgaatcttggtcttggacctgttttttcctttgagggttttttgttttttgttttttctaggatttcattgtgatgttttggttttgttttttgctttttgtttaagttgtgctgacaccaaacacatccagtttataatcagtacattggaaagctggtattgatgtagaaccagtgcataactttttatggggttttgttattggtttttttttgtaaagtgtgaataaaaggtatgtttactcatttttcctgaacactgtgttggtaatgtgcatcatgacaatttccagtgaaggtgagctggagctggttggactaatgagactgaggaagcagcttttcctacgatctgcattatgtaatcacaggtccagagagctttatggaagcgggagaggaggagcacttactcatgttgtatttgttaatggaggatgtcatcttttcatagatgctggaactagagtgcacttgttagatgctaaaggtttgagctttacacaaaatgtcttcatctgtatttgttattgtctacaatatatttgaatttggggcagcatattaagatgtaatggcctgttatgtcttgaaaatacttgttttgcctcttccaggcatactgcattctgtggatcagtttgaacagcttctccaccttatttggacagtgataaattgaaccaagagtgtagatttacaagtgtaaccttcaaaagaggaagaactatttggggtctgtaggtaatgaacagtcacaccaaaatagactatgatgcttttgttaagaaaggtttcatgttttagatattttccgtgtcctaaataattttcaataatctataatccctaaaatgcaataaaaactagtatgttttcacggtgtatattttttttcaaaaattctgtaacaaatatatttaatgtgttgccataatgtcatttcagtatttttgctggataaatccattttagaaatgtcttacaaaaagtttagggcatgttttctgttttaaagaccagaagtttgaaggcacccaaatccttgtcgccaatctcctgaagtacagctttaccatattagtggtcattatttatgctttgagagtttcaatattgttcgtcaagttaacttatggcataatttaagctaaagttgtagaaatgaattgttgagtgcaactttcatagtcccaaagataggcagagaacatctccagaaatgtgtgtgtgtgtgtgtgtgtgtgtgtgtgtgtttaatatgatttagtgacaaccaggaaaacttacttgggattattagcactttcaaacttagggacattattaaattggatggaatgcacttctaaatgtttaaattaaaatttcaaagctctttcgagattcaggttctcaataataatattcaagttttagagtttcactttgtactatttaaatttatggaactagtttccatactgacttgtaaggttttggggtcatatataaggactaaagccaagctaggcaaaacaatgacagcaccgttttttcagtgaagctctcagaatgtccagtacagatgttgcagataattccaagaactccttcagcaggtgttcttcaccattcgtaaacagtattttaagatgttcactttgctcttctttttggttacatacattttaataactggtatgttgaagtagtgtctaaaagtatctagtctttattcacagtacattatattgtgtgatgcactggactaactcttgtttaccattcatgtaacaaaacccagcacattatctgcactataagctcaaagaatgtcacatccgcccagacagctctttgatgagggtgatgggaactgaataaaccatacggactggcagtaacaagggcttttactgttctgttcagtggaaccttcttggtcaaattgtaattagctagcattatatttatatacagggtcttttttctttaccgatgtattttcctactcatagccaaccaataaattcagtatctgtttcaaatattttagaagtgtagtttgtatagctgtagtactgaggtttgaggaaaaataaatgttgatcagcagaccacgtatttaaaattctgaatcttctgggacagggttgtaactcagccttccaaagggaagagtgcagggggacggggccatgatatggggaaatggtgtaaactaatgtatttctttattggctgttattctgtataacactcatatctttgccaaagttcaattttatatttaggcaactgatggtccttttgcatttaggattttcgttgttgttaccttatacctcatgatataaggaatgggctcatgtgtcttccgtcttttggaaggaggttgacatattttaaataaatgcttttaaatacagta

SEQ ID NO: 38260 - DNA, 1817 bp, Homo sapiens
ggagactgcgccgacatggagctgttcctcgcgggccgccgggtgctggtcaccggggcaggcaaaggtgggcggcggggaaaggtgggcaaaggccggcggcgggcagaggcgggcaggggacgccttcactgagcccgctcccggcaggtatagggcgcggcacggtccaggcgctgcacgcgacgggcgcgcgggtggtggctgtgagccggactcaggcggatcttgacagccttgtccgcgaggtaggtcccgccgggtcccagcgctgcgaggcggcgagccaggagggggcggcagcgagcgggggcggtacctctgtgcgcgactccgcctcccctcgcgggcgctgcgcttctcaccgcggcctgggcgcccgcgcaccctctctcggggctggtggcctgcgtgggcggccgggtggtcggcagagccgccggggcccccgggctcagaaagaggccgaaatggctgcgaagcaggccccgggcaggagtcgctcgggcgcagggaggaagtgaaccggccggaggtagcgcccggctgctggccccacagtcccgacaccttcggaactcctaactcctttacttgtccggctgaaaggtcaccagccccagtccccagctgtgccgcttgctgggcacagagcctctggtaactgccccctgatacacacagtgcccggggatagaacccgtgtgcgtggacctgggtgactgggaggccaccgagcgggcgctgggcagcgtgggccccgtggacctgctggtgaacaacgccgctgtcgccctgctgcagcccttcctggaggtcaccaaggaggcctttgacaggtgagcctgtgagggcggaggaacctcagggaggggctgtcctggaggacgcagcagccctaatctctgaccagggtctgtccctcggcctctagatcctttgaggtgaacctgcgtgcggtcatccaggtgtcgcaggtgagctgccctgtgggctggacgggaattctcgtgagtgatgccagctctgcctcacggtctcgctgcgattccagattgtggccaggggcttaatagcccggggagtcccaggggccatcgtgaatgtctccagccagtgctcccagcgggcagtaactaaccatagcgtctactgtgagtgccccagctgtgccctcagccccaccccagccccagcctcgccctcatcaccgaccccagccccagccagcttgggttcctcttcgtaggctccaccaagggtgccctggacatgctgaccaaggtgatggccctagagctcgggccccacaaggtgagcagggctggggtacctcccccaacctaggacaccccacttgccctgctgaccccagctgtcccggtgtagatccgagtgaatgcagtaaaccccacagtggtgatgacgtccatgggccaggccacctggagtgacccccacaaggccaagactatgctgaaccgaatcccacttggcaagtttgctggtgagtcaggtgggagcccagccagcgtggtgccagcagtccctgtgtgtgccctgggtaggggtgggagggaaagatgggcggcagcctccttcctctatgcccctgacccccgccctgcccacagaggtagagcacgtggtgaacgccatcctctttctgctgagtgaccgaagtggcatgaccacgggttccactttgccggtggaagggggcttctgggcctgctgagctccctccacacacctcaagccccatgccgtgctcatcctacccccaatccctccaataaacctgattctgctgccca

SEQ ID NO: 38261 - DNA, 44882 bp, Homo sapiens
atatccgggttcccgccgcctccaccgccaccgcctcagccgcctcgcacatttagtcttgccgggagtggtgtgattcccgaccaagatggcggccgtggggcgagtcggctccttcggttcttctccgccgggattatcctcgacttacactggcggccccttgggcaacgagatagcgtcgggcaacggtggcgccgcggcaggcgacgacgaggacgggcagaacctttggtaacgactccacctctccctcagcccccgctggctcccccggccttgcgcggacgcctcgggatcccgtgcccgctggagctcggcgccgggcccggccactgcgttcccggcagccccatccccggcgcgccgaggccgggtccgtccctcccgcgctgcggctccggcctccggcctcaccgtacgccttgcttcccgttaggtcctgcatcctcagcgaggtctccacccgctcgcgctccaagctccctgcggggaagaacgtgctactgctgggtaagtgttccctgcctcgccccgccccgcccggcccccagcggcccggggtacctggtccgcgggctagctcgctggctctctttgtgcggacagccggcccagccccgccccgcctcgcctcccgacctgtcgcggatggctgggagagaaggggaacacgagacccttgacccaggacctgcggggacccgccctccctcaggttcctcctcctcctccccggtatatgggggtggccctgacagcttcccctgggaaggacagaattcgatcgctcatctgagggattctcgtggcctggggtttatctagaaaatgacaggttttctttcatcacaaaaattggtagcaggaggctctttgcgagagctgcagcgcaaatggcatgccattaatatttaatagctgactctttgtataattgacagaagctagaactaagacctggcgataaatgttcttgattcagcgttctctggtacaatgtgctcgtgttgcagctaccttaactgtcacatataattctgaaatttgtaaagggcagtagaacacaactttctagttaagtcttttcagccaaatggatgtaataaggagaaacggtccagtgtcagttctcctgattgttctgtatctcctcggctctctggaagttgtgtattctgtttctttagtgactctgggggtggggatagaggactgagggagaatagttcgcagattcgcatttttctaggcttagctcctgaatcatttataggagaaatttctctatatagctctttacatgcgagataactgaagtttggcttatacgatgattaaatttaaaaactttggtatttggtgtcggctcaataccagagttttttgttgttgttgttgttgttttggttatatccatctaaaaacaggaaacaagaagtcaaatactacttgataggctgcgtggttaaatatgaatgtttacatagaaaaaattacttttttaatagactgctgccaagcaagaatatatgattattgatattctttaaagctacatggagctagttgaaaaattagtttttacccttgtttttaatgtggttgaaagcacctactgaagattagcctggattgagtcactgccctatcacatataagccctaggatcttaagcaagttgcttgacatctataaacctcagtttcttcatctttaaaatggttgttatagaaataataatacttgcctctagggttgtggcgggaatcaaatgagttaatgtttgtatcgtggtaatatttgcaagtgatactttgtcatggatttatcttaaactgcattagaaaatatttgtgatcagaactttttaaaaaattgaattagtgcctacataagtgatattcatagggcaaaaataaattaggatccaaaagcaaaaaaaaattgtataatatatttttagtttactaatttaaacaaattactactcatttctaaggtaaaatggatttaagctcatatgacctcattgaaattgattctattttaattaaatatttggaaacactgtcatggtaaaggtaagattcagtagttttgttcttattttatacattttgtccagttatttctgcacattagatattgtgtagatgattctgtttatggtaaaacaaaagtggcagttttgttcattttttggtatacctaatttgcactgaggttgtgccattttttttttaacacccctttgacactgggtctgtgcatgggactgagtgttcttagaggtcccagcctccttcactccaccatacaagaatagattaaatttccttttttatgaacttaatagttcataaagtgcatctaatatcaggtaatatgagcttgaaatttaatatttttctttcagtactattgggattttcatcagagagtccttttcagctttggaaggagctaataactgatttgtatactggttacaaaaatagagttaactttctaaaatacccctgaagatttcttacagacatttcaccgtcacatatggcagcattcactctgtgctggtggaggaaagaaataccaaatagggattgtggttttctttgttatgagtttgaaggtgctaggcaggaggatgcttgaccctaatacatctttcatgaatgcaagtggtctctggagtctcttatttaaaaaaacaaatctaaggccaggcacagtggcccacgcctgtaatcccagcattttgggaggccgaggggtggatcgtttgagctcaggagttggagaccagcctgggtagtatggtgaaaccccatgtctacaaaaaataaaaaaattggcctggcacggcagctcctgcctgtaatcccagactttaggaggcctaggtgagcggatcacctgaagttaggagttagagaccagcctggtcaatatggtgaaaccccatctctactacaaatacaaaaattagctgggcatggtggcacacacctgtaatcccagttactcgggaggctgaggcaggagaattgcttgagcccgggaggcggaggttgcagtgagccaagatcgtgccactgcactccagcctgggtgacagagcgagactctgtctcaaaaaaaaaaaaaaaaaaggccgggtatgatggtgcatgcctgtagtctcagctactcaggaggctaaggtggagggacaacttgagccctggaggcagaagttgcagtgagctgagattacgccattgcactccagcctgggcaacagagtgagaccctgtctcaaaataataataataataataataaataaaataaaaaaccaaatctgagcctatgacaaggctttacatttcagaaacaacctagaataggaacaatgatatagccctaagtactcccctcacaacacacacaaattgcagtttagcttgccacattctctctcctcctacaacctgatgggagtaaagggtcatgtatgtgtagtaacgtgtgtatgtgtaagagccattgtcaaaggattttcatacaaatctcatttcacctcctctctcctccctgatcagggcaccaatttatagatggggtaatgaattgtagagacctgttaagtggattttccaaggtcacacaacataagggccctgttctgtgactctggcatggatttctaacttgatagaagttcctgcaagggagagagtgccaggtacaaaactctttctactcaaagcctgtctttgaacaaaagtactggtaattattttaaaggaaaatccaaatatttattggattctgggatgcagctgttgcaatggcacttgtgtttaagtaatcatttaatctgcctaggcctgacttctaatgaaatccaaaaagtctatgatattaactcttctttcttgaaaggttttgagaatggatttcattaagatttgtttttaataaaggtaggacttcttgcacatgtattttaagtaggttctaacctctaaattgtttttttaagaactgcattttcatttttaccttttatatttaattacttttaatacaattgattatatttgtttttttgtttgtttgtttgtttgtttttgagatggagtttcactcttgttgccccggctagagtgtaatggcaagatttcggctcactgcaacctccacctcctaggttcaagcgattctcctgcctcagcctcctgcgtagctgggattacaggcatgtgccaccacacctggctaattttgtatttttagtagagacagtttctccatgttggtcaggctggtctcgaactcctgacctcaggtgatctacccgccttggcctcccaaagtgccgcgtgagccactgcgctgggcatatttgtattttaatagctgcctttaaaggcagtttctccatattgattactttcccatgttttgataagaaaactccctaaggaaaataaataataatacctaacatagagcacttacaggtactagtcatgtaaggattgtttacatactctatccccttaaagatcaggaaacagacacagaatttttatttttgaggcagggtcttactctgtcacccaggctggagcgtagtggcataatctcggctcactgcaacctctgcctcctgggctcaaaccgtcctcctgcctcagcctcctaagtagctgggactacaggtgcgtgtcaccactcctagccagtttttgtactttttggagagatgaggtctcaccgtgttgcccaagctggtcttgaactcctgggctcaagcagtccttctctcacctcagtctcccaaagtattgggattacaggggtgagctaccacacccggccagaaacagaaatgttaagtaaattgtcctagggttacatagccaggaggtaaaatcagtattcaaaattttgcagcctgaggccggccccatggctcctgcctataatcctagcactttaggaggctgagggggtggatcacctgaggtcaagagttcgagaccagcctggccaatatggtgaaacccagtctctactaaaaatacaaaaattagccagacatagtggtggctcctgtagtcccagctactcaggaggctgaggcaggagactcgcttgaaccagggaggcagaggttgcagtgagccaagatggcgccattgcactccagcctgggtgacgagtgaaactctgtctcaaaaaaaagaaagaaaaattgtgcagcctagctccccgagctagtactcttaatctatagaatctccctaaaggaaaagagctttccttgtaagtaagaggatgcttagcagttattaaggaattttatctgattcttctcagtgtgtatcttttagtgcaagcaataacacttatttagattaattgaattcattgtcaacaaaggtacatatgtaatcctggtcccaagcacagtgactggtttttagataggacttcagtgtaactttttgatttgctgtcagtgtgaattaatgaaaactaggtggtcctttgtcaagtcatataagcctcatctttctcatctgtaaatccggctatttgaatttaatgatctccaaagccttatttgatctgacattttataaattttcttattttaatcttgtgagttattgaatatttttaaagaaatgttttaaggcatattgaaattgggttttaattaattaatatagatgtgggccatttaattccaccccggaaagaaatgtaaagttgctatattgttctctgaaggtattagtccacggtaatatgcagccaaaagtcccacaaaatgctgaacatcatcaataagtatatgtgaaagtcttttttcccccccttcaggaataaaactattatgcttgagctattgtaggaaaccttaagatatgcacagtggaattcagagatctgttaagagaagtaacttgtaactggcaagggagtgtatggttttctatgtgaggactgattataaaaataatgagagtgttcagtctaaaactattgatttggtgaggagctgggattaaagatcatcaaggttccatgagttatgctgttttctggcatgactggttatgggaatatgatgcaaggaatagactgttaccatatatgatattgacttttttcaaagaattagcatgaaattatttattacatgtttattatatgttactactactaaaaatacaccaaatataaagtgttttgagagtaagatggcatagtggcatcttataatagaatcagcaaactcttttgtcaagggccagattgtaaatagtttaggctttgtaagtcatatggtctctgttgcaacaactcagttctgctgttgtagttccaaaacagccatggataatatgtaaatgaatgggtacaggcttgtttcaataaaactttatttataaaaacaggcagcaagccagttttggcctgtggcctgaagtttgtgaacctctgtgtttgtttgtttgtttgcttgtttgtttgtttatttagagatggggtcttgccctgtcacctaggctgtagtacactggcacgatcataacttattgcagcctcaaactcctgggctcaagagatcttcctgcctcagcctctcaagtaactgggaatatacaggactgtagtcccaccacgatggctaattttaaaaatttgttatatttttctagagacagggatttactatgttgcccaggctggtccccaactcctgggctaaagtgatcctcccacctcagtctcctgaatcactggggttataggtatgacccacagcacatgactgtgttaggggattattggcgtcagttttatcagtaagcacaaatgccagttaatagagatttctagttaatgggatatggtgtgtggcacataataggtgcctagtgaatatctgttgaacaaatgatgaacagtctttacttaaagtatcattgttattccagttaggtatagtttgagcacaggtttaagaattgttaagaggacttcatataatatttcccccagtgctactgtcaaaagcagaaaacagaactggcaaatcacagatacaggctggtagagcagtaattcagctggtgtgaaatccatgtgagagggaatgtcagtaaaagcacttagaaaatataaaacagaaaggagtcttgaaataggaaaagaaaagtctaaaatttagcgtgggactctgtcactaacaagtctaagtggccgggcgtggtggctcaggcctgtaattccagcactttgggaggccaagacaggcagattacttcaagtcatgagttcgagaccagcctggccaacatgatgaaaccccatttctactaaaaacagaaaaattagccaggtgtggtgatgggtgcctgtaatcccagccactcgagaggtagaggcagggagaattgcttgaactcaggagatggaggttgcagtgagccgagatcgtgccaccgcactccagcctgggtgaccaagcaagactccatctcaaaaaaaaaaaaaaaaaaagtaagtgaccatggactaacctttttgggccttatttgctttatttgtaaaatcaggacagtggctattagaaagaccccacagattaccattttattctttttttcaccaaacatttattagagacatgtcatgtataaaatgctttgctgaatcatctggggtaaacaggatgactaagactcagctcctgccctccaggagcttataatctcctgtggggaagagactcaaagtagtaaagatcaagtatgtcggtatgaaataattgctaaataggtcacgaaatattttgcggatgaggtggtatctgagtacaattttgctaagaagggtgaggggagaacaacctgtgaaaagggcctaaaacgcagagaaaagggccgaggcagtttagatatggcggaaggagtcctgacgaaagccacaagatcttaagagtcagcctccctatcctttgaagtggtggagttgtggacaaattagaacctcctgacctgtaaactgagattatttcatgcatcatgggattaaaagaaccaaaagaaattatgtctaaaacactttcctctcaaaattggaaatcactattttaaattatgaaagtaatgcatgtttcttgccagagaaatttaaaaaaaggtaagaagataaagtgaaaatagccatgctcagtggctcccgcctgcaatcttagcactttgggaggccaaggtgggggcatggcttgagaccagcctgggtaatacagcaagactctgcctctacaaaaaaaattttttaaatagctggtgtggtggcacatgtcttttgtcccagctacttgggaggctgaggcagaaggttcatatgagcctgggagtccaaggttgtagtgagctgtgatcacaccactgcactacagcctgggtgacagagcgggaccttgtcccaaaagaaggaaagaaagaacatgaaaataatgcatgatcctaccacgtagaggtaagtgttcattttttcttatttatttattttttatgttttagagagaaagtcttgctctgttccccaggctggagtgcggtagtgtaatcatagcttactgcagcctccaattcctgggctcaagtgattttcctgcctcagcctcctgagtaactgggactacaggacaccatacctggctaattattttttggagagatgggagtctcactatgttgcccagcctggtctcaaactcctgtgctcaaatgatcctctggtcttggcctcaaagtgctagggttataggtatgagcgtctattaacacaccaggtcatgttcattttctctatgtgaatatttttttcttaaaaataaatcatgatttatattatttgtttgcaatcagatttttttttaatgtcatgtaccatggttcacttcgtgtaacacgggttttttttttcatgttaatagatacggctttgtttattgactgaatagtatatatagatataccataattataatggattggtagacagattattattgttatacctcattttccacttgtccagtattttctttgggataagttcccagaagtggaattgttaggtcttttaaatctttctacataagtattgtcagtcttctaggaaagttatactattttactttttttttttttgagatgaagtctcgctctgtcacccaggctggagtgcagtggtgccatcttgcctcactacaacctctgactcccgggttcaagcaattctcctgcctcagcctcctgagtagctgggaccaccggcgtgtgccaccacgcctggctaatttttcgtattttttagtagagacggggtttcgctgtgttagccaggatggtctcgatctcctgacctcatgatctgcctacctcagcctcccaaagtgctgggattacaggtgtgagccaccacgcctggccacatttttaccatcagtatgtgagaatacttgtttgtttagcaccattgccaatactaagtattattcattttaatctttggctatctagtaggttaaaaatttgcatcttaatgtaaaggtgatttaattgtagaatacataccatatttgattaagaaccattgctttagtgtgactttgacctcctagggcatgggaactattaatagccattgtaatcaaccactgtgcttagcatttactgatcttggtagatatttattggattaaactaaatgttttctttggtgtgtgtgtgttttttttgtttgtttttttttttttttttttttttttttttttgagacggagttttgctcttgttgcccaggctggagtgcagtggtgcagtcttggctcactgcaacctccacctcccttgttcaagcgattatcctgcctcagcctcatgagtagctgggattgcaggcatgagccaccacgcctggctaattttgtatttttagtagacgggggtttctccatgttggtcaggctggtcttgaactcccgaccttaggtgatctgcctgcctcatcctcccaaagtgctgggattacaggcatgagccactgtgcccggccaactaaatgttatttttaattcatatctagacagcccgtgggagtaaggaaaatgattaaggataagttctgtttttttttaatgtaatgtgaattgctgaatgatcaatccaaaggtagggctttggccagctgcagggctgggaactatcatgtattgtgtctgttacttgtgttgggtgttctgctaggtaccgtattatgtagcatgtttactattttacaggaaagggttttaagccctaggttacacaactgagctggaattcattttatttatttattttttgagacagagtcttactgtgttgcccaggctggagtgcagtggcacgatctcggctcactgcaacctccgtctccctggttcaagtgattctcctgcctcagcctctggagcagctgggactacaggcgtgccaccaggcttggctaatttttgtatttttagtagagatggggtttcacattgttggccaggctggtcttgaactcctgacctcagttgatccgcctgcctcagcctccataagttttgggattacagctgtgagccaccacgcctggccttcagctggaattcaaaattgggtttgtcttttcgctctacaggcaccccttgacatgttggagggatgtagtcatgaataggcatgcataaatttttacttacagtcactttgtgtcctgcattttgttaatagtctctccctactcttacctaccaatgtgagggaggaagatgccctctaggagatggggagcacacctaaagtccctcaccctacctgggtcctccagataacctgtggaaggccatgcagaagatgtacgccacaggtagttcagtgaagacccctcatggctcttgtcaccagagctttcagataaaataggataatttatgttatataagtccaaatcaaaaatgtcagctttacaatgttgatatctcaattggataaggaagggatatagcacattagaattccctgtctcctgatgttcctgatgctggggaccatgtcaaacagtggcatgcgtacttgggaagtgttcaagatagctattatcattaaagtattatgtgttcttaattgttttgctttgactactgatttttcacaattcctgtttttattgttatattttttaaactgctgtataagttacaaaggagttgggccgggcatggtggcacacgcctataatctcagcattttgggaggccagggtgggcagatcgctttaactcaggactttgagaccatcctgggcagcatggtgaaatcttgctctacaaaaaatacaaaaatcaaccaggcatggtggatgcacctgtagtgtcagctactcaggaggctgaagtgggaggatcacttgagcctaggagatcgaggctgcagtgagctgagatcttgccactgcactccagcctgggcaacagagttgccctgtctcacacacacacacaaaaactatatatatatgagttttatttctagtgtattactgatcaagaagtaatggatgaagctgggcacagtggcacacacctgtagtgcaagttactcgggaaattcaggtgggaggattgctggagcccagaagttcaagactagcctgggcaccatagactctgtctttaaaaaaaaaaaaaaaagtagtagtaatggatgataatagtacagcattttaaatccatcactatagagatggtctgatcttactctcctcgatttagaagttggggaacaaatggaattatttgacaggtttacacaatcaataatgacagtgttgcagttagaaatcacatttctaagtcttcacagttctaatctgttaattgttgttattattttttttttttttgagatggagttttgctcttgttgcccaggctagagtgcaatggtgcgatcttggcttaccgcagcctctgcctcctgggttcaagggattctcctgcctcagccttcctgagtagctgggattacaggcatgcaccaccacacccggctaattttgtatttttagtagagacgggatttctccatgttggtcaggctgatctcgaactcccaacctcagatgatcggcccgcctcggcctcccaaagtgctgggattacaggcgtgagccaccgctcccggccccctgttaattgttattatgaagttgatggagattacattctattgttgagttagagatctatcagggagataaagcagtatcaccctgtactgttttggtgaccatgtgtggaatctgagattttctttttcttttcttttttttttttttttttttttacatttttaaagagttgggggaataaaacaaaaaatgtgtgacagagacccatgtggcctgagaagcttaaagtatttgctgtctagtcctttacagaagaagttgtctagcacctgcatgtagacatgaaaactaatagtattgcttttatgaaattgttgttgttgtttgagacagggtcttgctctgttgcccaggctggagagcagtggtgcagtcacagctcactacagcctcagcctcctgggctcaggtgatctcccacctcagcctcctgagtagctggggctacaggtgtgtgccaccatgcctgcctaatttttgtatttttttgtagagatggggttttgccatgttgctcaggctgtaatgaaatgatttgtttttttaaatatgccctctttaagaaaatttagtatataaacatgcaaatttagataaaatattcagaaaataattttagcatcatcacctaaagggttctttatggaagggctttcatccagtctgtttgaacaggaactctctacttgcgtaattgtatgtttacagatcgttaactatttggctgccagtcttaaagctgatgtgtctgtttcactgccagctgaaggccaaggaactgaagataggtagctggattatttcaagtatcgttggaaaccccttttctgtattggccactttaaaggtatattaattgtgtagaataaagtaaattattttattttactggaactattaggtgtgttgtgttttccaaacaataacttataatttagtgacttaatttttaaaattgtttgccattaagcattatttttatttttacttctatttatttatttttttattttatttttatttatttactttttttgagacggagtcttgctctcgttgcccaggctggagtgcagtggtgcgatttcgactcactgcagcctccgcctcctagattcaagtgtttctcctgcctcagcctctcgagtagctgggattacaaagtgcccgccaccatgcctggctaattttttttttgtatttttagtagagatagggtttcgtcatgttggccaggctggtctcaaactcctgacctcaggtgatccacccacctcagcctcccagagtgttgggattacaggcctaagccaccgtgcccagcaaaccatgatttttaaacgtatcagtgtcaaaggacagacatcctaaactttaatattttttatccttctaattgtataggtgaataaagagaagagggttcatgatggagtttttagtatcttcaaacactgtccagcttggttgtggcaaggcaactaaggaccaacccttggtccaatggctagaaaaagttttcctaagtttagtgaaggaggaatgtattatgagcttacactattaattgatctgttattgatgagaggtggacatttgagttttatttatatgagtaatgaatgattttaatagattgtggtaaatggccaggacaagcagttacagatgaagtatattatgaaaatagagattgtggttggaatcaagaaatagcgaagtttgggccagatgtcctggctcatgactgttaccataacattttaggagactgaagtgggaggattgcttgagttcaagaccagcctggttaacatagggagaccccatctctacaaaaaattaaaaaattagccaggcatggtggcacacccctgtagtcccgattacttaagctgaggtggagggattgcttgagcccaggaggttgaggctgcagtgagccataattgtgcactgtaccccagcttgggtgacagaatgagaccctgtctcaaaacaaaacagagaaacaagaaggaaacccacaaagcaacaaaaagaatatgaaggttggtgaaagatctgtacataagacatggtttctctatttggtaagcaagcagtctccttaaaagcaaagactttatgtcttgctgactgttaggagaacctgcctgaagagtattcgttgaatgtgggggacatacctgacacacttatagactgctggaagaaacacacgtctaagatgaccctctgcagtacagtgtgctattcagtctgcagtgtgctattgagagcacaaagagggcacttaaccaaacatgtggagtcaaagaaagcttcctagagaccagaagaagatagcgttctcccaggtgaggggaagggaagagtgttccagagagaagtgatggcatatgtgaaggtgtagagttgggagagaacgaggcctctgactagaagttcctgaaagaaattgtgtgtctagagcctagtatgttggtgggggacatggtgagagatgggcaggaaaggtaagggagcttttgtaagaatgttgacctttacattttgccctttacctgtaagaacagcaggaagaccctgacgggtttttttctcacatcttacgaaaattccaaacatacagaaaagttgaagggattttacagttaatacgcatatatctcaacctagattctaccattaacatttaattacatttgctttatcacatgtgtcctgctctcttacccattttttaaaaatgcatttcagtgtaagttgcagatatcagtacacttttcctctaaatacttcagcaagtgtatcattaactagaatgccctgatgaagggtcttaagagagagagtagcataatgagatcggttcaggaagatcactcagctgcaggatgggaatggattgggggctggtatatacttagtgaatgctcacttataagtggtgtgttaatagagtgaggagaagagaactgggaggaggccaaatgttaagttttgtgcctaaagacatgaaaagagaaaaacagtttaacaaacaatatgattggaagatgtgtataaccctagaacaagactgcatctttgcagatacctcagatcagattcctggaaaataggagataaaaagtgggattttgtttacagaacctttgttttcattagcttttcagaccttttatgaaacagatctgttttcagatgttgcatttgccatcaagacacatcatgtcagactgcatttaggtgtaaagaaagtgaaagctgcataatcccctgaggggtcttaagaggattttgaattgaagcttaagatgtatgaaaagaagaaatgggcttaagatgtttataaaatatgaatgttcaattttcaattaccagggtctgatgaggtggctcatgccataattgcagcactttgggaggctgaggcgggcagatcacttgaggccaggagttcgagactagcctgggcaacatggtgaaaccccatctctactaaaaccacaaaaactagccgggcatggtggcatgcgcctgtagtcccagctactcgagagtctgaggcaggagaatcactttaacccgggatgcggaggttgcagtgagccaagattgcgctattgcactccatcctgggtgacaaagtgagagtctgtctcaaaaaaaaaaaaaaaaaaaaaaaattcaaaaattttaattaccagatgttattaaagttgataaatgagagaggaggaagagtggttgatagaaattttgctcccagaaagattttgtttcaataaataaaatgcttcctgaaacattttaagaaccttcttcctgccaaagcactgtgtgaggtggtcagaatattcttgggaataagtttttgttttttccttattctgtttaccctaagagctaaagggagttgtacccttgcagaggttgacttggattctcttgggaggcatggattattctatgctaccaccaatctttgtgactgtagccttggcctcagtttccccatttgtaagaagaggggatttattacagttccttgtagccccaaaatgctgtgtttatgaaatgttatttattctcagtgtgaccatttctaacttgttacaagaagtgagaaattttgaaatcacagggtggggaaataatctgaaactactatgtttaacatactacatttatttgaccatatgctctttcctttttcaaattttatgttgtaaagtttacttaaaacacatctacagagtactgaatgttaagaggaatagctgtcatcatgtaaaattctagcagagaaaaaattaccagcatagtaaaacaaatttctgctacttcaagttagattcacaagactaggaacatatccacctgtcactcagaggaagtccacaaagaagagtgcattaattttctttctcttctgaaaatagtagtgattcttggaagtggagataacttttttcttcagagagtcataatacaaaaaataataaacagtctttttgttgttgttgttacatagattagaggtttctgtgttgcccaggctggcctcaaatgcctagccttgcctccttatgcaccaggacaacagccctgagccaccatggctcccaaacagtcttgctttaatggtctctaaagacaccagcactgttgagtattaggaagaatgtgccttggcattaaattcctatgaatccagacctggctctgtcatttcctacctgtgtgaacttggataaggtacttaactgagcctcagcatcctacctgccaaatgggagataatcacgcccctcagagttgttgtgttagttacagttggcaggatactcttgcaggtaggcactctgtaagtgttcactgctgtatgctgcttgctgcttctgtagagagggaagtgggaaccactagtggctccatttgactaaggtatgggcgaagggacataattctagtctttaatatttattgtgtggagacatgttgactttatcctttttgtgtcctagttttttaggcctttgcatttcaaactcattaatatacaatatagttttaaaatactctcaaagtaggtaaggggacgaaatttgtatcctgcatttagggatttgtgaaacttggatcaatttttggctgcaactgaattgatagcacttttttatggtttggtttgggttttttgtttttgtttttgggatagtgtctcactctgcttcccgggctggagtgcagtggcatgatcacagcttactgcagccttgattctcccatgcctgagctgtcctcccacctcagcctcctgagtagctgggaccacaggtgtgcaccaccacacctggccaatttttctatttttttgtagatagaggatctccctatcttgaccagactggccttcaactcctgggttcaagtaatcctcttgccttggccttccaaaatgctgaggtccatgccctgctgatagctttttgttgtttgagacaagatgtgtcagtggctgctctgtaggaggcttagaagtatacattttaggccgggtgtggtggctcacgcctgtaatcccagcactttgggaggccgaggcaggcagatcacgaggtcaagagatcctggccaacatggtgaaaccccttctctactaaaaataaaaaaattagctgggcgtggtggcgtgtgcctgtagtcccagctactcgggaggctgaggcaggagaattacttgaacctgggaggtggaggttgcagtgagccaagatcgcacccctgcactccagcctggcgaaagagggagactccgtctcaacgacaacaacaacaacaacaacaacagcaaaagtatacattttgctgtgaaaggagcagacataataggcacgtttgtcacatgtgctttttaggtactagggatgcagcagtgaacaaaatagaaatgcctatttttctggagcttgcttttgaggttgggggagactaagtaaaatacatagtatcttagtatgttcagtggaaaaaaaaataaagaatgttgggaggttgtaattctaaatgagatgggggaagaaaagctgggggtctcagtgactcatgcttgtaatcccagtgcttgggaggctaagtggaaggaatgcttgaggccgggagtttgagaccatcctggacaacataggaagaccctgttttaaaaatgagtgaatgaatgaagaaagataacagagtgagacctgtctttaaaatgaatgaatgaatgaatagtaaatacttgtttgtaagaaggaatgaatgaatgaggtggtcagggaggcctacctgaggaggtaatatttaagggaaggcaaaaaggaggttaggcaacatgcagatatctgaaggaactttgttctaggtagagggaatagtggatataaaggctttgaggttggaatcttatattaattatgtaagtcagtgttttgggggaagtggcaagatgatgataatgctttgtgcatattgaaatgtgaggtattcatgggacatccagtagtaatgactagtaagtagtttgggagaagctgagccttgaaggaagtctgtgggtcaccagattttaggtggaattgaagtcctggatttgcagtctctgggaattacatatagagtgagaagggcagaggactgaggaaggaaccctaggtaacaaatgttgggtagggatagaagagcagtctgcaaaaaagacttaggaccaaacacttcagaggcagctggtaaagaggatggtgtttctgaagttatagccaggcagtcttctctgacttctctgtctgcctcttctctctgccaactcccaaccaaatcagcctttgagtatagttgtctctgcctccataccttagttcagaactacctcattttttgctaggactccattaatagcctattgtcttgtctctttactcctaaacttactcttgtcagtcattcttccacacttttccatagcactctttctaaagtacctaaactgtgccagtggttcctcatcttcagaatagtctgaccttctcagcttggcataagatgcctttcatgatctggcctccactgtttgttttcaccttttgcttcctttccccttcacatcctaaatctcatgcattcaaattatttgtccttcctagaaggatgcttctttgcttctgggtctctgtatgtgcttttttcatgtgttcttacttcctggaatgacagactctccatggttcattaactgtacaagatttgactaaagcgttaccttttctgcaaagacttctgacttccaagtaaaaccaggctcttccctctgggctgacttcctgatttgttgcatatctctggtgtagttgtaatgacaatatcttgaaactgtttcgtatttgttatccccttccaatttatgagctcttagaggacaacaattttgatataaggatcttcatattcttagtgtttggcttagtttaataaatgtttaatgcagtggttttcttttttttttttttaatttgctgttaaaattttttttacacatttaaaaactataaatagagatgggatctcacttgatcacccaggctcttgaactcctgggctcaagtgatccacctgcctcggctcccaaagttctgggtttgcaggcatgagccaccacatccagccatggaatggttttcaatgtggcttctgtaccagcagtatcagcatctctggaaacttgttagaaatgcagattcttaggccccactcaatatttactggattagaaactaagggggtgggtcccagtaatctgtgttttaacaaacttctcaggtgattctgataccttataacaaatcctgcaggtgattctgatagttctaatagttagaaaattattaattcgtccagtgaaacgaatgattgacaacattcacagagaggaataaactctgatcttatgataagtggaggagaaccctgttcagtctttagaaaaaggaaacaaccatgctgtagtgatggctgcaagaaattaaaatagtgagcctatatagttagattgacagttttgtttttttgtttgtttgttttgagacggagtttcactcttgctgcctaggctggagtgcaatggcgcaatctcagctcactgcaacttccgcctcccgggttcaagcgattctcctgcctcagcctcccgagtaactgggattatagtcatgcaccaccacacctggctaattttgtatttttagtagagacggggtttctccatgttggtcaggctggtctctaactcccgacttaaggtgatccacccgccttggcctcccaaagtgctgtgattacaggcgtgagccactgtgcccggccaatagtatttttgatgtcatgaattcaggctcaaaatctgttctgaatctactaacttaaacctttagagattagttaaactaaaaggaagacacaagcttgttattgaaaaaattactcataatatcgccatcagagataaccaaattatcaatgattatttctagataatatgatttctattcttttgcttatgcatgagattttctgcagctacgtattttttatttggaagcctttatatttaagtaagttgaaatattaatattttaagaaataagttgaaataaactcatctgaagtttttacccttatgaaggtgtcttttcacttttttaaaactgacaaaaattgtgtatattgtgtacaatatgttttgaaatgtgtgtacattgtgggatggctcaatcaaggtagtgtcttttcattttctaacatttaaagtgggaattaaagaaataagataaatcctgggtcatattatatgtagttttacttaactaattactgcttatttttatggatctgtgtatgctttacaaaatacttattgaatattgtgttgttcagtaagcttctgttataaggctgggcactaggtttttacttacagtgcaaaacattgtttttgtgggataatccaaatcaagttgatatcattttaacttagaggatttctttcaggaaagtagcctgtcataagaataaaaaccttaagaaatcttgattcttttcctagttctagaacagattcaggctccttttaaaggaagatattcatagatctcttcacatggtgatttaaattatttttattatataaagtctaatgcttgtgtctgctgaggcaactagatatacttattttttttggcttatagttcccaaataactccaaaccccaaaattataaattaaatgtacttataaattaaatgccgtagaaactatactgatttataagtacttataaattaaatgccatagaaactatagaacttggtaaaattcaaattagaaacatcaatataacaactgatgttttgctgaaattaaatgccagtgttgggtttagtaatagaaagaaatatttttatattttattttttactggttatttccattttaagcattttaaacatgatcattatgggaatcattgtcatcatagatattactgtttttaaacctaatttctttttttgatgggccagtttaatggtactttgtaaaaatagtactgaaaaatacaaatttagtgtcaaattctttttttaaattaggtaaaattgtatatatttacagtacatgaagttttagagtatatatatgcattatggaatggctaaatcaagctaattaacatatgtattacctcacatagttgtcattgttgtgagaacacttaaatctaatctcttggcatttttcagtacagcatattgttaataactatagtcaccaagttgtacaataggtctcttgaaggtattcctcctgtctaactgaaattctgtaacctttgaccaacatctctctccccaactcccttccctaccatggccccagtccccggtaactactgttgtgttctcaacttctgtaagatcaactttttaaggttgcatgtatgagtgagatcatggagcatttgcttttcggtgcctggcttgttttatttaacacagcagtccccagtctttttgggcaccagaaaccgacttcatggaagacagtttttccatggactgggtggggacgtttcaggatgaaactcttttacctcagatcatcaggcattagttagattctcctaaggagcatgcagccttgatccccaggcgtgcgcagttcacattagggtttgggctcctatgagaatctaatgccggcactgctgatctgacgggaggtggagctcagcggtaatgctgtcggctcacctcctgctgtgtggcctcgttcctgacaggccatagactggtaccggtccacagcccagtgggttggggacccctgatttaacataatgatgaaccttccaggttcattcatattgttgcatatgatggaaattccttccttctttgaggctaaatagtattgcattgcgagtatgtgtgtgtataatatatatgtgtgtgtatgtgtatacatgtaacatatacacacacatatatattatacatacacatacccacaatgcaatactattatgtacatatgtgcatatacacacatacacgtaccagattttccttatctattcatttgttgatggagttgatggacaattaggttgataccatatcttggctattgtgaataatgccgcaatgaacatgggagtacagatatctctttaacgtatttacttcctttggatttcttactgtcaccttttttattacctatttaaggttacacttattgctgtgaagtattagaaaatgtttcataaaaagaaccagtctgcctggtgcagttgaatatggaattgactgctctgggatactttgaatttggcatgcctgtgtgttgactttcttttctgttctgtctgcatcacttggcttcaccttggccccagtaggattataaacaccattgcagaggtgggcactgcaatcttgtggcagcattcagatataaagacttaagacatatatgttttttttagcttaacatggaaatgaagacaatttttaaattcttagagaactcatagatcttcaggaataagtccttagattcaagcaactccagttttatatctataaatactattactatgattctaataagtccatgaacagtaacatgtaagtagcatttaaatactcacaatattaaaaagccctcaccaaaacattgaacagctagcctagttttgttttgttttgttttgagacagagcctcactctgttgcccaggctggagtgcagtggcgtgatcttggctcactgcaacctctacctcccggattcaagcagttctcctgcctcagtctcccgagtagctgggattacagatgcgcgccactgtgccctgctaattttttgtatttttagtagagatggggtttcaccatgctggccaggctggtctgaactcctgacctcgggatccacctcccttggcctcccaaagtgctaggattacaggcgtgagccaccgcgcctggcctagttagcctagttttaaacctttttaaaaaatacttgtgtcaaatttaaatcacgtgattttctgtcattaatacttttaagtctatttttaatttttgtctgttgtacatcccccctacactttttcttgcccaacttgttatccccattttctcaccatctctcctgctacgtatttattatggcttcatggttctgctaaaggtcacagttccctgtcctgatgtacagggaactgattgatgtgccatccttcccccttgattggcccttaggtggacatataactcaaactgggccaattaagagtctttacctgaggttcttcagattgaaagctaagagtaagagtcttttattccttgtagattaaactgggatgacatgagagtggaaattcctgaaacctaaggtgtttcactttaccttctcatctcctgaaaattatccgtagaggaagtcatttgcaataggataggacaagatttaacaagacggagagagaatcctggtcatgatggagtctgcatcttttttatcttttttttttcttcagacagagtcttgctttgttacccagcctggagtacagtggcacaatcttggctcactgcaacctccgcctcccaggtccaagagattcttctgcctcagcctcctgagcagctgggattacaggcatgcaccaccacgcctgactaatttttctacttttagtagagacggggtttcaccatgttggccaggctggtctcaaactcctgacctcaagtgatctgcctgcctcggcctcccaaagtgctgggattacaggtgtgagccaccatgcccagccaagtctgcatgtttaatactgtagctgctccattatatttcatcaaattgcctttttggttgaagctagttccagttgggtttttcacttggtactagaaagcatccttaaataatcggtgttataatttataagatttatcctttttttacatatctaggtgaagatggagctggaaaaacaagcttaataagaaaaattcagggaatagaggagtataagaaaggaagaggattggaatatttgtacttaaatgtgcatgatgaagacagggatggtgagtgtcatttgtaacataaatttctgaagtctattttgaggtgcactgccattcacattagtctttgattttttttagtgtgtaattttttactagaagttctgtgatgtcatgctggtcaagaaatagctatgtttagccatacttttattaatttgggattgggattcatatatgatacttttaagcatcttaaggtatcctggtgtgcagatacttctttcctaccatacttgaagaatctcagtttttcagttcatcttccctcagatagtgattgttttgttgactcccatttcactttctaattttctgataaaaatattatctactcagcttttttatctatcagctattttttcttctgtagatcacttgccttctcatttttgtatatgatatcttgagtatgcatatctctatctgctgatggtaaaaacataaacaagttatgcatcctctggttttggattaagaaatatgaagtagaggatgctacagttaagtcattttaggcctttagataaattagcagatggcctaaacagttgaactttactggcagttaagtcattttcggcctttaaataaattggtagatggcctaaattgttgaactttgtcaaagccaatagcacatctcctgtggagatgcactaaaataccaagtggtactgttagttggatgatgaaatgacttaatcttgttgccttggttactttgttttgtctgttgtagatcaaacaagatgtaatgtttggatcttagatggagacctatatcacaaaggcctccttaaattttcactggatgccgtatctctgaaggatactctagttatgctggttgttgacatgtcaaagccttggactgctttggattctttacagaaatgggcaagtgttgttagagaacatgttgacaaactgaaaatccctcctgaagaaatgaaacaaatggaacaaaagtgtaagtaatctagaaacagtaatgtaggtttcaaatacaaaatgtcttggctgactttaatcattaggaatttttgactataaaaaaggtttaatgaagtaagcatattgtaagtactttttttttttttttggagacaagagtcttgttctgtcacccaggctggagtgcagtggcgcaatcttggctcactgcaacctctgcctcctgggttcaagtagctggtattacgggcacctgccaccatgccctgctaatttttgtatttttagtagagacggggtttcaccatattggccaggctggtctcgcactcctgacctcatgatccaccccactcggcctcccagagtgctgggattacaggcgtgagccaccggcccagcctgtaactactgtttttaaaattctctttagatgatgtgctaggttttaatatagtttcaaattagaaacataagacacaatggtaaactgtttagtagagatgccttttctccttgccaaaaagctgtgtgtgttcattttggaaagtagctttgcagggtgaaaagattgaatctttcttcagctgctcattttcagcagtttcattttttaattcgtaatcttactgaccttgtcaaaatgaaatgtgcctagaaagatgttgacagtatacatataaagatattaaaatggttttatgatttataaagtacatattttgtacatgcctatgtgaattggagatttttatgggaattatgaaaattgtatgagtcatttctaacaggttgtaagccagcaacattttttatttttatttttgagtcagggtcccacactgttgcccaggctgaagtacagtggcacaatcttggttcactgcaacctctgcccgcccccccaccagctcaagccatcctcccatctcagccccctgagtagtacaggcacgtaccaccatgcctggctaattttttttattttttgtagacatagggttttgccatgttgcccaggctggtcttgaactcctgagctcaagcgatccaccttgctcagactcccaaagtgctgggattacaggcatgagccaccacgtccggctgcctgtaacattttttaatgtcacttagagttcttcatttgccaatattgtgctttgcataagaaaatacataggtgggccaggcgtggtggctcacgcctgtaatcccagcgctttgggaggctgaagcaggtggatcacgaggttaggagttcaagaccagcctggccaagatggtgaaaccctgtccctactaaaaatacaaaaaaaaaaaaaattagcccagcatggtggcgggtgcctgtaatcccacctacttgggaggctgaggcagggaattgcttgaacccaggaggcggagattgcagtgagctgagattgcgccactgtactccagcctgggcgacagagcaagactccgtctcaaaaaaaaaaaaaaaaaaagaaaggaaatacatagatgaactcctttgttattattcactgacagtaacttttaaagaaaaattgacagcttgctggaatttatgtgtaagaaaacagtaaaaacttaaaatgtatgtagtaaatcattgaaagagatgtctaaatgcttttaatttttttttttctgtttactattgcctgtggagtttttgttgttattgttcttccctaagtctagatttatcctagagtagtagttgttgaactgtggttccctggaccagcagcaccagtatcagtatagctgggaacatatcaaaagtacacatttttcactccccatcctggaccactgaattagaaactcttgagggtggaaacagtaatctgtgatgtaacaagcctttgaagtgattctggtgcatgataaaatttgacagccactattagattacagcctctgatcttaagagtggtagtcaccagggctgctaagggtacatacagacccctgtgtttctagaggaacggtgcccacctgttcgggattccctattccttgaccccatgtaaattcagaacagttttcctccatatgagtcagtcttcatgatccaaagatctggctcataattactttaagagaaaacacacattttttttctaagtaagtaataatgtacattctttgttttttgaaaattgaaaatagggctgggcgcagtggctcacgcctgtaatcccaacacttggggaggccaaggcaggtggatcacaagtcgggaattcaagactagcctggccgatatgatgaaaccccgtcttttctaaaaatacaaaaattagccaggcgtggtggtgggcgcctgtagtcccagccccttgggaggctgaggcaggagaatcacttgaacgcaggaggcgggggttgcagtgagtgagattgcgccactgcattccagcctggtgacacagtgagcctccatctcaaaaaaaaaaaaaaaaaaattgaaaatagccggtcacagtggctcacctctgttatcccaacactttgggatgctgaggtgggaggatggcttgagcccagagtttgagaccagcctgggcaacatagtgagaccccatctctacaaaaataaaaagttagccaggtgtggtggcacatgcctgtagctactcactcgggaggttgagccagaaaatcacttgggtcagggctgtagtgagccatgattgcaccgctgcactccagcatgggtgacagagcaagaccctgtctctaaataaataactaatacttttgtgtatttttcccagtatttttatttctaagctggaatcatacgttggccttcttttatttatgtatcttttaatgttactatttcctacaacgttaaatattctttgaaaacttgacatcttatggttgtgtataattttttctcatatactattttaatcctatgctatagacagtttgtttccaaatttgttttgcttttatacatgaagaaaagagttacgtggaaatccctatgtatgtgcatcactgattgtgcccttgagaattcctaggcgagtaattacggagtctaaacatacattttcaagtctcttgatacattcacatttactttatattttttagtgacagttttgacaaccttgcaaataactcctaaaaactgatcagcactggtaatatttcattaagttgtaccagagttacagaatgagcatggcccaagattgagcctaggtaaaaaaggagagacctgagtaaagggtttagtgaaagaagttagtattagaaaatcatctagactatcttttaagttatgggatttttttctcccacatttatttttcttttatccatacagtgccctttgtgaattagagaaggtagagagacaaaactaattgtgacttgaccaaaatattttgcataaattgagccaggtctagatagaaccctactttgtagagccatcccctgcagtagtaatattctgtctcctaattattactgtgggtccagtgtttgtatattctctttgaaataggtttctcaaaccctttttgtttcttctcttacacaagactaagtataaattcgagtaaattttatctttagattatggcaagaaaagttacctgctgaaatgaagcaatttctaaattgtgtttactttgattttcagtgattagagacttccaagaatatgtagagccaggagaagacttcccggcttctccccagagaagaaatactgcgtcacaagaagacaaagatgacagtgtagttttacctctgggtgcggatacacttacacataacttgggcattccagtactagtagtttgcacaaaggttagtttgcttcctagggattctgcaactgatattcactgaggatgaacaactgttttgttttccaggttttttggagttaacacattagttctcctagatgattttttgttaacaaacaaataatagtttaaagtatttaatgatattaacatgttgcttttgtggtcttaattatagtttctttgaaagaaaatgttatttcaaatacttgtgattgaatttcattttcataattccaattgaacttcattgtatgatcaatcagtttagtagaaataattacaggtaaaatgatagtttattggtttttataaaattatttttcaacattaatttttttttttttttttttgagacggagttttgctcttgttgcccaggctggagtacaatggaacaatctcggctcactgcaacctccgcttcccgggttaaagcaattctcctgcctcagcctccgtagtagctgggattacaggcacccaccaccactcccacctaattttttgtatttttagtagagacgggctttcaccatgttggccagcctggtctcaaactcttgacctcaggtgacccacccgccttggcctcccaaagtgctgggattgcaggtgtgagccactgtgcccagcctcaacattaaatttttatatattctctaatatcagaggattatatacttaaagtagacttttaaacatgtagcagcactcattatataaagttaacatgcagtcatcaagggtttctgttttttaaagaggttctgataggaccactattatcaaaattatattattggttatttcactgtatatattttgtaataaaattaagtttcctttaaaaataattaatagaaggtgaggcatggtggctcacacctgtaatcccagcactttgggaggctgaggcgggtggatcacgaggtcaggagatcgagaccatcctggctaaaacggtgaaacccctcctctaccaaaaaaaaatacaaaaaaattagccaggcgtggtggcgggcgcctttagtcccagctactcaggaggctgaagcgggagaatggcatgtactcgggaggtggagcttgcagtgagccgagattgcgccactgcaccccaacctgggctacagagtgagactctgtctcaaaattaaataaataaataaatacataaataaaaataattaatagatcagctgggcgtggtggctcacgcctgtaatcccagcattttgggaggtcgaggtgggcggatcatgagatcaggagatcgagaccatcctggctaacatggtgaaaccccatctctactaaaaatacaaaaaattagccaggcatggtggcgggcgcctgtagtcccagctactcgggaggctgaggcaggagaatggcgtgaacctgggaggcagagcttgcagtgagctgagattgcgccactgcactccagcctgggcgacagagactccatctcaaaataataataataataataataatagatcaatttcatgttctccccacttggtcctaagtgtgtgtttttactgttcgtaagtcatggaatagttaagaaaatgacagaacataagtccttttgagacctgaaattaatgccttttattatgtaaaatttgcacatgtaaaattaaaggagggtatagaatttattcattgttggagtaaaattgattaaaaaatctaaaacctagcttaggttttactttgctacaaaaattatccataacaaaggaatggagtgacggcacttaaaataattaagttaaagtctgccatctgctttcaaatggtggttttggtatagttaattgttacatacaccttttctgtaaaacactatcttaaaatctcacactgaaatccttctgtgtgctttgttttttattttgttttggttggtgaagagctgtttgtttattggaagttggttccattggttccgtcagcactacttgccttatgaaaagcagtcttactttccaaaagaaaaatgttaagcttaaagggtccggaatcagtatcaaatgagtcatagagtcataacattttcaaaccagaatagatcatctactgtatttcataaaatctaagacactatcagatgtatttcagtttatgaacttttaaaatgtataggggtatggagaaatgtgtgtttccaaagggagagaagtatggtggttcaacgccatcagtttaaagactccggaaatggagatttctcttagtcttagaaacttagtctctctaagtttcttgtcttaagtccagatcctctgatttcagttaaaaaaaatttttttttttttttatatggagccttgcactgtcacccaggctagagtgcggtggcgcaatcttggctcacagcgagctccgcctcctaggtgcacgccattctcctgcctcagcctcccgagtagctgggaccacaggcgcccgccaccatggccggctaatttttttgtatttttagtggagacggggtttcaccgtgttagccaggatggtctcgatctcctgacctcgtgatctgcccacctcgacctcccaaagtgctgggattacaggcgtgagccaccgcgcctggccttaaaatatttttatttaatactaaaccaccatgcctttccaaaagtgtcaataagtcaaagtataataattatttttaatcatttgaaatcactgtcagtatttgataaaatgggcaatgaaatgctcctcataattatataatgagactctgttctgtgccgtatatatgtttttattttcatttttgtggagagttttgctatgttgcccaggtagtcttgaactcctaggctcaatcctcctgcctcaccttccaaagtagtacaggcacataccactgcaccctgttaggttttttttttttttttgctattttatatatatatataaattttatatatatatataataaattatatatatataattatatatatatattatatatataaattatatatatatattatatatataaattatatatatatattatatataaatatatatatattatatatataaattatatatatattatatatatattatatatataaattatatatatatattatatatataaattatatatatatatatgtaacaaaaaaattacatagcagatttaaccccaaactaatattaggtgtaatgaccattattaaatgtttatttttatattttacacctgcaattcagaagggttttggtgaaattatttggatgtcgtgatgtttgaacatgccttttttgtatttttcttagcatttttctgtagcaagcagaattcagaattgtctcattgattgtacaggcgacatttcaaaaatcagttgtagtttccttattttgttattagtgagattgtaataagagtgaataaaagcaccagaaaagaaattaaggtcacttgagaattatcagataaacacaggaacaaagaagaaatggtgagaagtagagactccctggatatgcagaagtgttttataaaactaaaatagatgttagattttttaaaactttgttccaggttataagtagttgagttattagcaagtatgatttcttagaacaagctaggcttgttattcttccttcccttaggtactaaaactttgtctttggtgttctgaccagatttaacattaacgttgaagttaatgctttttaaaaagataaaattatccattagtccctccaactaaaagttcatagggtacttgatattctgtgtcctgctgttcattcaccatatcagagtggtacttttatgatgttcccctatccagaattgaactgtttaaattactatatttagttatgattattttaaatgtattatttttaattattttaacttaacagtgtgatgccattagtgtattggagaaagaacatgactacagagatgaacattttgattttattcagtcacatatccggaagttttgtttacagtgtatccttttaaatacatttattgattcagtgtatcactttacctgttttagttttttaaagttaaaagaattaaattgatggacttgagaaattctgtaaacatttctccttctgtctctggttggaaatttcattttagttcccaaattatttacatttggatattttgagatagaaaagcaaatattgaagtatgttactttgatttgctgtgtttaaagtatgcttaagaaaaataattaccaattgtatgtggaaaagtctagtaagctgtatgtagttatgaacatatctgattaaaaaactgtatttattggtgggtggtaggacaaggtcagtattgtgttttttgtgttttcatttttaatttgtttagtgtgttgtcatcttctccacatatagcctaacagtggtttcaaaatctggctctgcctatctagacatattggattggagtattccaaagtgaggctggagaatcatctaaactttagaaaccttcctggaaaatctatcatagaaagtcttgttaatctagattgcaaggattaggtgagccagtgagtaataattacagctaaaatagggagaaaatgaaggttaaaagtgagtactttttagagactttactgttgaaaacttagttacaccttgaatgcactgaagagtaaactcaccaaccctcttggatcagatattttgcagttgcattccccagccaaagtttttgagtctgaaacataatgaaatgattattaggaatagatagtaatgagtaatacacacgtttatggtgtctacaaattataaatcattttcattagtgggcgtttaatttaaggaccacttaaagaaagcctgaataagatcacttgacactgatagtttccctttccccttttctcttcagttctttctctttatgggcctttctcttctcatgtcaccaaatggctgagttggttgagttaaagggtactagtctaccatagtgtcttcaaaaataaaataaaaagtgagggtaattgtagtgtaggtatctgtagcctcttttttatgttatctttggggattagaaaatttgagagtaaacagtctctttaatcatttatttaatgctatacttaaaaatgtaagtacagaaatgtaatcagaaaggaagctttctaccaaaatagagaccattagagccagttgattttaaaagaatacaaaatgtgagaagtcatctcaagataatgaggtatgtatttatcagtgacagtgacagttcaaaatcacctttattttattaaatttttaattgcaatgtaagtttttcagttacagaaatcttccaaattatcataatttggttttcattgtggggaagagcattaatgcaaagttaatacagttaaacttttgcctaagattatgtttgtctctaccatgttaaagtttcgtatcaaagtaagtttagtaagttgtatttagcaatactgcttttaggtttataagcctcaggtcatgtcccagaaaatatgagtatcccagttaagaagttagactgtactcccagcatttcccccttggcctaggtcaccatctcccttggagaaacaagggccagtgctagaatgtggatggtcatagaatttctgatagccactctgaatccatcatctgtcagtggtcacattgtccatggatgtcttaatatttacatccactgtgtcttttggataaaaggtcaaagttaggctctgctttaatacatcttgatgtgaggttgtgttatttcaagttttgtcatgaaatgtgcttttgccttgggttattcctgaaagcttcctaattggtacctgctggctcacctttcaacattgggtttcttttgctctctccagtgagtctcctgagccttatccctgaagtctttaattcctgggttttgtaaaaactacaaagagacactgttaacacaccatttttgttgaaaaggcaaacaaaacagctgttgataaataatatcccctctatgaagtttaggaaagttaaaacataaaaattgtcctttcatgtgctttaaatatagaagtagtcatggtgtcagtatttctagatttacctttacttcttgtcttaatgagacttctgccttcctaagttaaattgattatgtaaaaattcttttattaattgtagcccatatgaaggtagtattttttacttttgaagttcttgattaccatataatatacctttggagttatttctgaaactaaaatgcatagaaataaaagttaagctgaaaacacagaattttatggtatttgctcatgacatttgtccagaatttttctttaaccatattattcagatggtgcagcacttatttacacttcagtaaaagaaaacaaaaatatagacttagtatataaatacatcgttcagaaactatatggatttccctataagattcctgctgttgttgtggaaaaggatgcagtatttatgtaagtgtactcttaaatatataattttatcatgtattattgctactatttgatggtgaatcattatttcagttttgagatgggaccaatagaccttccatgatgagaaagtgagaatctatctgttcctagattgttttttgtttataacctgtcttgatttatctattattgccttttagatttactgctggcctgagccctttttcaaaggtttttgagctaaactgtctactgggtgcctatattagtgtattgtatctgcttattctttaattgattatgatacataaatgaccaaatatgagatctagacatgcttttaaaaattacctggctgagcacggtggctcacgcttctaatcccagcactttgggaggccaagagcagatcacctgatgtcaggagttcgagacaagcctggccaacatggcgaaaccccctctctaatgaaaaatacaaaaattagcccgggtgtggtggtgcacacctgtagtcccagctacttgggaggctgaggcacaagaattacttgaacctgggaggcagaagttgcagtgaaccgaaatcgcaccacttcactccagcttaggtgacagatcgagactccatttcaaaaaaaaaaaaaaaaagaaagttacctgaatagtccaggtgcagtggctcatgcctaaaatcccagcactttgggaggctgaggtggaaggattatttgagcccaagagcccaagactagcctgagcaacatcgtgagaccccatctctaccagtaatttaaaaatcagccagatgtggtacacacctgtggttcagctacttgggaggctgaggtgggaggatcacttgagcctgggagacagaggctgcagtgagccatggttgagccactgtactccaacctgggcaacaaagcaagactctgtctcaaaaaaaaaaaaaaaaaggtaaccgtataaaattgggaggtaataattactgcccccttcccccaagttaacactaatgacatttttaatattggtaatcttttttgagacagggtctcactcctgttgcccatcctggaatgcaatggtgcgatctcggctcacttcagctcctgcctcccaggctcaagcgattctcctgtctcaacctcctaagtagctgggactacaggtgcatgccaccatgcatgcccagctaattttttttcttttttattttttgtagagatggtgttttggcatgttgcccaggctttcattttaagtagaaattagtaaaacgtggacatcataatgaaaagctaattcgttttccataattgttcaaattgacttcatgaaagtattccttttacatgatcttggactgaatgaaagaatgactatataaatgcttgagaatttatcatatgtatttctttccagtccagcagggtgggataatgataagaaaataggaatattacatgaaaattttcaaacattaaaagcagaagataattttgaagacatcataactaaaccacctgttcgaaaggtaaccattttagtaaataatctcaatatttagactttagactaacctgaggggaattccatactttaaaattaaatgtagaaaggcaaaaatgtccttttccatctggagggtttctaagtataattttggtgtgtttctaatgtacagtttacataaggatttgttttagcaaaatagaaatcagctattcagctaattaaatcttcgcccttggcatatttatattagcaattgttagtgcagaatccacattctaatatagtgctttggaaatcagattggcatgagtgaatatgtggatcttacagagtttgaataggtagaagctgtgaactttccaacctagagcttggccaagagccaagaaaacattgctagaataattctgttggttctatctattgaggcaggtcttggatcttctctccagttagttacccacattagctcacagctatccaagaactttcaattttatatatatatatatatatacacacattttttttttttttttgagatggagtctcactgtgttacccagcctggagtaaaatggcatgatctcagctcactgcaacctctgcctcccaggttcaagcgattctgtcgcctcagcctcccgagtagctgggattacaggcacccaccatcgtgcccagctaatttttttgtatttttgtagaaatgggtttcaccatgttggccaggctggtcttgaactcctgacctcaaatgatccgctcacctcggcctcccaaagtgctgggattacaggtgtgagccactgcacccggcccagttttagtctcgactctaacatatcaatctatccaatcagatcccagaagatacactgctttcctatatcttgacttcatgcagtgtataatgttctatagatagagatgtttctgaaagctctataaaaatgagtatttgcataaataaattgactatccctaatctgaaaatccaaaatgctcaaaaatctgaaacactttgagctccaacatgactctcaaaaggaaatgcttattgaaacattttggattttcagattacggatgctgaactgataagtattaatgcaaatattcagcaatctgaaacacttccacttctggtcgcaagcatttcggatgaaggatactcaacttgtagtagttctcactgactgactttaatcttgacatatatatcaagaaaaaataatttttatttagcatataagagtcttcagaatccaaacactcataatataaagcatccatcttctgtttgtgggttattattagtaataagaaaaggtcaaatgaaaaatcagttggtgtggtatttggtttggatgtctattaaaagaaatgcatgcataaaaataaaatagcaaaaatatttcacattcttttattgagcatcacctcaggccctgtttaggttctaagtgctaaatgggaaggagagtgatacctatagtaaaccaatacatagacatctgtcaagtagtgataagtgctacagaaataaagcaggatgtagggagagtgagcaaggggactgggctgtgagggatgctgtatatgaatgatgggggaaggtctttgataaaggggggagaatgctgaaggcagggggaactaaaagtgtacatgccctgaggcagaaatgtatgaggaagacagaggcaggaaagagctgtggggaaggttaagctagttgatgagaggcagaagtaagttactgtgggtctttatcattaggctacagtaaggactttaggtttcattctgagttagatggaaagagattgagaggttgagcagaggagtgatgtaatctgacttaaccttttagaagaatcactggctcctgggaagaaaatagactgggtatgtgttatacagcaagaatagaagcaggagacttctgcaattccttttcctaattattcagctcatagaagagccattatatttttatttcagagaaacaagggagaagttgcatttcacttaactaggatattactggcccttttaaaacaccctaactgctgtttagcaaattttataagcatgattaatatgcttgtgactctagggttgtgctgttcaatacggtagccacttgcctcatatgccttttaaatgtaaaattagataaaattaaaaatcatttccttagtcacactagccacatttcaagtgctcagtagccactggtggctagtgactgccatattgaacagcacagatatagaatatttccaaaactgtagctagttactggacacctctgctgaaggccttgggtagggcagctcacgcatgtgaatataaatatagtataggtaatgttcaaattcttgaactgttttttaattagtccaatctagagaataaattattaattgtgttagcataatatattaaatttgctcatttgtgcattgctcatttcagtttgtacatgagaaggaaattatggcagaagatgatcaggtgtttcttatgaagctacaggtatgaaattatatcagaagcagacttagtatggttaatgggtaaactgttcttgtgtgtattttctttaaaaatacaccagtatatgctatgaatgtctaaactaggattctttttttttttttttttcagtcccttttagcaaagcaaccaccaactgcagctggaaggcctgtggtcagtattacaaattttgacaaaatgattaaaatgcagtacatattattttagttattttttattaattatgtacatatttcatatgggtgtgctttgatataaacttgaattcagaattcttctgtaatttgtgagattttaaaagtgtaaagatctatttgtaacatttgttgtgtgtcaatactcagccatttatatgtcattttacaaattctcacaaccgccttatgaggcaggactgttattagccccattttgcagatgaggaaatgggaaccttagggaggacgttgtggcttgcctgagattataaagctagtagaatacaagtccagattggaaaccaagtctgactcccaagcttctaaccatacatcatcactcaatatgttctttattttctatgagaggaaaaatttgtatgttaaaatgtgatgggcctctgtctggcattctctaataatgaggacaggattgctaacaattttgtcaatggcttgcagtgtaaaagtaccagtagaacaggggatagttgcaaagtaatttctttttacaataataacttttgtgaaaatgaaagtttcaggtttttataattgtattttcctatttttacataggatgcctcaccaagagtcccaggaggctccccacgaacaccaaatagatctgtatcatctaatgttgccagcgtgtcacccattcctgctgggtcaaaaaaaattgatccaaacatgaaaggtacatctctttctaggagataacaagacaatacattttacaagagaaataaatctatctaaaattccaccttttgccataactattttcattcttgtgtaataccttttaggctttgtctctatggatatataatctcatagttaaccagattgtaaaccattttacagtgtatttgtgatgtatcatcatttccatgataaaagttttgttatatttaatcaatttcctggtagatcattgaagaaattcacatttacactataataagtaatctgcaattaacataaaggaaaaaactatatgcataatagttatttctgtaggaataattgccataagtgggattagtaggtcaaagagtttatgtttttatgcctttggataatattttttcaaatgattattcaactttgcttatcatcaacattgagtgttgcagttttaccacaacctaattaacatgctttaaatactacctaataagagtttttcctctagtgttttccttctatttgtgtttctcttctgtgaattgtttattgctatcatttgcccatttatctctggcaacttctaccggttttcatataggattctgtaacttttcctaatacttgaggcagtttctcaacagttctatttttaaagaatccttttcaaaagggagatatatattagtatataacatctttttgtttaaaatacctttggccttttaaaaataacattctaatttttaaataattattttacacttaaagtttactcattagagaaattactcagcatcaaaagatcaaactagacttgaatttggaatataaaactcttaaaatttaagtttattcattttctatgtgtgattactgtaataataatttaaggaagaatcttatgttttggctaaagctttttgtttttttatttttttatagctggagctacaagtgaaggcgttctggcaaatttcttcaacagtttgttgagtaaaaagactggctctccaggaggccctggtgtgagtggtggtagccctgcaggtggggctggaggtggaagcagtggtttaccaccatccaccaaaaagtcaggtatgcttatgggaagcaagtcacttgtttaaaataacagcttttttgagatataatgaagttcactcatgtaaagtgtataattctgtggttttggtatctttgctaagttgggcaggccatcaccataatctgattttagaacatttttatctccccaaaagaaaccttgaaccttctctctttcctctgtggatttgtctatctggacatttcatgtaaatggagtcatacaatgtatggctttaacaaatgtttttgaaggtcatacatgttgtaatatgtatcaatatttcatttcttttttttttttttttttttttttttttttttgagatggagtcttgttctgttgcccaggctggagtgcagtggcacgatactgcagcctccgcctccagggttcaagtgagtctcctgccccagcctcctgagtagctgggatcacaggcacctgccaccatgcctggctaatttttgtatttttagtagaaacggtgtttcaccgtgttggccaggctggtctcgaattcctggcctcaagtgatcctcccacctcagcctcccaaagtgctgggattacagacatgagccaccatgcctggccttcattcctttttaattgctgaataatatttcattatatggctataccacatttcatttatctgtttactgggtaatggacatctgagtttcatctactttttgactattattaatatggtgctgctttgaacatccgtttttgtgtggatatttgtttgtaattctcttgggtaaatacctaagtggaattattgggttgtgtagtaactcggtttaaacaaaggttttgaaggactgccaaaatgttttccaaaatgctgtatcattttaaattgtcatcagcaggttaggaaagttcgtttctccatatccttgccacatttttattgtcatctgttgttaccactcattcatcttctctagatgctacatttttgttgctattttctgttttaccgttcttattgtcctatgccttaaaaaaaaaaacctttatgagattaaatgataggtgccagttatacctccatttggtaacagatccacaatttaaaatgagggaatttgttttttcttgaaatttatattatttttattttttagacagagtctcactctgttgtctaggttggagtgcagtggtgtgatctcagctcactgcaacctccacctgccgggttcaagcagttctcctgcctcagcctcccaagtagctgggattacagcagggtttcaccatgttggccgggctggtctcgaactcctgacttgaagtgatcctcccaccttggcctcccaaagtgctgagattacaggcgtgagccaccacacccagcttgaaatttttaaattaagtgttgtttgtataacttagtgtgctaaataaagttaatgaaagtgttaggactttttaaatgaagagatattggtgaaaacgatactttcacttatatctaaatcttgttttttttctttttcttcaatgtaggccagaagcctgtcttagatgttcatgcagaactagacagaattacacgaaaaccagttacagtttctcccacaacacctacatctcctacggaaggagaagcttcttgaagataccaaataaagccatttattctgttttctgggataatgtaaacatgcctctgccttttccttcaaaagtggaattagaaagctggagtgcttcttcagatggactaaatttatgtcgtgtgtgtgtgtgtgtgtgtgtgtggttacccattttttagaaggagccgtacagaagaaaaattattctacattatgtaggattgctgtttgcattgccattttgcataagaaagtaatttttgattttgaaaatctcaaaacttttagatctgaaatacagccatgtgatcgatcatattctaaaggctatttaaaacatgtaaaaggatttggggaacggcagaaaacatgcagtttgggcatttgactgacttggaagtctaagcttattttagttataactattaaaatcatttttaaaaatttgttagttttgctgacagagaaaaatcgtcagttgtcagattttgcacaccacaataaatgtaccaccacacacggaatatgctaagaaaactatcagatagcgtttgatacactagtcattgtctcaatcactgatcctgtaagttgtcatcaaaatatgatttagaaatattggccaaggtgttgctttaactgaggagaaaagaaagcacactgcctaaatgtgtaaaagaaaaatgcagaggttattaaaatgtaaagaagtaacaatctttggatttgtctatacatatatatatatatatatggctttgccttaatatacccccttttttgtttgtgactttcaactgtaatcagttaataaagtatttattctctgcattcaggttc

SEQ ID NO: 38262 - DNA, 10070 bp, Homo sapiens
cggcggcggcggcggcggcggcggcggcggagcccggagcgcaggccggaggctcccggcccgccggccccggagcggagcggagcggaggatgcagcagccgcagccgcaggggcagcagcagccggggccggggcagcagctggggggccagggggcggcgccgggggccgggggcggcccaggggggggcccggggccggggccctgcctgaggcgagagctgaagctgctcgagtccatcttccaccgcggccacgagcgcttccgcattgccagcgcctgcctggacgagctgagctgcgagttcctgctggctggggccggaggggccggggcgggggccgcgcccggaccgcatctccccccacgggggtcggtgcctggggatcctgtccgcatccactgcaacatcacggtgaggaccccctcgcgtgcgcctctgtgggggccccttgtcagggacccaggatcactccatccagctttttgctctcgaaggacctgggaggccgaagcccctctcagggctcagttctttctctccaggttacatttgtttctgctgcttgaggttatgcagtgcacccagaatctctaccattgaccccaatagcaagggacaccccgacatatggcgcctagactacccgtttccacgaacccacccacatcccaaggttcatgattttggctctttttggctactcctccacaactttaccttgccacctaggaatgcgtctttcttccccttactcttatttcaaggttttaggcctcggcactgaccctaactgcaaagacctggcctgaaactcactgcacatttcagcgatgcccccttctcagtagtacctctgacttaggaggttgccacctgtgggatccccgcctaggcatccctcatgcagaccctcttgctctctcaacttcaccaagtgatagtttgcaattcattgactcctcttccttctctcctttggattctttttctggtgtaacctctaactctcctctttttgcctcagctggtagcagttctgccactcccctgcctgttccctatggatatgtccatttgccctgggttgttgcttttcctggtaatgatagtgatgtgatgtgcgagggctacccccatttattctaagcagtaacagttgcatttctcccctgtgagcgtcattccatcctaggcatacaccttacatgtctcctgcctggtctaccctcagacatcccttgaacagagaattggcttctgctaatttgggaatgtctggtactgcatgctatagcacttatattggttgatgttacctgctgtgatggtattctctctaccggagcagtagctgaaatgctagcagacagtactttatccaggcaggcagacctaatcggagtagcctggggaaaggcagagttgtgaattctctgctacttgggggcctgaattcaacttactggtgttttctgtccgttttctcaatcaaaccaagttaagatttggtgaggtaaagcctcagtttggattgattggtgccccaccaaaactcatatgtcccatttctcttttcatttcctttcttttttcctgctagaaagttaaaattgaaggactaggagtggcttagttaagtgaagacttgggcatctttgataattatttttcctccagcattgaggattagagtcatggcaatgctaagatacccagtagaggtggataaggtttccctggcttgtgtgggaacctcgagttaattttgttcctgaattaagcttctaattccttaagggtaggtttgcccctatccagctgctctttctgttgccagaggccatttactgcgtttgtccctggcaggaagttaaatttagggggtcctcagccagactccccatggctataaaggagacttggcctaaactagcccccttggtttgggcagagagggagtctggtcaggctgcatttggcaccgtggctcaggaatgctgggaatgtcagtagcgtaggcttctttctcccagcctgccatgtggagccctacagcccacgcctggactgagaaggtggcaggttcccaagggagaggtggggagaattggtctttgaggggctcttctggaagtggtgtgggtagattcttgccagtacccttttactcttgggttctggagatacagtctagtttttatacttcttccctactgaactctgcttttttcacttcagtgtcattgtgatgaggtgatcccttcctcagccgattctggagtttgaaaagcaagcttggaggactgttctgggtccagggagaacttgaagtctagaacttgtataggcagtgcaggagatgaggagtcccccttcgctgttagccaagtttggctgtgctaggtttcctggtttgtactctcgaggaaagaaagaaaaggtttcagtctgcttctcggaaagggtcttcccagggactgtttttcttccagtttagaatttgttgtgaagctgcttggttagatgctgacctaagttgggcttttatgtgtgtgtagggggtgggggtgggaagcaaaggggctagaagtcttggggggaagaggacaggcaaaatctggcttttcccagagtcacccattttgattgctcttattgctcttttcccttcaggagtcataccctgctgtgccccccatctggtcggtggagtctgatgaccctaacttggctgctgtcttggagaggctggtggacataaagaaagggaatactctggtgagggggccacagggtaggggtacattttgttcttatgaggcccatgccacaaaggcatcctgtgaaagggatcctgaaaagtggacggtacacagctaaacatttaggggatgacctctcgggggagttgcttactgaagccagagggagaccctgcatcggccctgggattggtccatcaggagactcattcccacagccacgtggcccataaggcttagagaactagttattggtgtggggcccaaactaagagctcatccatgcacttatccagatcggagtggggaaggatttgatgtctctgtgctcccctacctgtagctattgcagcatctgaagaggatcatctccgacctgtgtaaactctataacctccctcagcatccagatgtggagatgctggatcaacccttgccagcagagcaggtgagcagctgaggagcctcgggccctgttgtgcagagttgccccacagggtactcagtaaataattgagacaaatcagtagtttctctccatccccaccggctcccaaaaacatacacgtcttatgactctcaccctcgttcttctccagatgggaatcttcttttgctaaatggggcactggtagcttcatctctgatatcaaaattcattctcatgggcagcatcccagatgttgaaagggagcgggggaatttttaccattatcttagcaataacagttggtggccactggggacccaggccccttggtgagaaccaagaatgcaatatcagtctaaagaagatcaagtaaaggaggggttcttaggagaattaaactaggatttaggaggtgggtgacagagacagccattttgcttttcttttattctttggcagtgataggcgaaaaataatgggctggtagcaaagccattccctgggctgttgcttccactcagatctggctggtggagagactggcagcattacaggcaggcgcacaacttccagacctgggggctcaggggagtaggttggaggctgcattctagcaagccactggggctctgatctccatctttcccttccttgctgcagtgcacacaggaagacgtgtcttcagaagatgaagatgaggagatgcctgaggtaggcttgccccctgaggtggcattggctggaagctcttgcagtcagcaacattggtacccatatccagaactccagtctaaaactggagagagaaaaatatcaaaggaataaagacagatttactgacctggaggaatagccagtgtagtagaggagacagggcacccatatccaaccactgaagacaggtgcagcgcggttcaaaccaaatactgggtaagttaatttcaaatggctttggagtccaacaaacctgtgtttgcatcctagctatcctaattgaggaattttatgtaatctcactaagctacagttttcttatctataaagtaggattataatacctactgcatatggttgtcttgagattaaatgaggtgttatatataaaatgcttcagatgatacatgataaatgctaaacaatctatctgatatattctctaaaaacatacagaatataaaatcatggttaggaatttgagctttagagctagacagaacttgactgaatcttagctctgctaagagctgtgactttgggcatgataattgacctcactagactcagcttccgcatctataaaatggataatgatagaataatgagtgatggtggtaagaatgaaatgagctagtatctgcggcacctaggacagaacctggcatgtaataaacactcagtagacattacctgctggtgtggtaattaggtatgtcctgccagaaatggggagatcactctgattacttttatttcctagcattagattaatatcccaggttctataaccgtgtaaggttcttgagactggcaaagggctgacgacatgaaatttactcctcccagatagtggacagccctctgggccacacccccaacatctggctgaggggctcaaccctacataggttctcctccttccctatgctcagtgagctagttgcttgctcacttagagcaggatgaataaggggctaattctgttcttgacctcttccatatatctctctggacatcctttctcatttccatctggcagtgcgtgcctctgcatacctgattcatgccttgcatttgtagcgaggagaggagatgtaatgattcaggtttctcctttaggcttggggccctgagaactcccgggtgcaatagtcacctggtgaaacatgagctttgagtcacagggtcaggcccaagtcatttctgctaggaattagggaagagtttctgctgccaagggagttttaggaacagttggagcagggtcagtccaggaaacaagagggctaagtccctgcctcgatctcagctgcagctctgctcgtttccgaagtccttgctgtagcttgagagctgaagatttagactgtggagggaatggggctggaaattgttctaaaaatggaaagcacgttgcgtttataagactgctagatggactgcttcactttaacttttggctcttcgccaaatgggactgggaaggtgatggtcattctctaacctgtgtcggtttttttccttttcttttcactcccaccccacacctcctccaggacacagaagacttagatcactatgaaatgaaagaggaagagccagctgagggcaagaaatctgaagatgatggcattggaaaagaaaacttggccatcctagagaaaattaaaaagaaccagaggcaagattacttaaatgtacgtgccttctagagagaggctggtgaaggggttggtgggaaatggctgggaagtagtaggccatcgcatctcagtatggagagcagactccttttttgtgcctaatcctttcttaaatcctgggcaagctgccagactgcccctaaggtctaacgtgtgtttataaaccacacgaccaaggaatgttcctgtcatccgtccctcacagggtgcagtgtctggctcggtgcaggccactgaccggctgatgaaggagctcagggatatataccgatcacagagtttcaaaggcggtgagtttgccccagagaggggcctgcacaagagtcacccataaagaagggtatggtggcaaggggcccaagaggttctggggtccaggagtgcttatgaacttttcaggccaagaatggagctcctcaagccagtggcttggttgcatgtccatctgtggtgaacctagagctgttgatctttttctctcagtctgggaaaggggtctgcattagagaccactcaccacctggaccattctactaacacctgttttttccctccttccaggaaactatgcagtcgaactcgtgaatgacagtctgtatgattggaatgtcaaactcctcaagtgagtggggactctgggattggagaggaagttgaggaggagtgtgagtggggctactgtggtgggatctccagggcagccccatccagcattttcattcagggtcccggagcgggtgtgggcagtggtttcgtggtctgctgccagccagggcaggggagcccttatgaagctcctgaggtggaaccaggcatctgagcccaggcttgttgcttcttagagttgaccaggacagcgctttgcacaacgatctccagatcctcaaagagaaagaaggagccgacttcattctacttaacttttcctttaaagtaagacttttcttttccagtctctccctctggcctaggctgcccagtctgcctgacagtcctgtggaggatgctggcctccctcccctgattgtcgtctctctctctctcaggataactttccctttgacccaccatttgtcagggttgtgtctccagtcctctctggagggtgagtggctggcatgcggaagagggcatctcctctggcagagggcggggaagagacttggagattttgtcaggcacagctgactaacctttctcatgcaggtatgttctgggcggaggggccatctgcatggaacttctcaccaaacaggtgagcctgtctctcctccttggccaggccggcctgggcggggattgtctgagctttacagcacacacccctacgggctgggtgatagacatgatgtggccctttcattctgctgggctgggtctgcacccactgacctagacagacaggtggtggcagtgctgggggcaaagggcaagggccctcctatagacacagctgattgcccagaggacaagcatgagggttctctggaagctccatctggacctgcttgccttgtccttcccttcacccagggctggagcagtgcctactccatagagtcagtgatcatgcagatcagtgccacactggtgaaggggaaagcacgagtgcagtttggagccaacaaagtaaggatcctggtcctggggctggtggggctgggtggagccaagtacacttggggccactagcaggccaaggctgccttctttagaggaatgagcataaggcccccgggctggtggcattggatgagagggcctagggtgcccacaatggaacaactgtgccttggcccctaggggcacccctaggacttttgggaggtttcgggtctggaaaaggaagactatgggattatgcctccaagggacctcgaaggtggagggtacttagtgttttactagaccacagtgctgggagctgggactctggggtctctgggtgacagcctgcagaaggtgaggggcagtaaggccacagctagccatggcctgatctggtggcttcctctccccagtctcaatacagtctgacaagagcacagcagtcctacaagtccttggtgcagatccacgaaaaaaacggtgaggctggagccaggactcaggagattcggacacttgccacacccaggttttcacttccagccacagagcaagaaccccttcttttggtttctgatactcaaccacccattaacacagcacctgccccagttctcccaggagggactggcggtggctaacattcacaacctcttccagaaacacaccaaaatgatcgtatcaccgataaacttggtgctacccccttcttgaccaccttttgaaaaagctcatctaactctcccatcatctcaggttgggcacatcattcccccttctcatctccaggtatgcaggctctcagcttcccatacacctctccccacacagcatagccctccccaatatcctcttatctctgccactggagacgtcttcagggattggggcaggacagggagggtgggcctgaaccttcacctcactgaccattccatttctttgcaggctggtacacacccccaaaagaagacggctaaccctggagtatcacccttcctccctccccaggcaccactggaccaattacctttgaatgctgtatttggatctcacgctgcctctgtggttccctccctcatttttcctggacgtgatagctctgcctattgcaggacaatgatggctattctaaacgctaaggaaaaaaaacaaacacagaactgtttcaagtactcaagactgacttacagaccaaccaaccaccttgctggaacccttgctagcaggcattcttataaaagaaactttcgagcctccttatattgctggaaactcagctgtgctccagactagagcctccttacctatgctatggatttttaatttattttctcttatttcatgtacactgctttttttggttacagtgtatgatggatgtgtatgaaaaaaatgtatctttgggaaaacaattacagtttgttaatttgaagatgctggtcttgactcatctttatttttattcgcacatcccaccccatcccctgaactacttgggaggtggggaggggtacgagtccactgttgctttggtagagatgagaggccgcattttgctgctaaagcaagagaaacttggagctgaagcacacacctggtctgcccctagatttctcctcaaggcctctggagcaaccagcacttgcccccttggaatgcagagcctggcctgccaaactacaatgtggtaggctgaaacgatggtgttaattcttaggactacttttctagtcacagatgttttcaaatttctaagaaaaagaaaatgaggctcaagaggctgcttcgtagaattccttttgaatgaattgagtggggatggggacacagtctccaagtgtgtatgtggtcttttctgatctcagctgtgtggctgcaactcttcgctgttcattggttcctctcctggaaagtggcttctaaccagcactggatggtgatcattggtaagctttgctcacctccctctctcttgcttcatttggctttatcaaaaagaacagacctagctctgaatttgtttggcttgggaaattatggattctttcaagccactcccacaaggtgggtcctactagaaagggttagcattttaaggggggttgttctatacacctgtgtccttaccccaggctcaggaactgccagggagggaagatgaggtggggagtctgtactgagatggaactgtcagtgctgtgttgtatgtacttgctgttgtaaaagtttgggcatgactttgcatctagcgggtgctgcctgcatctctttgtctgtaagcttgctctgggactcagcctcttaggacctacgatgccagcagctctcattaacagtgaaatgacagaggccaaagatggccaagtgaagacccaagtctcagaaaacccagacttgggacaactgcctgggaactaggatgctagagcagttctgtaatgctttgagacacagcaattttcacattggccattctttcccctcccctaccccttttcttttgagggacttttaatgtttgctgctttaggtggatggagagtccaccagtcccactcaatgctgctctaactctacccacacccacctaattaggggtgctaataaaacatgctgaggttgagataaagacgggacataaggggaaaattcattccatagagctgaaatctggttttcaaggcctctgtggctttcttctgaacttaccaccagccctggctggaatgtagattgtgtttttagtaatgtgtactgtgagctgtcttctgtataatgtattttgtaatgtatttttctcatctaccaaaggatgaaacaaataaaattatttaaatagt

SEQ ID NO: 38263 - DNA, 30832 bp, Homo sapiens
aatcagcgcgcggggcgagacgaaggggctgggcggggctcgggctcctgctccggctcagctgcggcggccgcaggttccaaagcgggtccgagccgccgccgcgcgcgcgccgcgcactgcagccccaggccccggccccccacccacgtctgcgttgctgccccgcctgggccaggccccaaaggcaaggacaaagcagctgtcagggaacctccgccggagtcgaatttacgtgcagctgccggcaaccacaggttccaagatggtttgcgggggcttcgcgtgttccaagaactgcctgtgcgccctcaacctgctttacaccgtgagtatccccagtccgttcctgctcgcttgggggctttgcacctgcttgggagctctttggcttccctgcctggtcagcgactcactcgttgcatcccgcgcccccttcccggcttcccacgtctgcgcgcccccggcctcaccatccgtccccgccggggaccgggcgccggcgcttgtcgcagtctcttcctttcgttcattgtgaagccgcggtctctcaggctcgctggccgcgtctctgccacattgctccaccccgccccctcacccaccgccttgtttttcaaacattcaaccggacctctccgctttcccaccccgtacccttctgccgctcgctcctgacatccagacgcatctgggccaggcgtggaggcgcgagagccgtcagggcttgcggacagttttgcggaatggcgtggcctgaaactgacgaggcggcatatggctggtgtgcctctgggttagctcttggtaccctcgggattttaattgaggccactgagtaggttcacaggatgtccgctgcttccgaagtttgtttcgtgctcacagtaaagggatgtctttttgtttttgttgttgtcagttttgctagtacttggtgctttttctgtgtgtcttgtccatgatcaatatcctaactccattttaaaccaagtcctccaggaaataagcgagcccccacccaagtcgtttctttccctgccaaccagcttgggcctcttagttttaacgctgcaggctctctttgtgattttttgaggcgcaattctgggtgaacaggaggatgggcaggacagatcgacatttattgaatgcctatcacgtcccaggttttacatacacaatgctcgttcatcattctgacaaccttctgagggaatggggcattatctgcattttatacataaggtaacagaccaaaaaggttttagtaagtttacatagctggtagttgacgagtcaggagtggaacctaggctgtggaatccagatctttccacaggctgtctctaccgggcggaagaaacttcctcttctgtcatcatccctccatagtagtcttgctcccttctataaatatacctggcgctttgcagcacccaccctgaaaacaaacccagcacccctgcattagcagagagctaggccatctgtgcaagcttagattacctccttggaatagagaggctgccttgtggtcaccaacaggagaaggaggttgggtcattttacctttactgttcctttgtatgtgaacatgactgcaagctttgaaggcaagacagaaacaggcattgagtacgcttttatggctagttagtaagaatctggtcaacatggtcattaatagtagacttgggaaaaaaattttagaacacctggtgatacagttccttggagatacatgtcaagtttcagatcaaaattcatctgtatcaccctgaggtatgcttatcaccctggctgtttattaagtaaatgctgaccagttctctagggtttttttttttttttttaaatcagtgtgagtggcctgcttggaactttaaattccttattttgtgacctgagttctgttttttttctgccaatgatttagtcatctgtttgccagacacttagtcttacagtgcctgcttacacagagtggaatgtctactttgcatacttacttcactgaagggtctatatcaatgtataatcttttttaaaaaggcaagttattttaaaatgaagttccttgctttctagacatcatttttagttgtatttagagtatatcaggaaagtgaggcgaaagaaaggtgattctaaagggacatattaagactatttaatatctattctaaattattgaccttcaaagtgtgtgttctattgattttaatagctatgcagtaaaacttaatgaattggaaattcacgggacaataaaaatggctagcccttttaaatcatagactttttagacaaagggacatttcttaaaatgaattagtggctgcttgcttcttttacattgtaaataggcttaaataactgcagcagtttaaagtggaggcaagtgacaggtaaaagttggatcaagtcttagatagatgctgaaaatgtgccatggccattatttagcttctatttctcccctgatctctttctcaacattttaagatgaaaaaaatgtgaggcagttggggatgggattgagcatgaagacttgggagacatttctctataagtcatgaatagaaacattctttgtaggttctaatcccaccctggtcactgcctctaaaatgtgctcaacgctacaggattacatttgaggtcatttctaaaagtgttggttaaaccaggattgcatatgggaacggcagatgcctgaaacatcatcattgctgtgttgaagcattttactgaggaacttaggactgtatcagctgaactgtccacatgctctggtggcttgctgatgagcctgagattcgtgccacattcatgatcagctcagaaagcatgtcactaaaaacaagttggaagtcccaaacaaggaaatttgatcactaggcaaaatgttaacagttgatttttcttgttgtttatggcttgattattttagttaataggatcgccagtactggacaagcttaaattagtgtagtatgtgttaacagtttgtaaatatagaagaaaagggggaagctacattcctgaattcaccttcacagtattctaagagaatgacttgcctcagagcttcctgcatttaaagaaactttcagtttcttcattcaacaattattgagtgcctactgtgtgccaggctctgttctcagtttggaaatacagcagcaaaccaaacagggcgtaaaaatcaatgtgcttttatgaaggctcttttttatttactaccttttatacatatgttttcaggaattgtattcagtcaataaacttttgtctactgtgtgcactcttttgagaactgtgggaaataataaatacctataaaggcaaatgcattgtgaagacaggatctagatgagagacatggaatgggaaaattaaatggcgtataaggaatatactgactttaggtaccataaaatttaggactgtggcagatatttgtgggttagagaagttgggggaataaaggaggtgtgattgaatcaaggaaatgtagaaatagtgtgtgggtctttttgataccatttaggatatacataaaaatgaaaatgatttgggaaaatgacttatttttaatagtttataggaatattttaggctgaaaagattttgacaagtagtgaaaaaaacttttgaaaattatgcttagtgatttgtgggaaattttagaaaatatgaaataaaatttgtattaaaatacgtaatattttgaagctttataatgtgtctccttgtgcttcttaaccagagaagaaagctctattaaaaacaaacaaccaaaaaaaaggtagctgactttgttaaatagaaccaaactgaaaaatatgaccaaacatatatttactgggactttttaagagttgccctgccagttttaaaatcaggagggaaatttcagaagttgcagttttgtttctcctgtgtgtgttcattcttataacatctttccatgtttgtttctttctctttttcgtgattctttttccttatacttttggttgttttgagaaaaattctcatgcagcataaaaattatactgaattacttcataaacaccttaatttatatttttatcacctctgaagttgggatgcattttattgtttctatttgtatttttgagatggagtttcactctcgttgcccaggctggagtgcaatggcgcgatcttggctcactgcaacctccgcctcctgggttcaagcgattctcctgcctcagcctcctgagtagttgggattacaggtgcccgccaccatgtccagcttattttttgtatttttagtagagacggggtttcgccgtgttggccaggctggtcttgaactcctgacctcaggcgatccacccgcctcggtctcccaaagtgctgggattacaagcatgagcactttatctactataaaatgctcccggcctgggatgcattttatagtagataaagtgtgccatatctgttagataaaaaaatacgaccatacaatttatgggaagaaaattctgtttttaatctgttagataaaaaacatatgtccatacaaattatgggaagaaagatcactggatttatgaagaaaactgaaacttttccaactctgttactagacaaacagcttactttgagtttcagtttcttcatatataaattggtgatgatatttttcagtcgtcccctcatgaagctgtgtaaggataaaatcagatagtatataaatgctttagatgtataatagaaataaaattaagttgttacagcttcaggtggaaaaagttgaattttgctgaatttatagacttggcttcttctttccagctattcttcacaggtaaaacttgcataaagaaaactcgtataaaacaatattttgttacttttagtctgcaatgatcaaggttaagtgcagaagcacagctaaatattttaaagcatgaaagttggcattaggttaaaaagtagtaatattaagtaggaattacttttatttatccactgtagaatcgaatatttcttgtaatacccttttttttttttacataattggccaacctttcaaacgtgtctgtgggtttcctctaccgtttctcttgaatgaatctacttcctgtaaaattgtattataattgtaactgtttggggttatttgtgagtctaatgtaagtttgagatgtgcccaagttattttctgttttttattctaataatgaatattaattgagcatcaatagcagtgaacaaaatcccaatggcttgccttcatggagtttatatttatgggggtggacagatgataaataagtaagtaaattatatatcgtattagaaggtaaacaagttttatggagaaaaataaagcggagtaaaaggaaagataggtggggcagtggagcggatgtgggaggatgggtacacagcttcacatatggtggtcatgcttggcctgcatggaaagaaaacagtgtacgaaaggtgttagactgttcttgcattgctataaagaaatacctgagactggataaagaaaagaggtttaattggctcatggttctgcaggaagcatagtgctggcatctacttctggtgagggccccaggaagcttacaatcatggcagaaggggaaaggaagtccctgtgtcacatggggagagtgagggggaggtgccaaacgcttttaaacaaccagatctcacgtgaactcagagggagaactcacttatcactgaggggatggtgccaaaccattcatgggggatccacccctacgaatcacctccctccaggccccacctccaacattggggattacatttcaacatgagatttggaggaggcaaatatccaaactgtatcaaaaggcctaaaggagatgaagaacagttatctaagaaaagtgtttcaggtagagggaatcgtctttgaaaagaccctgatgaaagagtatttctgcttttttttcttttctttctttctttttttttttttttttgatatagggtattgctctgtcacgcagtggcgtgatctcagctcactgccagagagctgtctcctgggctcaagtgatcctcccacatcagcctacctagtagctgggactacaggcatgtaccaccatacccagctaattttaaaaaatattttgtagagacggggtctgtgttgtctgggctagccttgaatacctggcctcaagcagtcctcccaccttggcctcccaaattgcttggattacaggtgtgagcaactgtgcctggccaggaggagtattgctggtttatgcaagggacagatgagtcaaatatgagtgggacagagcaagcaagcagtacaatgcaggaaatgaggtcagagaagtcaggggtggacccaggagagcactatagggccatgagcttttataccaagtgaaatggggagccaatggtgtgtttaggtttgaggactgatatagtctgatttttatgtaaaaggctatatggcttttgagttaagaatatattatagatggcacaggtgggagcattgagactagttacaaggctattgctataatttgcacatgagatgatggaggcttggattagtatggtggcaacagaattaaaagaaatagattctgagagtgttttggaggtagggcgacctgatttactgaaagggacaagtcacagattactatgatttgtggctcaggctcaaggaattggcaggatagatttgccgttaactaggatggagaagatggcaggtggagcagactttgggatgaatgagaggattcagtattggacgtgatgctaaagaaacccaagtggaaatgtcaggtagcacttacagtaaccacactgttattcaggggagaggacttgccaacaagttagtgagggtagatggagaagggcagtggtccatggattgaagtagtgcatttcaaacattaagagattcaggagatgaggaacattcagcaagggagcctgaaaaggaatggccagtcaggtaggaggaaaattgcagagaggttggtgtctcagaagtcaagtgcaaaccatttcaaggagatggggaccgagagttggttctcgaatttgtcagtgaagaagtcgttgaaaagagcagttacccttttatttttcttataatcctctgaacaataaaggcaatgtcgcagtcattctggctttcctgtgtgcccggcacagccctggcatgtggttggcatttagttaattgaatgcaggaatcagtacagggttcttctgcccatacttcatttcttgtctcccagaaatgctccaaagaaggaagtggtagagtggggttggaactttgttggcagctgtggatgtcacctcaaactggttacccttggaaaatgacaagtggaggtcccttactttcaatcacctttatataatttccatatactttgtatttttttgcctagtaagtataaaagcagtggcatcacggagagccataatgaagaaaaatattcgcaagagcacttcaggccttctgtgtcatttgaagaatgatcataaagcaataaaagaactgaggttttagcttcaacactcaatgtctggctatttagcaaaatgtagattatttatagagttttcatatttccatccagctgtttggcatcgtagaaacatgtgcttgatcttttctgaattgctcttcagttttccacattaagcagaagttcagaagagagttcagtgttcacgtgtaattcctcattatgaatgttgaggcatattgaggaagatagtctggggctttgttttcttttttttaggggcagggtctcactctgtcactaaggctggagtgcagtgtgtgatgatagcttactgcagccttgaacccctgggcccaagcgatcctctcaccttctctccttctgagtagctagaactacaagcatactccaccctacccagctaattaattttttttttttttttttttttttgtagagacaggggtcttgctgtgttgcccaggttggtcttgaactcttggcttcaagcattcctcttgcattggcttcccagagtactgagattacagatgagagccactgaacctgcctacctttattttctttacatgtctgtggatgctgtattacattttgttggtatagtccttctgtatcttactactgttttaaatttgcttgccttccactaccatcataacttctctgttgcgttagtgctaacaaaacatttttgaataatttacaacatctaatctgtctttttgaaatgttttaaattctttcatcctcaaagcaattcacttaccttggaagaattttggtactaaaaaaaaaggtagttgttttcacaatattaaaatctgtcttttcatcttgttcttgaaatgtggtggatatttgatgaaagattgaaggttatgtagacagagaataatatggaacatcattaggctgactttcttcccctccaaatattgtatagattggagaattagcgtttccttgtcctgaaagggtaatgagcaatatcatgtgctctttgattcagcagtgtgttttgagcacctcttaatgcttcacactcttagccaggtgctaggaatgtaagataacatgggccttgattgtctggtgcttaaagtgtagaaggcccatcagaattccaagtatggctgggaggaggaatggtggctaatgaataacctcgggcgataatccaggcccttcccatcttgggatttgtcagcctgggagtatggactttttctcgagatcagaaacaaaggacagccagcatagaaatgacctgatctgattggctttaaaaccaagaccacaatgttaggaatagagtttagccggaagtaatagaaacccagctatcactgcttaaaatggtaagttttattattttcacggaaaaagaagtcaagacccaggtaacccagggcatgtgcataattcaagcatattgtcatgggcccagtctccatctgctttcctgcccaactatccttggcatgccaccaaattacatataaaactctaggtaccatgaattgttccaggccaggcagaagatggtctaaaatgtctttccttgtaaagccttgtcttttggggggaaacagatctattgaaatattatcgacacagtaaggtgaatatacttaaagtataacattttataagtttgggcatatgtgtacacctgtgaacccatgaccacattcaagacccctgaaaatctcctcatccttctttgaaatccctctttcccacccttaaaccccccacctagtctgcaggcaaccatggacctgctcagcggtaaaacttacattggtgttaaatttagtaacgctaaggaggatgtttgtagaaaaaagatgggacattcctctggctcattgattaccttcttttgacggcagggtaagaagctttagggacgtcttttcagctaaaaggagtgctcatgtttttaaaagtttattgacaaggcgagaatttagatttggtgttggtagggaaggcgatcaccatggtgaaggtaaataggatcagtgcaattttgcaggtattgaaagtttatgatcaacacaaggtgaagcttgtgtgaatcaggatacttcatgggttatagatgttcttgaagcaatgtgttggctcatataagtgggacatccagtagttgggtcataaggttttgctggatcaaggggctcgaagtcgctcgcccctttcatccgcttttcagcttagcttgcctctgctcagtttcttttacgggctagatctttccctgtccatgatggctactggcagaatcaatgttgtccttataccttgctaggtcagatgaacctgttgttttctgctttcaatattcctttatcgatcttgcaggacacgcttattgaccctgttggcttatggacctatcccttggatcaatcactgttgatagaaggatgggcagccatgattggtgggccagaattttgtgtgtctgctgctgctgatggtcagaggggccagtcattaagggtcgtactggaagtatatgtgttaggttgcaaaaacaacatgtgtctaagacagaggtcattcttattctgggcagcaacttccccagttcttctgttcttaattctagcatatcctagcaatttcttcatcatctgcaagtcttagtgtagtggtttaatatttcaacacccgcttatgctagattataaagaacattatgcatatatctttctttgttctttatttttatttttatttgagatggagtctcgctctgttgccaggctggagtacagtggcgcagtcttgactcaccgcaacctctgcctgtcgggttcaagcgattctcctgcctcagtcttctgagtagctgggattacaggcacatgccaccatgcccagctaattttttttttttttttgtatttttagtagagatggggtttcaccatgctggccaggctggtctcaaactcctgacctcgtgatctgcccgccttggcctcccaaagtgctggggttaaaggtgtgagccaccgcgcctggctctctttgttctttaataccattattgtatgtatcaatctgaaagacacataaacacatggtgcttaatgttaaaacaattctgtttgctagagtgatctcaaatatattaagtttctaattccaagtagaatttcttgttcccctactctaggcaacacacagtgtgctcttctgcttgtatgtgaatgtacgtgtatgtgacaaaatttctgaattagataaaagtaaacaagcacaaaatgaataagcttaacatttggtagttaactaatggaaaggtcatatgagtggagtccttattaacacatcactgtgtgaccaagtctcctaggaagtaaattaaagagatgctattcacatacctgttgatatgcctataaagcaagaactacaatttcttatgcattgtaatagtgtctttaatattacatctcagtgttaaaaatttcttaattattttcctaggcactatgatgcagttctatagggagaaaaaaaagtcacattactcctcacctataaaatgaaaggaacagattaggatccctggccaggtagtttagtgccatggtgttctctctctgtctctgttttgtttttgtttttgttttttttttgagacaaggtcttgctatgttgctcaggctggtctccaaactcctgggctcaagtgatcctgcctcggcctcccaaagtgctaggattatagatgtgaaccactatgccccacctgtgctgtagcgttctgtgtttgtgctgtgagccctggctaagaatttctttctttctttttgagacagggtcttgctctgttgcccaggctggagtgcagtggcatgaacacagctccctgcaaccttgacctcctgggctgaagctatcctgagtcagtctcccaagtagctgggaccacagctggttgccactgcacctggctaattttttttatttttttggtagagacaaggtctccccatgttgcccaggctggtttcgagctacctgggttcaagcaatcctccttcctcggcatcccaaagtgctaggattacaggcatgagccactgcgcctggcctggctgagaatttctatgttccttgcagtagcaccttcctgtttattcccccttcagtagactctactcatgtgtacacttgcagttttgccattgccactttctcttggcgtttactcgggggagaaatgccagttttagacactttttatgaccagttttatggtcttgctttggtgtaccttttccattacagctcctttagttctctttttaaaactctttttatatgattcacctttctttgtcttaaggagaaaacaggaaaggttggtgcttactgcttataaaaacattaccagcaatgaattaacagacacataattcctttttatcagcattgtctcccaaagggaaggaaactgtcataggtgtacatttactttctattccagttgatttcataaggaaactgttattataatagaacaaaagattctttggagttcctttgtctagcaagttctagtgacaaacctaggctttttaattatgctgttagagttaactgtttgaatcaacaatttttagatcactggtttggaagacctcatataatcttgttctcttcacaattacaaaccagccataacacataattatcactactgagaaataaattgttttactattatctttaaaagtctcctttttagtaaagttaaggatacactgataatcagatctcattagaggcatattataagtctttaggtgttataattttaaaagttaacttgggtatttgggggatttttaaaataatgtgttagaaacaccagtcatacacaagaaaacacattgtttttagctttttaaatgaaaaaatccaacatatttttgggtgttcattagaaaattgattagcacaaacaagtttatgatgtacagtttcgctgttgctgtaataagtgcaaaatttgttttggattggacagttgattctatgttttctttcacctttgggaatggcccttacaaatgagaatgtgtatttgcgtgtgcatgtgtgtgcatatgtgcatctaggagttgggcatgaaaatgggatagggcagtgtcttggttcacttttgaaaccatctgagtgtgatggacctagagcattgccttttgttacaaacgtgtggagaatcagcaacttactgcctgttgccttcagttgtataccaccttcattcccaagcctcctctttcctaaattggaacaaattataggagggaatgtggactgctcttgaatatgcatagatggggattgaggtgaaatatctgagagacaagtgagaatgtctagatttaagtagctgggtttgggagatagtgggagctaaggctgaatgaggaaagttagaccaatttacagaggaatgcaaagcagaagaatttagaattggtgacttagtaagaagggggtgttacatttttcaaggctagttttaattaggaaatttcatatgctcaggaaataatatggtagacccctgtgaactcactggctttatacatttcacatatgccagtgttttttttctctctctctttcgagatgaggattctctttgttgcccaggctggagtgcagtggctattcccaagtgcagtcacaacgcactgcagcccaggactcctgggctcaagcagtctgtctcggcctcccaagtcccagctactgttgagactataggcacaccactgaacccagctaatctctcttttaagaagttaaatgttactctgtagctaaaggccaactctccagtccctttcccattttcccctctcaaaggtagtcactgttctgaaatcaagatctgtcacttccatgaatgtgtatgacaatgtcatatattatatacattaattatctacaaataacatatagtattgttttttgtgtttgaaaatttatataaatggtatgttttatctgtatttatgcaacttgtctgatttcctttacatttttttgaaatttgtcaatttaatagaaatagataaaaatcatttgtattctattgtgtgatcacaccagagtctgtgaattccctagtcgtgatgtttgaaaatgtttttaattttttactgtaacaaacaaggttgtggtagaatcctggtatatatctagttgggtacataggtgttctcttggggattaacctagaaacagaattgctggggtagtaagggatacatataattttcctaggtggtgttaatttgttatataaagtagctacaacaatttatattcctacttgtacacaagttttaggttctttacattcttggtgtcatcaggcttagtttttgccagtctagtgcatgtgagatggtatttccttgttttaatttttgtttccctgatttttgatgtgatttaacatttttcatgtgttgattggcctttcaaattcttcttcagtgaattgactcttactacctttcaccacttttcagtttgctttttgtcttaagttcatttgtattcatttttattttttatttatttttatttttacttttgagatggagtatcgctcttgttgcccaagctgaagtgcagtggcaccatctcggcccactgcaacctcctcctcccaggttcaagcgattctcctgcctcagcctcccgagtagctgggattacaggcgggtgccaccacgcccagctaattttttgtatttttagtagaaatggggttttaccatgttagccaggctggtcttgaactcctgacctaaggtgatccgcctgccttggccttccaaagtgctgggattacaggcgtgagccaccgcacctggcctgtaggcattttttaatatgtgtgctggaaatatattctcctagtcctaggtgtctctcacatttgtctcgtatttttcactgtacagtacagaagtttaaatttgtaacaggttggatggtacggcaggtaaaaacacagatctacagccaggtagcctgggttcatatcccagctctatcccttccttactgtctaaccttgggcaagttacttaacatctcactctgtgcacagcttttcccatctggaaaatggaagcaacagtacctacctcttagggtttttgtgaagattaaattagttaataaatgtaaaacccttataatactttcttaaacagagtaaatgccatgtcagtgttatatgcgcatttttggaaacttgtttcaaagaaatttttccttacccacaaagtcattaaaatattttctatacttttaagttgtgcttaaagtagagtttatggtttgaggtagggattaataatatcagttttcaaaatgagaaggtggttgtcacaaggctacttattaaagtctactctttctctgctgacttagaattttgcctctctcaaagactatgctgctggcttatttagatctgtatcagttacctgctttaacgactgaaccattaaaatgaggtatttgtcatatctcttattttattttttttgagacagagtcttgctctgtcacccagggtggagtgcagtggcgtgatcttggctcactgcaaactctgcctcctgggttcaagctatttctggctgatttttgtatttctagtagagacagggtttcactatgttggccaggctggtctcgaactcctgacctcaagtgatcatcccgccttggcttcccaaagtgctaggattacacgcatgagccactgtgcctggccattataataggttctgatatttgttagatggtttttaacttatttagtttttaaatttttaaaatctatttaattttactttaaaaaaaagaaatatatccaaaatatgtagagtcaggctcaagttttgcagacatgggtgaaaacaacaacaagggtggcattcaggacagttagattgaaccactgacaggactgatttgccaccaggagcatttcttcttcatggttctggtgacagtgcagctgggctaagaaaaagtgcagcagatacaagcttttctccttaatcttctttatctctttgtttattttaggtcttctttcatgttcttcaaatacatttcacaattttcttcatgaagatcttggactacttttgttggatttcttcatatatatcttatattttgggggtatattacaaattatatcctaaaaagtatgtgaaaaaaattttttttggtgcatcagcatgttgttgatttttgtgtattgattctgtttctagcaactttgctggttcttaccaattttaatttttttttgattttttggatttcctttgtagatgctcctaataatttttgaataatgaaagctgtgtttctctcctcccattgttattttgtatttacacttagttgtctaaaaccccaccacaatgctgaatagatgtggtgaaagtccacaccctgtcttattcctgaattttggagaaaatgtttatgatttatttttatcttaccattagctagaataatctttcctatcttttgtcactgagtgtgatttttgctttggctttttgatcggtatttatcagtttaaaaatttggaaggatttattattaacctttctcttaaataattttgccaagggctgttacttttctctcctttaatgaagctttatgtattctttctattgtaagtttctcttctttctcctaccattgggtttgttttatgtgactcttttttaagtttgcatttttaaaaatatgggtttttaaaatagtttttattccccttttatctttttatttttctgtttaatattttttattttattattttattattattattatttttgaaatggagtctcactctgttgcccaggctggagtgcagtggcacaatctcggctcactgcagcctctgcctctcgggttcaagtgattctcctgcttcagcctcccaagtagctgggattacaggtgcccaccatcacacccggctattttttaaaaaatattttggtagagacagagtttcaccatgttggccagactgctcttgaacaactgacctcaagtgatccacccgcttcggcctcccaaagtgttgggattacaggcgtgagccaccgcgcccagcccccttttatctttttagtcagtttaaaatattttgttttagtctccttcagttagttctgtcatctcaagttcttgggagcttttatccttcttttgttatatttgtcatatctctctcatggtaaatttttttcttagtcattttgtgattttttgattggcagcaatgtttttatttttttctttgggaatcctgtaagggctgggatttggaagggtccctcctgagcaaattttggatatgcgtttatgagcttttctcccccaaatgccgtcacctcttgtaatcagcttttatttgaattgtttgtcttgaggattcctgcatgcctgaggcagtgtactcttagactgcaagcatgggcatgataggctcttgtttgataggctcgtgtttctctttcttgaaaactttttgaagagactgaaaagtctttgctctctttctggataggttgttgtggtttttctctaacccctgacactgaaaatacagctttttggagatcccagttatgcaagggtctcagttccacttcctagctctgctatgaaacctaaatcctttcccgttagggactgttctgatccaggaactccttccccacctgctcatgggaccccacagcaccagctgtatgcttacagttctagctttcgattctcctttcatttctgacctgtaggaatttcccatagtttttctgtgctcacttacgtatttaaataaaatgttacagtcttttcagtgttttaaaatatttgtagctgaaaggattctgtggtagctcagttgcccatgttccaagaaccctctgtggtgggctaaataaccacacactccaaaaagtcgttcatatcctaatccttgaaacctacaaacacgttactttacataactaaaaggactttgaagatgtgattaaatgaagaatcttgagatggggagattattctggattatctgggtgagctttatggaatcacacaggtccttggaagagggaggaaagagggtcagagtcaaaaaatgatgtgcatatttgaggggtttgaacatgatatgctcctggctttgaagacagaggaaggggttatatgccaaggaatgcagaaaaccctcagaaactagacgaagcaaggaaacagattctccctctggagctttcaggagtacaacctgaccaacacagcctccagaactgtaaggcaatacatttgtgttattttaagccactacacttgtgttaatttgcaaaagcagcgataggaaaccctctttgatggttttagaggactgcctggtagtggtaattagggtagactgaaaactatattgaagacacagcagaatcaacttggtgaggaatgcccttgacagagggttatgtagaaggaagcagcctcttttttgcctctatctgcaggaaaagaaaaaaaccagaacagaggtacttgtgaatattctagataacattctcaataatagcataaagcctaatctgagaactaaatagtgttttctcccctctttttggttgtagagatcttttctttacatttacattaatagattctcattattaatgagcctattagttggcaactgagtgagcattgaagagtttcctcattttgccgaaacgatgatgcagataatgtatttgctttgcggcgaggatgcccatgagggtaccagaacacttcaccccagctacatgataaggattccactgatggtaaaattccaggcaggttctataacagtgagaggttcctgatttgtcaaactccaaataggtgaattgttctgtatttcttttctaggactgctgtagcaaattaccacgaacatggtgactcaaaataacagaaatttatcccctcacagtcctggagaccagaagtccaaaatcaaggtgtccacagagtcaggctctctcagggacctgggggagaatctgttcttgcgtcttccattttctggtggctgctggcattccttgtggctgcattagtctctgcctcttttttttatgtcactttctacattgtgtgtgtctctctctaatttccctgtgcctctctcttaaggatacctgttatgacatttagggcccacctcataatctaggataagcacctcctttaaagatccttaatttagttccatcttttaccacataagataatgtttatccttggccgggcgcggtggctcatgcctgtaatcccagcaatttgggaggccgaggcaggtggatcacctgaggtcaggagttcgagaccagcctggccaacatggtgaaaccccgtctctactaaaaatacaaaaattagctggacgtggtggcatatgcctgtaatcccagctactgggaaggctgaggtgggagaatcacttgaacgcgggaggtggaggtcgcagtgagccgaaattgcgccactgcactccagcccgggtgagagagcaaaactctgtctccaaaaaataaaataaaataaaaaataaataaataataaatacttattcttttactactgaagattatattcacagaggggtcagctgggctattctgtttatctgaatttttttgtgtgtcagggggagattattgttctatactcttactcgccttataaaaaatcttgggggggggcggttagcaattatttgattatttgtcctattgtaatttttcattctcttctataccgacttctagagcaggggtccgaaaactacagcccacagccagatccatctcattgactatttttgtacagcctgctaacttagaatggtttcacatttttgaatgttaaaaaaaaaaaaaaaggaggaatgatattttgtgatgcattaaaattatatgaattcaaattttggtatgtataaatagttattggaacacagccctgcctgctcatttgtttacatattgtctgtcactgcttttgtgtacaggggcagagttgggtagttgtggcagagaccatgtgatctgcaaagcctgataataaatatctggccgtttgcagagaaagtttgccaagccctgttctaatagggatgtcttgtctctggcttttagcacatagcatcaagtacttgtcggtgaataattaacttttaatttactatttaagcaggtgtaacttttaatattctcatatttaaggatttcagtaatatagtaaggatgtagtataattcccaaaaggatttaaagaatcttttaaagatcttaaagaactatggggttagaagaattttattagtaatactcttattcatgcttcttatcttttttggctctaagacttaaaagatacaatgtaattcttctggtgaatttaactgaattaggatatatgcatcacacccaggacttgggtgttggcaaatgtgatggttgattttatatgtgaacttggctaggctgtggtgcccagttgtttggtcaagcactagtctagatgttgccgcaaaaatatttgtagatgtgactaacatttacaatcagttgactttaaatcctattaccttccatcatgtgagtgggccttatcccatcagttgaagaccttaagaacaaagattaaggttttctgaggaagaaggaattctgcttgagtttccagcctgctggccagctctacaaatttctgacttgccagtcacgacaatcatgtgagccaattctttaaaatctctctgtctctgtttcactgttggattttcactcaatagatagatagatgtagatatagatgtatttcctattggttctgtttctctggaaacagaagtacagcaagctgctctgatgtcttgcacatgtggcccatcttcagcgtttggtaccatgatgcagcaaggatgctaagcatagccctcctgccacgcatcatccagcactccttcttccttcgcacctccttcaggcttctgtcttttacagctcctgaagggaaatgtgttaaatttgaataccacagagtcagaaataagctcacttgtgaaggggcagaggactttttctcagtccaagactgtttgaagttgtgagaagactgtcagtgagtatgataaaatgaaacagaggcaaatgggcctactgataaggagcagttgggaaaatgagaaggactagacgaatttctgagtggcaaaatttgtgaaaatttttgcctctccttgtccctctgaaaagaaaagcttgctgggtgtaccagctgcagtggagcccaccaagttcatataactctctaatttgattatattatgctatagatggttccttttattctcaagttttgtctctttggcaaaaaaatacaaaaaaatattttctatgagtacaaatagacactcatgtagcagttttgcttgtatctctacatatgtaaggtttactgtaccagtagatgtaaaatttgcctgacaaactattgtattacatacgaaaatttacacatttgagcagaaaaagatgcatttgagtaagtggtaatttatttttatatttctaagcaaagtttatcaggcttttaaatggtgctagaaaatatatttttttatgttttgatttttcctaattgggtattatgctgtcagattgctccaggcaatggttgactcatgattgaagatactgtttccttcctgttcaacaacctgtcccccactcctcccctaatacctatgtaagcttcatcttctataagtgaattaccatctttatgtggcatactatttttaagtgggattttaaagaagtaatatcattttgacttttacaggtcataaccactaggcatgtgttcttcaaccagtgttgttttataaatatatgaataaaacaattggcatatcaaagaatttctttttgctcagaatactagttcactttaaatagctaaagtctcttacattctttttattctgctaaaagttttaatgatctctctatatatgatttttaataaaatagatgatgacatttaaagcagttaatttcagcagcaattctatgagcagtttttgagtattccccagggacccggtcttgtgatagattctggggctgtatagccaggtgaaaagatgtgggtccttactctcaagttgctgccagtcttctggagagacaagcttggaaacacaatgtgtgatgaagggaacaagagaaccgtgttccagtaacagagatcggcccgacaacggagggatttctttagtcagctggggactaggagggcttcccagagaaaattacagtgcatttgggctttgaaggaaagataggtgatgtccatttgaagagatcaatatgttggaccgagcttggcatctggaagtttttgtgtatgtgatttcttcaaaatcttcagtagcatgcatttaggctcttagtaaacagatgacttctgaggctctgtgagaattttgcgtattatcagtctttttttttcttttgcaagaataaagcacgcctggggattaatgtaatttgttaaaacaatactgcctattgagatcttgtgtgtattcttgtattaagttttagtgcttatttgtaagagactacgtaggtgcctgaaggatattgttgatatttaattaactggcattttccccattctctctcctctctctcgtcctctacccctgccccctgggtgtttttgcagttggttagtctgctgctaattggaattgctgcgtggggcattggcttcgggctgatttccagtctccgagtggtcggcgtggtcattgcagtgggcatcttcttgttcctgattgctttagtgggtctgattggagctgtaaaacatcatcaggtgttgctattttttgtatcctttttaaaaatcaagattttactcttgatgactattttgatggttacaactaatttaatattatcactaggaaatttattgccagaaagcaactccaagcaagccttatgcatatttgttcaagaactattagaaacatttcttagggtaatgttattgtacgttttcatattctcaccctgtccttgtgacaccctgaagaatatattctgcaagttcagtgtagtcctatttatgtattgtaaattcagagttaaattgaattgatttggtgacttctaggcccttttttacacattaatgtttggttgagaatttcagtgttttttttagacttaatattaaaaaagcttacatgtatttatctatacctatgtctgttttgtaaatgtaagaatttttattttattctgaatgaaattctaatctagttttagttatgtaattatgactaatatttttctttataaatttgatgcaactatgtattaccaaaataataatatgtgtatcctttttgaactttctctaagtgccatctgttctgtattctgggttaattacttcttgtgcattctaaagttgtcagtacctctgtacctctgttttatgccattctaagaatatttagaagtatccttaacttctaactctcagtatatgattattctgttacttgtatttattgttcagttttctgtatcttgcgcttgtttagccctgaaccaggagcaacaggtaagctaagacttttttcttctactttattataccacatagcatgagtatgaaaaaaaggagggtaatgattagaatataaaataatttcgtcttgcacagaatgccaccttcactctggatagcaaaactctcttgttccctttgcattagtgcagcaggttggagccggacaccatcaggtgttgccattttcggtatcttttaaatcggattttgctttcactgggttaaaaagtgctatggctaaaagatgttcccccaatcttttcccactattatgcaatgaaacatttgctccagaatgcttgtggttccagtctagcaatgactgttttcaagctctaattcgtagacaaatccaggtttctgtcatggagcaacagaacttttgccttgttaacactccgagaattatgcctttgaaccaagtgcttcttttaaattgcatgtaaattcttttaaatgcatgtaaaaaattaggagtttttcaatcttgggatagaaatagtgccttaatttttgctgcaaactgaggaataagcctttgaaaagttttaaggatttttaaaataaaaattattttaggtacacttagtactaaaagttacaggctccagctttatacattttctgcagggatgacacattttatatattaaacacatttactagggtcagcttctggaggttggttggaacaatacggcaagtgctcgaaatgacatccagagaaatctaaactgctgtgggttccgaagtgttaacccaaatgacacctgtctggctgtaagtacattgtataatatatgtttttggaaatgtattacagataaataatgattaatgtggaagaaatggactttctgatgctgaattgtattttcaggattattttatgtatatatttacattatatttccatgtcctctgttatatcatttgcctgttctcaaatacccactccagagagtgttgagaatttcaaggccctattggacacagatgctaatggtttattgtccctaatttcttcccatccttctcttcctagaacaagttgtgaaagaaataatagtacgtcagttcatgtgttcatattttggggaaactcctgttatcacatctctgagccctaagctgaatatttcctcagtgaggcttcttttgtgagattatctccttgtagggggtctgtgttatgtttctgttgctgcgtaacacattattacacagcaatagaaacacactggctttaaatatccatttagtggctttaaatacccatttattatctcacagtttccctgggtcaggcttggctgggtcctttgctcacctggctgaaatcaaggtgtcatctgaggctgcagcctcatctgaagcttggggtcctctccccacgctcagtggttgttggaagaattcagtctttgtggctgtgggaccacccctgtttttttgctgcctgttggctggaggtctctctctgcaactagaagctgctctcaggtcctatgttactctttcacaatgtggcagcatcaaagtcactgtgagaatctctccattctgttaagatggagtcttttgtaatgcgtaatggagtcttatctgatgtaaggtaacatggaagtgactgtcctatcatattcacaagttccacgcatactcaagagcagtgattgtatagggtgtgtacaccattgagaggggagggtgggagtcttgggggctgtgttagagatttgcacactaaaaaaccaaggcctcaaattggatataatactcttagacactaattttgtgtgtatgcagtttttatgggctttttataaatgtattttgaaataaaggtttttttactttaattggtgcagagctgtgttaaaagtgaccactcgtgctcgccatgtgctccaatcataggagaatatgctggagaggttttgagatttgttggtggcattggcctgttcttcagttttacagaggtatgtgcaaataacaatatttttcctcctttgtcacagagattcctgttttgcatgacaaagggccttgattcttgttatcagtgagcattttcattgagaactagcactgtaaaaagaggaaacttggtttagaatcagaagatcttacaagtctattaatagcaccaactttaggaccgggtgaaaggcttgatctgtctcttcttatgtaaaatttaatgaactaatgagtgagattagattgaattatctctagggtctcttctatttctacagttgtgtgatgaattataattttaaatttaatttggaaaaggtaggacattcacattgtttaatatgtatgttaatgtctataatacacagacatacatatataaaaagattatatatctttttatatatatcttgaaaaattgccttcctacaccatttttcattcccctgttcctagccttctaaaacctatgcataatgtctatatgtgtataatgtattgtgtataatatgcaattaatatatagtacaatatttatgtatgtgtatttatcatatattttattcaagttcagtttctttttttctcatcaagaatgaaatatgtacatttggctgtcattaacagcataggaaaaaaaaagaccaagattaatattctttttttttttttgagatggagtcttgctctgtcacccaggctggagtgcagtggcacaatcttggctcactgcaagctccgcctcccgggttcacgctattctcctgtctcagcctcctgagtagctgggactacaggcgcccgccaccacgcccagctaattttttgtatttttagtagagacggggtttcaccatgttagccaggacggtctggatctcctgacctcgtgatctgcccacctcggcctcccaaagtgctgggattacaggcatgagccaccgtgcctggcctagtattcattttttatttttatttatttattttatttatttattttgagacagagtcttgctctgttgcttaggctggagtgtagtggtgcaatctcggcttactgcaagctccacctcttgggttcaagcgattctcccacctcagcctcccgagtagctggggttacaggcatgcaccactacacccagctaatttttgtatttttagtagagacagggtttcaccatgttggccaggctggtctggaacccctggcctcaagtgatctgccaacctcaacctcacaaagtgctggggttacaggtgtgagtcattgcacctggcccaatattcatttttttaaagttccttctgacttccctctttagtctgaccattttttcatttcactgtttctcagaaaagagctatctgacttgtgagttggttgtgacattaattctagaaaaatgatatacagcttgacaagaattctgtgcatttctctcttcttttgtttaaaaaccatagatttttgttatgaaaacttaaaaatacagatagagaaaaactggagtaatttctctctacacatcagctagagtcagcagttatcagaattttgccacgtggcttcttttttatatctggaatttattttgagaatttagttcttttgagcagcccagttttcttgtcatcagatcacactgccttcagttatgctattttttaagtaggagttctttaaaaatagaactcatgagtcttagatttctaaagtgttctttcatggaatcctgctttatatcttacatactgtctcctttggaaatctggctagagatttttataacttatgcaacctggttttttagatagtgatagtggtaggctctcactttttaagtttatattttgctcaatattcacagaatcacagattctcagaatttgaagggatgcagttacttagctgacaacttcttctcataggtgaaatagaaagatttgatttgaactatttattatacctttaaacaaacctaaaccatgagagaaacattgatttagaatctgaaaaaagctatgattaatatatgttctttgtagtaacttgagaaactacaaaaaattatgaagatgaaaaattagacgtagctactaaaattacctactcagaaacaatcatttatattgtggcatatttccttctgcccgttctatatttagtaaaatgagtaccagcttattgcatattctacatgtactttatttttctacatacattttcatgttatgagcaatatattttggtgacctactgcacactgagtgtaggttctagagaccgcagagttgatgacatctaatcaaagttacctttgaaaagtgccctcttaatcatgagcacttttgtaagcttgaagttcaataattatccagttttgatctttttgcattttggatgtagccttcctttctatccctctctgaacagtcgggcaaggaaggggagagattttccccttttggcgcttatagccaagttggaggaatacaattctggtaaaatgtggctccggattatgagtatttagtttgtttgattgctttcttcccccaaggactgtgatttaccctctcagcatatatccaggggtgatagtcaaaatgttaacatcctcaaaaattctgaccagaagctccctgtgctgaaaatttccaaggtggggagctttggcaagtgatatttgggcaggttgaggtggggcggggggactcaaagaaatagttgtttaactacagatatgtaagtatttccgtgttgtaacagctagtgtggctgagaacagccagtgacatgtcagattaccgaataaaaccacaaaagtggggtagtttatgggctccaggtttgaacatgggctctaccactgaggacctgtgtgattattttgtttaacctcttgttgcctcagtttcctcactggtaaaatgacgatattgatagtatctattttgtgaaagctattggggggattatatgaatttgtagtttgtagaatggtacctttcataaagaactctttgttatgtttgttaaatacatttctttttccccattagatggattccaaaacagatgactttccacatcttcaaatcaggcttacctttccttgattcaacctgcagacctcagtccaccagctataaacactgccagttatgaatcttacagtaatttgtggattcttattgtggtcagtggagagaatctgggacttacctaactctctagaagtagtttaaaagggctaatggtggctacaaagtcacataaacaaaatttaggttaaaagttggcacacgtataaagtgggagatacagtttaaaactcattttattctattaaaattttgtatcttttttagcctaaagagttacaattttcatttatttaaaataaaccaactttgaaacagaaacagagcacacatttcttaatttaaaaaactatactggctaacaatttagcgaacttggtgcgggaaatggcacagtaacagcttcatctcttcctaccaagagaggtaggaattataacattttaaatttctgtgttggaaaatttattcattttaagattttttgctgttacttaaattttactgaacttagtttattcctgaattatcaaaatatatgctattttagctatttagactactttgactttgtattagttttccatatttctgctgtaacaggttaccacacacatagttgcttaacacaacacaaacttattgtcttacagttttggagatcaaaagtttaaaataaaggtaccttctggaggccaggctcaccagccctccttttacatcttcaaagctaggagagttgcagcttctctttctatttccctttacttctgccatcacggtgtcttctctccatgtttctgactctgtccttcctgcctccgtcatatgtgtccccctgtgattatatcattgagcccacctgggtaataatctctttatcttgagacccttaaccacacccgcaaagtccctgttactgtgtaaggtaacatatttgcaggtcgtaggggttaggacatggacatccttcagggccagtcattcagtttaccacagtgttcgttttaattttttctcagcgcccgtcatttggtttacttcatttcaaaaagaaaaaaaatctctccccgttgaacaaaagatgcaaagcgattgagagggtccaaagttattttattgatcaactgaataaatatacataaatgttactttctttttctttactttatttttttttccccattccagatcctgggtgtttggctgacctacagatacaggaaccagaaagacccccgcgcgaatcctagtgcattcctttgatgagaaaacaaggaagatttcctttcgtattatgatcttgttcactttctgtaattttctgttaagctccatttgccagtttaaggaaggaaacactatctggaaaagtaccttattgatagtggaattatatatttttactctatgtttctctacatgtttttttctttccgttgctgaaaaatatttgaaacttgtggtctctgaagctcggtggcacctggaatttactgtattcattgtcgggcactgtccactgtggcctttcttagcatttttacctgcagaaaaactttgtatggtaccactgtgttggttatatggtgaatctgaacgtacatctcactggtataattatatgtagcactgtgctgtgtagatagttcctactggaaaaagagtggaaatttattaaaatcagaaagtatgagatcctgttatgttaagggaaatccaaattcccaattttttttggtctttttaggaaagattgttgtggtaaaaagtgttagtataaaaatgataatttacttgtagtcttttatgattacaccaatgtattctagaaatagttatgtcttaggaaattgtggtttaatttttgacttttacaggtaagtgcaaaggagaagtggtttcatgaaatgttctaatgtataataacatttaccttcagcctccatcagaatggaacgagttttgagtaatcaggaagtatatctatatgatcttgatattgttttataataatttgaagtctaaaagactgcatttttaaacaagttagtattaatgcgttggcccacgtagcaaaaagatatttgattatcttaaaaattgttaaataccgttttcatgaaatttctcagtattgtaacagcaacttgtcaaacctaagcatatttgaatatgatctcccataatttgaaattgaaatcgtattgtgtggctctgtatattctgttaaaaaattaaaggacagaaacctttctttgtgtatgcatgtttgaattaaaagaaagtaatggaagaattgatcgatg

SEQ ID NO: 38264 - DNA, 1862 bp, Homo sapiens
cggggcggcaccgagaagctgaaacggaagtggcgtacggcatgcgccggtggcgtgatggagcggcagcagcagcagcaacagcaactgcgaaacgtaagtgagaactaagtcgtttcgaggccagacgttcagctcgcattcctgcacacatcgcgggaaccccacagggccagggatttgagggctggaaacttcgggctatggcgcgcgggcctgggaaactttgggcggcgcgaccttgactagaagtgtggggcccttatcgctgagtttgtggtcccccttttctctcagctgcgtgacttcctgttggtctacaatcggatgacagaactctgcttccagcgctgtgtgcccagcttgcaccaccgagctctggacgctgaggaggtggggaactgtgtagggaggttacgctgcaagaagagtttagcggtagactgcttccctcctcaccccacttcccgtacctctggccctggccttcccacgaccctcacccctaggctgggcatggggaagaaaggaggcggacccgacagggcacctttatcctccacttaaaccctatcttccttctaggaggcctgtctgcacagctgtgctgggaagctgatccattccaaccaccgcctcatggccgcttacgtgcagctcatgcctgccctggtacagcgccgcatcgcagactacgaggctgcctcggctgtgccaggcgttgctgctgaacagcctggggtctctccatcaggcagctagccatacccaaccccaggaaggaaggccttggatggaccctcagattgaaggacccggtggaccttggggttggtgaatcctaaacagagagaattcgaggttgcctgaaagctgggtgtccttgctccttttcctggagccaatatacccagtttttactcagtttgatttatattctgggcaaggaagctttgcctactttattggcacaatccgttgttctgtcgtttagtgcatatctgctggcttcagccctggcagctgagaaattgttttctatatgtagaaggaaaacctgagcatttgcaggcatctggttaaagcagggtctgtgtgtacaattttaaaacgggtaatatgtcatgctcttagttcatcttcacaacaaaactatgagtaagcggtattagcctcacttaacagatgaggaagcaagattccagaaagtaccagaaggtcattttatacaacaggagattggttcctgcccagatgacagaaaatgggagctctgtctagttgtccttaagtctgactgacttcagtggctcataaccgtgagccaagtatttgttggttcataactgttgttttgtgaactatgtcttacatgtctagagttctgctggatctagggaaaggaggagctatcgaagtacaacggatcaaaaaaccacagggcttttgggcactgcctccttgggaagttagtggccacagaagagagatgaaacctgtaagaagtctggagtcttttggaacttcagccatttccccaggttgttactttcttagtatgtacagtcttctcaggatgagcagtaaaacctttgaacaaaggtctgtgtggttgtcttcacgggcaatcaggaagggagagagctggggaccatattctgcaatgcagccaaatccgaggaagagaaactgaagggagaagtagatggcaatggttatgataaaaagggataaaactaaatcttcgggacttctttaatgctacgttaatgtttcactgctcgtctagaaactcctaaatccagctttctatcatctgccccacattggtcccattgagtacattctgtgatttctaattc

SEQ ID NO: 38265 - DNA, 54581 bp, Homo sapiens
acgggagttcctccttgctctcgcccctactctttctggtgttagatcgagctaccctctaaaagcagtttagagtggtaaaaaaaaaaaaaaacacaccaaacgctcgcagccacaaaagggatgaaatttcttctggacatcctcctgcttctcccgttactgatcgtctgctccctagagtccttcgtgaagctttttattcctaagaggagaaaatcagtcaccggcgaaatcgtgctgattacaggagctgggcatggaattgggagactgactgcctatgaatttgctaaacttaaaagcaagctggttctctgggatataaataaggtaacagtgtttactatgttttactttctggtacctttaatttgtggatgtgtctgcattttgctggcaaccaccctttacctcatctctgcaaagcagggaggaaaaaaaaattagtattgccattttgcagatgggagggcatgaattaatatgttgtatgatcacatgataaacagacctagaggttataatagtcccagttactgccccatttgtaaattgatccccatttttgccctaaggataactcataattttttcctgaacctgatttcattgatccctctattttaaaaatagggaaaaaacaatcgttttagctatatattaaaagagtaagaagcttgtacctattaagagaaagtcctacttactgttaatgagaaaagtggtttgaaagattatactcgccgttggctcacgcctgtaatcccagcactttgggagtccaaggcaggcggatcgcgaggtcaggagatcgagaccatcctaacacactgaaaccccgtctctactaaaaataccaaaaaaaaattagccgggcgtggtggcgggcgtctgtagtcccagctattggggaggctgaggcaggagaatggcgggaaccccgcggggcggaggttgcagtgagccaagatggcgccactgcacttcagcctgggcgacagagctagactccgtctcaaaaaacaaacaaaaagattatactcaacagaaaccaatgctacattgccatagttattgccaagagtaattttaaaaagcatcttttccgggaggctgaggtggggggttgcttgagcctgggaggtggagactgcagtgagctgtaaacgccccactgcactccagcctgggtgacagagtgagaccctgtctcaaatttttttaaaaaacattttttaccacgtttgacctgtgatactgaaggagtggcgggaaagcatcttttagtaaaaacaataaaagggaaaaaaactttcagtgtaattttttacctaggacaagtgtaggtgtggcttagggaggagaagaggacctagaatccaaccttttatttgacctttggtagatgaacaaaggggtttctagaagatacctgatggcctgaaacattatccattacacactagttgacatgcaatgctgtaaacaataattcaaaggatgtgaagttaaatgagggttaacccagtgagtggctgatgaagacagcaatcaacaaataatgactgtctgctgcttagacattagggatagggtgacaaacagaaaataaggttccatgacctcagtctagtagggaaaatggacattaagtaattacaagtgcaggctggatgcggtggctcacacttgtaatcccagcacttttggaggccgaggcgggcagatgacctgaggtcaggagttcaagaccagcctggctaacatggtgaaaccccatttctaccaaaaatacaaaaaattagttgagcgtggtggcgtgtacttgtaatcccagctactcatgaggctgaggcaggagaactgcttgaacctgggaggcagaggttgcagtgagccgagatcatgccattgcattccagcttgggcaacaagagcaaaactctgtcttaaaaataaataaattaattaaattaaattaataaataaaaaagtaattacaagagcaatgaaaaatacaacccaggtccagcctggaccagcatggtcaaggtctggcatggtgatatagtcagacacatctgagctttcgttttctgattgggtaacttactcaacgtttccacagctttagttccttttctgcaaaatggataaaataacaatacatacctcaaaaagctgtcagtatgatatgagataatgcatacaaagcatttagcacagtgtggtataaggtaaacacactgcagtgttcttattattccttgacaaagtgtggtttaagctaaaatttaaatgtatgtaagagttagttaggttaatgacttccaatgtccagtgctggtttgtacaaaattttctctgatcttcagtgacatgcatttatccaacaaatatttattgagcacctattatctgttaggcactgttctaatgcagaactgaggatatagcactgaggaagacatgagcctcatgagctaggggcagtatgccacactgtataataaaatgtataattgttagatggtgttaagcataaagaaaaaaataaaaggtgaaagtagataaaagactctatatggtggggagggtaggaggggagtgttgactttacagtggtggccaggaaggccccactgagatggagataattgaatcaatatcagaagaagctgagagcacagtgagtcctgcagggagggatcagcaaatgcaaagcctggcatagactgagggaagggagagaagcacaagaaaggtctagatctactctgtgcaacacagtggtaggtagtagcccctagcctcttgtggctcttgagcctttcaaaatgtggccagtctgatttgagatgcactgtgagtggaaatacatgctggattttgcagacttagtatgaagaaaagaatgtagaattttgtgttaataatttttatatagtatacatgttgaaatgataattacttagatatgttgggttaaataaaatatgccactagattgttttttttttttttggtgtgactactagaaagattaaaattatatacatggcttgcgttatatttctatgagacagtaccggtgtagagatttaaagggctggagctacagatgataaaatttcctgtattttggctttttactctggggagtcaatgaagggttttgagggtaattcctattgaagaggatcctccagctgctgggcttaggagagatgtaagaggagaaaagatggaaggaacaagtaaagtaagagactactgtgataatccaggcatgagatgaaatgatggggactattgaaccgggttggcagtagcagagattcggagtaatggtcagaaaaattgaggacaatgtagtgagtttttattaggttaaattagtttaatttaaataatctatattttattttgagattatatccttcctactttttgtgggtaaaaaatatatttgttaatgaaattacatgataacatatgagggtcattttgttagttttgagtgtccttatttggccaaaagtttggcaatcctagttcggtatacacatcccactctatttttcttgccgttttatagatttgaaattatagaaggctgagaaccactaaacctgattgggaaaggacagggtggggatttggagcagtccaggtagcagaaactggagatgtgaagctcttgggctggtgaatacctggagaatgaggaagaaagtggagtggtgtttgattgttatgagatctagctggcagggcagggaggggccaaacggagggccctttcacctagagtacaaagacaatctcttagattcatccatgtaatgaggacagcagtgtccacatgtaccatatgttaatttagggaagaattaatggtggtgtcagctttgttgttccactaagcctgataatgggaattattcattctgctttgtgataatctatcacttcttgactattctcattcccatgcttggttagaatagtttgtagccaggcatggtggcatgcttcagtagccccagctactcaggaggctgaagcagcaagattgcttgaggccgggagttctggactgtggtgcgctctgcatgtctgcataagttcagaatcaatatggtaccttctggcggtgggcatgaaggagaccaagttgtctaaggaggggtgaaccagccaggttggaaacggaacaggtcagagctctggtgctgttcagtagtgggatcatgcctgtgaatagccactgcactcaacctgcgcaacagggagaccctttttcctaaaatactagtttggaaagaaaaatttacagtaagtggtgagcatataatatatgctcaaagactatttgttgaatgaaaaactgaattaatgaataactgaaagaataatgggcataatttaaaaagtttttcaatttttagtaatcaaggtaatgggtgtaaaggtcttagttgtaccaatagacaaacatatttgaaaaaagttaccaagggaaatcttgaagagttatgagcaattgtactgtgctgcaaaacattttaaaggaagaattcattttttttttgaagatctgcttattttttatttcttaccaactatctacagggcactgtccggaattttttctggaggaatttagaacttaaatttgttgcaccggccgggtgcagtggctcacccctgtaatcccagcactttgggaggccgagatgggaggatcacttgaggccaggggttcaaggccagcctgggcaacatggtgaaaccccgtttctcctaaaaatataaaaattagacgggtgtggtggcgcatgcctgtaatcccagctactagggaggctgaggcaggagaatcacttgaaccgggaaggcagaggctacagtgagctaagattgcaccattgcactccaggctgggtgacagagcgagactccatctcagaaaaaaaaaaaaaagtttcacaattcagaaggtgtggaaagcagaccaacctaaatgaggaagaccaaggaaacagggcaaaagtgagacagcggatgtgaaagaagggtatctttgcatccatatagtggagtggtggttagttgcttggtggttacagaaagccaaccagtaataagcaaatctctgaaaacagaataaatgggacataaatttttattgtaaaatttgttcatgtaaggaaatatatttgttcaaaaaagagaagacccaatcaatacaatatacttttttttttttttttgagatagagtctcgcactgttgcccggactggtgtgcggtggcaaaatcttggcttgctgcaacctctgcctcccggattcaagtgattctcctgcctcagcctcccaagtagctaggattacaggtgcccaccaccacacccagctaattttttatatttttagtagaggcagggtttcactatattggccaggctattcccagaatcctgaccttgtgatctgcccacctcagcctcccaaagtgctgggattacaggtgtaagccaccgcacctggccaatacaatatacttttaaaaaactttttaaaatatggtaaaatatatgacataacacaccattttaaccatttctgagtgtacagtttagtggcattaagtacatttaccttattatgcagtgatctcttctatttctctccagaaatttttcatcttcccaagatgaaaatctgtacccattaaaacaatatatctccccagccctctctctccccaggtcctggcaacaaccattctattttctgtctctatgaatatgatactctgggtactgcatataagtacattcatatggtatttgttttttgtgtctggcttatttcatttggcataatgaaggttgtacgtgtagcatgtgtcagaaattcatttctttttaaggctgaataatattctatcctatgtgtatacaacattaatatacttgtaaaaggaaatgccaaaagctgctggttaagtataggagagcaaaataaagtttacctgagatgttgatgtcccttgaggaataagagttcctcatgagagtatactacagtttgtgagggagatttcagtaaaagaaaaatattgtgggaacctgcccccaatatttcaatgtagcttctttctattttccataagtgtcagccggctgagaaataaagagagacagtataaagagaaattttacaactgggccgctgggggtgacatcacgtatcatgatgcccctgagcctcaaaaccagcaagtttttattaagagtttcaaaaggggtgggggtgtaagaacagggagtaggtacaaagatcacatgcttcaaagggcaaaaagcagaactactgataagggtctatgttcagtggtgcacatattgtcttgataaacatcttaaacaacagaaaacagggttcgagagcagagaaccggtctgaccacagatttaccagggcaaagtttttccccaccctaataagcctgatagtactgcaggagaccagggcgtatctcagtccttacctcaaccacataggacggacattcccagagcagccatttatagacctccccgtaggaatgcattcctttcccaaggtattaatgttaatattccttgctaggaaaagaatttagcaatatctctcctacttgcacatccgtttataggctgtctgcaagaagaaaaatatggctcttttttgcccgaccccacaggcagtcagaccttatggttgtcttcccttgttccctaaaaatcactgttattctgttctttttcaaggtgcactgatttcatattgttcaaacacacatgttttacaatcaatttgtacagttaacacaattatcacagtggtcctgaggtgacgtacatcctcagcttatgaagataacaggattaagagattacaggcataagaaattataaaagtattatttgggcactgataaatgtccatattaaaatgaaatcttcacaatttatgttctttgccgcggctccagccggtccctccattcggggtccctgacttcccacaggagaaaaagaacttgtttccctttattatcataacagtttcactatgcaagctactaattctccccacagctgtccagatttggcctttccaacattagttgccatttacaaatgtgtacactgattcaccatcctctctgtggataaatgtatgagtcctcctagggtctgcccattagtgcattagttgacaattattaggttgatgcaaaagtaattgcagtttttgtcattaaactaatggcaaaaacagcaattacttttccaacaacctaatacttggcctgcagaatgcacaatactagatcttcatccaaaatatcttttgagacattctcttaaaagttaaaaaaaaaaaaaggcaaaaattggccaaaagcaaacaagcaaagataacaacaacaacaaaaaaccccaatggtatgatcctaaacttaagttgactcaaaattggcgccccaaattggactcataaccccttttcctcaaatctgctgtcatctctgtctgacatgtggcagcgtgatcttgccagctaccaaaactagaaagcaaagatgtcagatgtggctccttcccatccttcctcatctactcaccaagtcttactgattttaccttctaaacatatattttaaaggatattctttcctctacattttttctactaatgccacatttcaagtttgtgtcatctattacctgaatcactgtaactgcctctcagtttttttcttcctccagtgttgacccctaaaatccaccctccatacatcagccaaaataatcaatacgacacataaacctgacactataatttaatcagtggctcctcattcattttttgataaatcttaatatgacatgtgggaccttaatctgaacttcttctggccttgacctttatgatccatccaacaacactaatcctactagtggtttccacaagaccaatctcctatctgtcattgcccacaccctgcctgatgtgtcctttcaccctggggaaagcaagtgaaagggcatggcaaaccactgctggaattgtattgtgtgcccctctgtgttcccgtaactccctgtatagaactctgctgtgatactcatcacaatgtattaggttgaaactgccaatattcaatcttttattatcaaaacaataacagtattacgtggtcctacttaactatgatacttatgtttctttctactacacagagaacttcttggggtcgggactctacctcattcatatttgtgtcaaggtttttctaagctcagtgaatatgaccttcacattaaaatgctgaaagaacaaatggtttaatgaactgtggttaactcattatttcttttgcagacagtaaactgacatccatgaatagtttttaatgacatggaaaaaagtttaatgttacattttttaaagcctgatatggaatacacagagataccaacattcacaaagtattcaaagttcataaatataaaaactagtattttaagatttttatcttcttttaagaagcttgctttaaattcagctccaaataaaagaagctagtcaaaatactaaaagcaaaatgtgcctatatacctgccaaaaatgtgttgttaacaatcttgcccaattcaaatggaaagaatctcactactttttaaaaattatttttaattattttcagctgtcgatataatatgttcatatcaattattaccttgccctcttttttgctttttctagcatggactggaggaaacagctgccaaatgcaagggactgggtgccaaggttcatacctttgtggtagactgcagcaaccgagaagatatttacagctctgcaaagaaggtgaaatgttgtgtttagttagaatcatatcatgttagagctaggaggtgttttggagatgacccagtctgtacatgatatagatgaagtacctgagaaatgttgttatttgaccaaggttatagaactagctcatagcaaacccaaaactagaaccgagaactgaacctctcaaatattagtatgttctggaattttccagggagttgttaaaaatgtatatatatactcttgggctccacttccagagattttctttcagtaggttgaaggcagggcctcaaatacatccaccctgcctcccatgcgccttcatctcacccatgatgctcatataggtaactatgcctggatgacacttgcagaattgctgacagggtcttctgaagcccattcatagaattgggttagaaagttacaataaagctattctttatcaggtttttattgtagatagatctatttcttttcttttctcttttttttttttttttgagatggggggtctcactctgttacccaggttggagtgcagtggcatgatctcgattcattgcaacctccacctcccagaatcaagcaatcctcccacctcagcctcccaagtagctgggaccacaggtgtgtgccaccacgccagctaattttttgtatttttggtagaaaacggggtctcaccatgttgcccaggctgatctcgaactcctgagctcaggggatccacccacctcagcctcccaaagtcctgggattataggcatgagccacgctcccagcagatctatttctataaagcattatttgcctcttctagatacaattgagatgtgctgtatataatggggtttcactctgaacgcattctcgcttgtacctgttaactaaataccttaatggcagcaaggtcatcagaattacctgggcagattccttaaaatacacattcctggaccttacccctggatattctaattcagtgcagtataaaaagtgtgattcagcaagacttgagaacctctttgtttatggaatttttggtttgagttctttttttttttttttttttttgaaatggagtctcactctgtcgcccaggctggagtgcagtggcgtgatctcagctcactgcaagctccacctcccgggttcacaagcgattctcctgcctcagcctccctagtagctgtgattacaggcacgcaccatcatgccgggctaatttttgtgtttttgtagagatggggtttcactatgttggccagggtggtctggtctggaactcctgacctcaagtgatccaccctccttggcctcccaaagtgctgggattacacgcgtgagccaccacacctggcctgagttcttttttttttttttttttttttttttttgagatagagtctagctctagctttgtcgcccaggctggagtgcagtggtgcgatctcggctcactgcaagctccgcctcccgggttcaccccattctcctgcctcagcctccggagtagctgggattacaggcgcccgtcaccacgcttggctaatttttttgtatttttagtagagacgggatttcaccgtgttagccaggatggtctgtatctcctgacctcgtgatctgctccctcggcctccaaaagtgctgggattacaggcgtgagccaccgcgcctagcccattatcagatattttgaagtagctattttgaggtggccattttagtatcagaactttttttctttttctcttttcttttcttttttcttttttttttttttttttgagacagtcttgctctgttgcccaggctgcagtgtagtggtgtgatcttggcttactgcaacctccgcctcctgggttcaagcagttctcctgcctcagcctctcgagtagctgggattacagatgcccgccaccacgcatggctaatttttgtatttttagtagagacgggctttcaccatgttagccaggatggtctcgatctcctgacctcgcgatccgcctgccttggcctcccaaagtgctgggatttgtatatttcttaataatgaaagcaagctgagaatcagatattttgaagtagctgttttgaggtggccattttagtatcattttagtatcagaacgttttttttttttgagacagagtcttgctctgttacccaggctggagtgtagtggcgtgatcttggctcactgcaacctccgcctcctgggttcaagcaatcttcctgcctcagcctctcgagtagctgggattacaggcagatacctgtaatatatatatacaggctgataaatattatatacttatatagtatatataaatatataatataatatgtatatatgagatgtgctgtataataataattaatagtataatacatatacatatacatatataatagtataatacatatactattaatactataatactatagtatattatactataatatactattactatattatactgttatactatattatactatagtatactaataatagtatatactattattatatactaatataatagtatagtatactaatactatattatactattaatatataatatacatacatatacatataatatgtgtaatataatacatatatgtatatatgagttgtgctgtatataatgctgtgtatgtatatatgagatgtatatgtagatgtatatgtatataatgctgtatatgtatatatgtacatattatatatgtatatataatatatattatataatataaatataacaatataaatattatatatatatccaggaatctgcccaagtaattctgatgaccttgttgacattaaggtagttagttaggtacaagcaagaatgcgttcagagtgaaaccccattatatacagcacatctcaattgtatctagaagaggcaaataatgctttatagaaatatatctgctggagcgtggcttatgcctagaatcccagcactttgggaggccgaggtgggtggatcccctgagctcaggagttcgagatcagcctgggcaacatggtcacctgaagtcaggagttcaagaccagcctggccaatatgatgaaaccctgtctctataaaaatgcaaaaattagctgggcatgatggcaggtgcctgtaatcccagctacttgggaggttgaggtgagagaatcacttgaacctgggaggcggaggttgtagtgagctgagatcatgccactgcaccccagcctggacaacagagcaagacaccatctcaaaaaaaaaaaaaaatatatatatataaatatatatatatatatatttatatatatttatatatatatatttatatatatttatatatatatatttatatatatatatttatatatatttatatatatatttatatatatatatttatatatatattttatatttatatatatatataaaatcatatatatatacacgcaaaacatattctctcttatttgagagagctaaaaattaaaataatcgaactcttggagatagagagtagaaggatggttaccagaggctgggaagggtagaggtggtgtagggaagaagtagggatggttaatgggtaccaaaaattagaacaaataggctactctggttgcactgcctgtgagttagccctgctctgcaaggagcagccataaagaattttttgttagtaaaaatgattaataatagtaatttaattgtacattttaaaataactaaaagtataattggattgtttgtaacacaaagggtaaatgcttgaggggatggatacctgatttaccctgatgtgataattatgcactgcatgcctgtatcaaaatgtctcatgtaaccttgaatatatacactactatgtacccacaaaaatttaaaaacaaaattaatacaaaaaaatacaaaacagacattcatatcctggggaggtaataggcaatgatgaagaaagggtcaagagtgtctgggaaaatcctttggtaatataaaatagtatataggtataaatggtgttgatcagggtcaaaaaacttagcttgacactttactaacgtaaatataatctgatgaaattcaattctgactgaagagccttcagcatggcagattgatgccctacaggagtactggtagacttttgcccatggcctcctttctgtttggggtggcttgtcttgggctctgacgtcagacagatctgggagagtcccagctccatcttttaatagccatgtgaccttgggtatgaaactcaaccattctgtttcatgttttcatctttaaagtgagcatataagaattgctgtctcattgagttactgtgagaattcaataagaaaaataatgaaatcatgtaaatgcataacaaagtaaaagcccctcataggctatttgccacttttccctcagtcccccaacacactgtagcactatctctaaataatgataactctgttaatagagctaggtttcatttgaaacacagtgtataacaaaatgcattaggacgctagggtctatccgcccaagcatcttagttgcttatggaaccataaaaatctcatataaggtatttttgcattgctaccccttggaattatggtactccaatcttataaaaagtagggcttaagcatcaagattctatgatctttcttagttgaagagatagttattgattatattctagtccagaagatataacaattattttgaaaaaaagttacattacctgtaatggtccccttttgagtatagtcttttttttttttgagacagagtctcgctctgtcgctcaggctagagcacagtggcgcaatctcagctcactgcaacctccgcctcccgggttcaggcgattctcctgcctcagcctcctgagcagctgggattacaggtgcacgtcaccacgcctagctaatttttgtacttttagtagagactgggtttcaccatgttggtcaggctggtcttgaactcctgacctcatgatccacctgcctcagcctcccaaagtgctgggattacaggtgtgagccactgtgcccggcctacaaatagtctttttttaaaaatatttttctttctttttgagacagagtcttgctctgtcacccaggcgggcgtgcaatggtgcaatctcagctcactgcaacctccacctcccaggtgcaagcaatcctcccagttcaaccttccgagtagctgggactacaggaacccaccaccacactcacctaatttttgtgttttcaatagagatgcagtttcaccatgtcaatcaggctggtcttgaactcctggcctcaagtgatccacccaccttggcctcccaaagtgctgggaatatagatgtgagccaccgtgcccagcctacaaatagtctttacagtccagtggatgccttctattgctcttagcagctagccttgttcttttgtttatatttcctcaactgaaatcatttcaccaatgatagctgcaacaacctttgaaatctggccataagggtttacataagcccttccacataaccattttatttctcaaatgttcttccttctggatcaataccaaaatagaattttcaagagaaaacacacataccatgcatatatattagaaaaacacacatatgtattttaatattatttacctcatatttctatattttgggggttttttgtttgttttttgggtttttttttttttttttttgagatgaaatctcgtctgtcacccaggctgcagcacagtggcacgatctcagctcactgcaacctccgcctcctgggttcaagcgattctcctgcctcagcctctcgagtagctgggattacaggcgtacaccaccatgccccactaatttttgtatttttagtagagatggggtttcaccatgtgggtcaggctggtctccgattcctgacctcaagtgatctgcctgccttggcctcccaaatgctgggattagaggcgtgagccacctcatttggccaatatttgtatattaagtaccctcatagacacctgagcaggtcaagaagagaatcttaaaacatgttacttgtagacaagtataaatggttttgaaataattataatgatagtaatagcagtttactgtgtgtactagatacagtgttagctcctttacatgcattatttcatttgtttccacaacgactcacaaggaacttgtattagtatctctattttgcagaggaagaattgaagttttaagaggttaagtaacttggtcaaggtccaacagtgactggcagagcccaaactcaaggtccaaggaaaccactcttcacccttaagcctactgccacctaatggagagcgattgaacaacagaacagaaaataaacagaaataaatagaaaatgtggccagcttaatagtgtaatcagttttccacaattctctgtagtagtccctgattttgccacattagttttacttttattttttgagacggagttttgcttttgttgcccaggccggagtgcgatggcgcgatctcagctcaccgcaacttccgcctctcgggttcaagcgattctcctgcctcagcctcctgagtagctgggattataggcgcccgccaccatgtacagctaattttgtatttttagtagagacagggtttctccatgttggtcatgctggtctcaaactccggaccacaggtgatccacctgcctcggcctcccaaaatactgggattacaggcgtgagccaccgcacccagcctaatttaactttttttgcttaccctttgaagtaatgttttaaaaaaaatgctacttagccaaatgcctcttgatctatagtcaatagaactaagtcaagagactaaattgcaaaagaaaatttccacctgatacacttgaagatagatctattttggacataagtgcataaaataaaaaggatttttttcccctgttgacacatggattgcaaaatcacttttatccagatctagcagaaaaacaagagtcattgcgtacaagacgggaacagtgactcatgcctgtaatcccagcactttgggaggctgaggtgggcagatcacttgagatcaggagttcaagactagcctagctaacatggtgaaatccaatctctactaaaaatataaaaattagccaggtgtggcgtggttgcatgagccttcagtccctgctacttgggaagctgaggccagagaatctcttgaacccgggaggtggaggttgcagtgagccaagatttcgccactgtactgcagcctgggcaacagagcaagaatccgtctcaaaaaaaaaaaatagccattgtgtataaacttaccctcatacctcttaatgaatttacttttcttattttattttttgaaggtgaaggcagaaattggagatgttagtattttagtaaataatgctggtgtagtctatacatcagatttgtttgctacacaagatcctcagattgaaaagacttttgaagttaatgtacttgcacatttctgggtgagtatggcttcttttacaaaaatgttccttttgaaaatcccaaagattaaagtggggcttttagcagacataaggaagtattaaatcaatgctaaagttttctccaggcaccagggataacattatacaaagagatcatttttcatgctatgaccaaattctatcattcttcctcactgacaacattaataataacaataataaattaataataaatgtcaggtgttgtatatgttttaattctaagctaggttctcacatttctgtgtgatcctatttagagataaagaaaggagttggggaccatccgagtcatcgtctgtgattttataaaggtgaatccagtttgctttcagattctcttttttcttttttagacagggtctcactctgttgccaaggctggagtgcagtgatgcaatctcatctcactgcagccccaacttcccaggctcaagtgatcctcccacctcagccccctcaagtagctgggactacaggcattaacatgcccagctaatttttgtatttttagtagagatggggtttcaccatgttgcccaggctggtgttgaactcctggactcaagtgatccgcctgcctcagcctcccaaagtgctgggattacaggcatgagccactgccctggctttcaatttgcatgaggctcaggcctcatgttatttcctggccctaaaattgcaaaccttattgtgaacctcaccattgaaggtcttaagttatatatatgtacatatgccgtgtgtgtttctgaagtctccaaatattgcccaaatagccagttcttaaaaaggcccctcaaagttttcttggatgtgagtttgggatgactaatctcaaaagaatattggggtttataaaaatgcagtgttattttatgctaatattcccaagttattgacatatatctttatgttttgtgtttgttcaaatataggttactgtctctttttttgttgttgtttggagacagggtctctgtgttgcccaggctggagtgcagtgacgtgattttggctcactgcagcttcaggttcctgggctcaaatgatcttcccaccttggcctccctagtagcagggactacaggagtacaccaccatgcccagcaagtttttgtattttttgtggagatgaggttttgccatgttgcacaggctgatctcgagctcctgggttcgagtgatccttctgcctcagcctcccaaagtgctgggattacaggtgtgagccactgcacttggccgggtattatcttacttgtttcttcatcccaagcatcaacaacaagaggtggagggctggggaacataaaaatttagcaattttttttttttaaacagtctcactctgtcacccaggctggagcacagtggcgtgatcttggctcactgcaacctctgcctcccgggttcaagtgattctcctgcctcagcctccccagtagctgggattacaggtacctgccaccatgaccagctaatttttgcatttttagtagagacggggtttcaccatgttggccaggctggtcttgaactcctgacctcaagtgatctgcccgagttggcctcccaaagtgctgggattacaggcatgagccaccacacctggctgaatttagcaatttaaatgagatggattctcaaagctttcagtagccattgttttgctcaggttttctaatgtgggcatcatatccagtcaccttattgttgctgcatttgtcagttagtttgtttttttcatttatgacaggattaatgttaaaaaatatacttttgtttcaaaatattcccaataggtctgtgagtctgaaatacagtattttttctcttttaataaaaactatttgtagactacaaaggcatttcttcctgcaatgacgaagaataaccatggccatattgtcactgtggcttcggcagctggacatgtctcggtccccttcttactggcttactggtatgtgaacatgtgtttccttcattggttcttatgcctaccttgtgtgtgagatttcttaccctgtctaataagaactctctttataatcataagagacttgaagttttccagtttattattgagagttgtcaaaaaataagcagaaagagttgcacaaagtctcttgtctaacagcattatcaatcattaatccccttctagaggaccctgctagaggtagcagccggaaatgtattcagttacgagccaaccacttttaaaacatttctcatctcttttaatagcaagaaattacaaagcaagaacaataattagtattaattattaacatttgtaacaaatttaatatttataatttttaatattaataaaaatgggtaaatttttgcagaaattaaatcagagtgagagagagagaatattaggcataggtgggtgattttttttttttttttttttttttgagacggagtctggctcagtcacccaggctggagtgcagtggcgcaatctcggctcactgcaagctccgcctcctgggttcacgccattctcctgcctcagtctcccaaatagctgggactacaggtgcctgccaccacgcctggctactttttttgtatttttagtagagacggggtttcactgtgttagccaggatggtctcgatctcctgacctcgtgatccgcccgcctcggcctaccaaagtgctgagattacaggtgtaagccacctcgcccagccgagaagtggcttttaagaaaccacacaagggtgccatttgggctaacatgcagggttgcaaccacacaaggggtttgtacacttccagcttcgtgacagagctgtgctttgctagcccttagagaactcctcttcagaatcctcagctatcactggcctgaactactacagtctgtgatccttactggccacagttatcttcaactcagccagctctggtttttgctcagcatctgatcaatgataggactttcacagagatgtgctaaagattactgccagcagaaagcagtgtttatcagatattgttattaacaattgggcaattaaactgagacactgcttttttaaacatttaaaccttttttattgacacgtgacatacatttataagaatgaagaagtcgtaagtgtgcagctcaatgagttactacaaagtggatacatccatttaactaccatgcaggtcaaaaaaatagaacattacaggaccccagaacccactcttggaacccttcccaatcaccagtctctccttccttcccaaaggtaaccactatattgacttataacaccttagattaattttgcctatttttgatctttatgtccatggaatcacactatatttgtgagatttatccgtgttatggttagtagctatagtgtgatcattttcatggctgcatagtgttgtatcatgtgaccagacaacaatttatttgtccattctattatttatgaacatttgggttgtttccagtaaaaatattatttacgaatgacataatgtcatttataatggcattatgaatcttgactgaatcactcaccagctgtgtgaccttaggcaagttactctactctgtgcttcatttccctcatctgtaaaataggttaataataataggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactacactccagcctgggcgacagagcgagactccgtctcaaaaaaaaaaaaaaataataataataataataataataataataataatatctaggccaggcgtggaggctcacgcctgtaatcccagcactttgggaggccgaggcaagcggatcacgaggtcaagagattgagaccatcctggccaacatggtgaaaccctgtctctactaaaaaatacaaaaaaaattagctgggtgtgtggtacgtgcctgtagtcccagctagtcgggaggctgaggcaggggaatcgcttgaacctgggaggcagaggttgcagtgagctgagattgtgccactgcactccagcctggcaacagagagagacttcgtctcaaaaaataataataataataataatatctaacttatttagaatgctataagatttaaatcatacaatgtattgcacttagcataaaatctgaaatcctgcaagtgttcaataacaggaggttgcctgttggcattacatttcaattccacttcctgttattcacacaaaacagggagttcccacctctaattttagcttccagaatgctttgccccagtggaattcatcatatatgctctgacgcctagtttttgggatgaaatgagaggaaaaataagagtattgatccttttccctgtaattcagccctcatctatcattgtcctgagttactacagccacagaaaataatttattctagctctagtagcctatcttaggaaaaaaattttaatttcttttcagagttttagttcaacagttttaatgattaatatgaagaatgcaagataaaagaactggatttatggtggaaggtgaagcttttgattctattctaaaatgttttttgctgcttgctaagtaatttgttcacaagtattttgatttttaaaagaaaacaattagctagctaatatattctgtcaacccaaatagccaatttataagcatgaaaagttgccagtatgggaacgctcagtaaaactgagttctgaacattagcttgtaacaaaatgttatttaaaagaaaaatctggggccaggcatggtggctgacacctgtaatcccccaggctttgggaggccaaggcaggaggatcacttgagctcaggagttcaagaatagcttgggtaacatagcaagatctcatctctacaaaaaatattttaaattagctaagtgtggtggtgcgtgcttgtagtcccagctacgcaggaggctgaggtgggaggattgcttgagcccaggaattgaaggcagcagtgagccatgatttcaccactgcactccagcctgggcaacaaagacagacctcaacacaaaaagaaaaaaaaaaaaagaatttggaataagaagtactaattcagactatttttttcagccctccaagacatctgaataatttagactatttctaataagaaggaatttgatgtaatgttacaaagtgcagggggcaaaaatctactcacttttagctttcatatatatatatgcctttctatatataggttcaccataaagttgaaaaatatgttattccttttacacactcaagatcattaactctgactttcaatatattcttgcatttttggtcacttaagtaaaatcagaaaataaggtttagtaaaagaaaaaactaaatttatggatagcttcaccatgcagaaatgttaatggaaaggagtcccgatccagacctcaagagagggttcttggatctcgtgcaagaaagaattcagggtgagtccacagtgcaaagtgaaagcaagtttattaagaaagtaaaggaataaaagaatggctactccatagacagagcagccctaagggctgctggttgcccatttttatggttatttcttgatgatctgctaaacaagcagtttgttattcatgcctcccctttttagaccatgtagggtaacttcctgccattgccatggcatttgtaaactgtcatgcgctggtgggagtgtagcagtgaggacgaccagaggtcactctcgtggccattttggttttaatgggttttggccatctcctttactgtaacctgttttatcatcagcgaggtctttatgacctgtattttgtgctgacctcctatctcatcctgtgacttagaatgcgttaacagtctgggaatgcagtccggtaggtttcagcctcattttacccagctcctattcaagatggagttgttctgtttcacatgcctcttgacatttcccccttcccttttataagagaactcttaatcctaagagttgcagacggatgaaaatccatcttttgtaacttcttcaggctgaatggggccatgatattcctgcctaactgttagggtctcttgtgttcagggtagagaggagcttagtcagaaagcatcagtgtggcgagggccattcatgactcttgagttttttgtgtgtgtgttttttgtttttttgagatggagtctcgctctgtcacccaggctggagtgcagtggtgcgatctcagctcgctgcaaactctgcctcccgggttcatgccattctcctgcctcagcctcctgagtagctgggactacaggtgcccgccaccacacccggctaattttttgtatttttagtagagacgggatttcaccatgttagccaggatggtcttgatctcctgaccttgtgatccacccgcctcggccccccaaagtgctgggattacaggcatgagccaccgtgcctagccgactcttgagttttgacaagaggtgatatctgggagattaataagtatttagtttaagaaaacatttagtaagcctgtcctgtgttcccacacaaagggtataacagcaatatattccataagagtaaagcaaagtaagtaaagttattccaagtaaactaaattagaaggctttccatgaactgggcaactgttgagaccaagctgatatggggttgctagctgattgcaatgtgcctagaattttacattacccatccctcttgtttcttctgagcagcagttagagatccctggttggtttacaggaataaacagggttagcctaaattgcagaaacaaacttaaaaacaactgagactagaatttaataacaagtatactatagttcttgaaatataatattctctctccagtttcccatttttattaaagacacattatggtaagactgatttgctttattatacttggtctgattatttgtataaagtgcagcgagaataattatttttcacacaggctttttaattggctttgatggaactctgttttataaggaatctcaggtaagacttttttaaagctaagccctgccatgggtttgtacccttaaatacctatgagttgggtaaaacacttttcttttgaggtcccaagttaacttgggcctcctggacctgtaagaaagtgacattctttacttaccataggtcagaaaccctgtacagggactgtgtaggcaaagtatgaggccagtttcccatagggcttttattggctttacaagtcaagtttgattctttaaaggaaagcacaccattccagtcaaagccttggtaaaataaccaatttctccaatagtgtcccattacaaaagaaaacagatttttgttgcacttatacaaacaactatattgccataagttaagaatacttacaattggtttccattccggagaaatcaggtagagagaaacaaatatgtttcaaattttgttcataggagtatattttacttaattgctgcaagctgtaaatagcttaaaagaagtttcctttgaaaaataaaagatcagcaatattttaagcaaagttaaaaaaaattacttcagttttctattggttcagttaattcagttaactcctgttctacttgttattcatgaacattccagctttttatgagagtttcgaaagttgttttctttattttaatgttacaatttctaaagttattagcaacctgcatttaagaacatctgctagaattctatagttgattataaaccaccttttaaagaagattaaaacaagacaacaactgtctgtggatgataaaaactttaggacagccactattaaagccacaattgataaggaaatttggttacttttgtggcatacaaaattttacataacaattataattattagtaacatacactaagtcatattagaaataaaggagtttcttataactttggaacatataccaataacatatttatacaaatatagtccaaagaaagcaaaacactgtttcacatttgagaatgcttcctggatgatttttataccaaataagcgaaatttcacctttacattaatgtattattaatgttaaacccaatttttaataaaaccttagagacatatttacccaattttaatgtttaatcctaaggtaagattttataaacctttataaccctttacatttttttgtgaaagcgcagataagtcctctaagagaaacctgttgtgcttttattccaatgtttaatttatggaaaaactgaataatacccctttaactttagctaatatgttcatacacagaatctcttacaattaatttttataaaccttccacaaaggccaggtgcagtggctcacacctgtatatcccaacactttgggaggccaagatgggtggatcacctgaggtcggaagttcaagaccagcctgatcaacatggagaaaccctgtctctactaaaaatacaaaattagccaggcatggtggcacatgcctgtaatcccagctacctgggaggctgagacagaagaattgcttgaacccgggaagcagaggttgcggtgagtcaagatcacgccattgcactccagcctgggcaacaagaacaaaactccatctaaaaaaaaccttccacaacttctttaaatctttttttttttttcacttaacacaatcctttaacactttaatctaggcagaaaataatccgcattcccatgcttcttcttacaattttttttttaaccaaaaacacatttcaccttttttatacaccttgcatgtaaaactgtttcttcagtagtcttaattacacattacaatgctaacttctagcaacttttatttttgatgaaaacgttggttaagtaagggattttaattatgtactaggtgtggagactagtctaggacacaccaggcagaagtgcagataagggctgactctccagcatagccaggggcatgaggccttatctagaatctgatggctttaaagtaggtaaatagaacagttttcaaaagttaaagaaacagtttgtccttaaagcatttagcaaatctgatatctgaccttaatttagaccaaatgtctacatttttaagacattttattttaccaataaactttaaaactgtctttattttcaaaagattactaaagtcacacgaacaaaaaggcattagtttctatttttctgaaaaaatatttacgcacttacttttctaagtcaattgattagagctttgtaatatataaacatacactataaatagaagattcagcacttatacagtttttcgtttgccagtttctttttttttgagacaaagtttcgctcttgtcacccaggctggagtgcagtggcatgatcttggctcactgcaacctctgcctcccaggttcaagtgattctcatgcctcagcctcccgcgtagctgggattacaggcgcccaccaccacacccagctaatttttgtatttttactagagacgggttttccccatgttggccaggctggtcttgaactcctgacctcaagtgatccgcccacctcagcctcccaaagtgctgggattacaggcatgagccacctcgccccaccatttgccagtttcttaattggatgacaggtttcagagtggagcccttggaggaacagagctgggacagcatgcatttctagggctaaataagtagcaaataagcagctgaaggcagacagatctccaaaattaaaggtggtattttatactggatcctggatccccaaaaggagggaaatactacgggagaagacaatgcagtgcttttaccgactgtgcatttcattgcaaggcaacctaaagccaatcagcccattttgtaatcagcccatcctcatgagagtctcatctcccagtgaggggtgaggatgttgccttatcttccaggtggcctagagcatgcttctctgatccaagtgtgcagagtcaagtatccctccataactactattagccaccccttaaagtacatttcctacctagttgttacacaccaaagctctctcataatgcaaagtaattgctgataacccccctcccccaaactcaaaaccgtcagataacacaatgcaaaacagaacagagcctttgattttgagaggaatctatctgcttttaattcttggggtctcatgaggaaaacagaggggttttttttcttttttttttttttttcccaaaactggatctgtggtgctgcctttgtttttcccaagtagtcccaagctaccagaagttatctacgggcctttcatgtgagcattaatagtaacaagacaaaacaaaacaaaacaaaacaaaaaaacaaaaataattcacttgactgagaagaaaaaacctttttccagcaaaacaagcttcaagaagagaaaaacataaaggccttttaaatatatttatagcttattccacttttaattaagctgacttttcaccatagtgctctttaaagaagaaatcctttcagagctcttattacccgactttagccatgccaagcggccaatatttccagcttctgaactttaccaaaggtaaactcctaggtgcttagaagaaggaaaattgaagacagtccatggaggagaagagaatagacacatatattaaatcagtaatgacttatttcctgggtggggaattgaacctagactgccactgtgaaagtgcaaaaccttagctactgagctacaggtctgggcagtgtctatttcttttctcagaagtagtctagattagttaattttgagcttgcaaaggcttttaactatttaatatgattttcagagctggctatgacatgaactttaaaattcttgttccctggaagacagagcccaagagaaggtactgccatgcggttaaaaggtcaagctcccaagcacataaaacaaggtggagacttcatcgggttttttgtttgtttcagggacctgcaaccaagtttgttactgaccagcttgctgggtagtcttgaaaagcgggcttacaggtgttctaagcccatgttttatcctgaagtacccctctacacggaaaaacgaattcatagcacaaaatacaccagcttaagactagccttagaattctttttcgcattaattaagtctttacagaggtgataaacactgattttttttccattcattcaactgtttgcacagagagagagaagctaaaaatctgactggtaacaaattcttagccttttgctggcatgccaggcttctgggttccttttccctgagcagccctagtgatcgggcttgtggcaccatctccccgggggccaagctgcatcataaaggaaaaaaattttttttttcattttgaccagagcaaaatatgcatgataaaacatagacattagctactctgcttagcacccaatatcaaactggcaaggcttaaatttacccccagttgggccccatcatctttaatccaacctctgacttggaatttcaacatgtggtctctgggcaagaaggtcgccctgagaaatagaaaagataagaaagggaaaggaaaagtagagacggaaagtattgcctgtggcagggtggggaaggcaaaatgatcagggaggccagagaaagacccacctattgcagcaacactgaaaacttcaggctgctgctgtcggttgagcagggatctttttcagcaatcctgtcagctctcaagtttccccttttaggcaggaaaaagctccccatgtcccacgatcctgtgcatgcctaaccctgtcacccatagccatcagcaaagagtacaaaggcagattaatccaaagagaacagcagttaacatcccatagtgccaaacctgttcttagctgaaagggactttactgagagggtcctctaaccccctaaatcttattcattttatttattattttattatattttatttttgagatggagtctcgctctgttggccaggctggagtgcagcagcacaatctcggctcactgcaacctcggcctcccgggttcaagcaattctcctgcctcagtgtcctgagtagctgggattacaggcatgcatcaccacgtctggctaatttttgtatttttagtagagaccgggtttcaccgtgttggccaagctggtctcgaactcctgacctcaagtgatccacccgccttggcctcccacagtgctggggattacaggcgtgagccactgcacctggcctaacctcctaaatcttagaagggactctaatcctcctaagtcaggcctctaacttgacgtcagtcaagtgtccttgccttttattaagaaggacctgtaacccactctgtcttaggagagactctaactcccctaagttgggcctctaacccaatcccattctttacccaggtgtaggcaccccacttactcaaagtcagcccactgttgtgccctgatgattttcctttgggtcaggggtctcttcagtattgtaactctatggtctgccagaaatatgttacaggaccccaacacttacccaaaggtagccatagggtcagggtttctgcactttagtcccttcgtggttgccagaaagatgttaccagaaaggggtcccgatccagaccccaagagagggttcttggatctcatgaaagaaagaattcagggtgagtccacagtgcaaagtgaaagaaagtttatttatttttgagacagagtctcgctctgttgcccatgatggagtgcagcggcgcgatctcagctcactgcaagctccgcctcccgggttcacgccattctcctgcctcagcctccctagtagctgggactacaggtgcccgccaccatgcccagctaattttttgtatttttagtagagacggggtttcactgtgttagccaggatggtctcgatctcctgacctcgtgatccgcccgccttggcctcccagagtgccaggattacaggcatgagccaccatgcccggccgaaagcaagtttattaagaaagtagaggaataaaagaatggctactccatagacagagcagccccaaggggtgctggttgcccatttttatgattattttttgataatatgctaaacaaggggtggattattcatgcttcctctttttagaccatgtagggtaacttcctgacgttgccagggcatttgtgaacagttatggcgctggtgggagtgtagcagtgaggacgaccagaggtcacttttgtggccattttggttttggtgggtttggttttggtggctcctttattgcaaactgttttattagcaaggtctttatgacctatatttattttgtactgacctcctatgtcatcttatgacttagaatgccttaaccatctgggaatacagcccggtaggtttcagccttattttacccagctcctatttaagatggagttgctgtggtttacatgcctctgacaaaataatcatgatatgcatgttataatttttaaggatattttaaatgcaaacatatagttatgcattgaaaaaatatataattttggctcttaatttaaaataatatatgttaataaatattatgtgcaacatcgttttctatttctgcgtgggataccactgcacatacgtgccactagttattcaatttactcattatcattggtattttgtcactctttcagttgcaaggaacaaaaaacttaaactgccccaggcccaaagaggaattttttggctctgtgattaaagtctcaagcaggctgtcttcctctgatggccagatatctaccagaagttccagggttaaaccctttaaattccaagtccagcaggaagggaaaaaaaacatcacttcaacagtggcttcaaacgttcttgttctagaggtcagtgactagactagcctggagccaatcactgtatgcatttggtgacagcggtattaccagaacaaggggacacaaatgctgatgggaaaaaacaacagctgtccactacagacatttcacattattcccaactatttgctttaatgaactgcactccagggactatccttgaacattaatctttggagacatcattgattattaccttgggataaacaccggatctgagagcgtggcatacttttaatgaatttgataccttttgccaaactgccttccagaaaaggctaccagttaacctgtgctttggaaaatagaaagctgtggaaagaaagtgttttttgtcacttttttgaaagtttgacatatattgaatgaagccttaaaaagaaaagattgctagattcaattatatgaggtgaaatatctgtacattgaaaaaaactcagatgaaaatttctgtccttataattactgctaggcaagaattccgtcttgttttactttgcttttatatgaattattcctaaagtaaatcatttttatatgcctacatctactggcatttttatattatgatttttccatgaatgccctttagccatttatctattagagtattgtcttattcctttataaaagttgccatatattaaccttatccttgtcttatatgttgcaaatgctttaccagtttgtcacttgcctcttaatttgcttggagttaataaagtttagaatatatcatatataaacctggtttactacccacacgtaaaacctgattctgccactttgttttgtatcttcaggcaagtttgataacccatctttacctcagtttcctctttggtaaatgaggatcttaatatattttataggggtattatgaagattaaacaaaataattatttagaataggccaggtactgtggctcacacttataatcccagcgccgtgagagactgaggcaaaagtatgacttaaccccaggagtttgaaaccagcctatgcaacgtagcgagacccacatctctacaataaagtaaaataattattcaagtgttgtggcacatgcctgtagtcccagctacttgggaggctgaggtgataggattgcttgagcacagaagttcctaggttgaagtgagctatgattgcatcactgcactccagcctaagtgacagataaagactccccaaaaaactccaaaatgcatcagaataactgagggcaatgtctagcacttagtaatctattttagatctgatttttatttatgttgtttttcagtatacagaagcttttaatctcatataatttaatctaacaatctttcttttaagccttctgtattagtcccctctcaccctgctataaataactgcccaagactggccaatttataaaggaaagaggttcaattgactcacagttctgcgtggctggggaggcctcaggaaacttacaattacagaggaaggggaagcaggcatgtcttaaatggcagcaggagagagacagcgagagagagtaagagcaagagacgaactgccaaacacctaaaaaaccatcagatcttgtgagaactcccccactatcacgagaacagcatggggaaaactgcccccacgatccagtcacctcccaccagtgccctccctcaacatgtggggattacaattcggattacaattgttgatgagatttgggtggggacacagccaaaccatatcagcttcaataagtgcctaaactttttttaaaaaggtaagaaattttttttaaaattttttaaaaaatttccacagctttctgtcttccaaagcatagattaactggccagaatgtatagctactttgtgtaattgctaattcatacagatttaacagaataaaagattatctgataattattgccactgaattgcacacttaaaaatggttaaaatgacatgttttacatgatatatattataccacaacttttaagttaattatatatcaaaaaccatttaattgtgtacattaagtgaatgctttgtgtgacatatgaatttatatctcaataaagccctttttaaattaaaaaaacctgagaaagtaatgtccatttagaataagtaatttcactactacttccaaatgaaagagctgttaaaataaacgctttgcattgtgattcattcatttgacaaatattcattgagcacctaagagccaagcactgtgctgggccctggagattcactggtgaccaaaacagtcatggagcttataggaaaggtgtgggaaacagatgttttaaaaaatttaatctcagctgggcgtggtggctcacgcctgtaatgccagcactttgggaggccgaggtgggcagatcacgaggtcaggaaatcgagaccatcctggctaacatggtgaaaacccgtctctactaaaaatacaaaaaattagccgagcatggtggcgggcgcctgtagtcccagctactgcggaggctgaggcaggagaatggcgggaacccgggaggcggagcttgcagtgagccgagatcgcaccaccgcactccagcctgggtgacagagcaagactctgtctcaaaaaaaaaaaaaaaaaaaaaaaaaaaaaatttctctaatgaatgttcagttacaaatctgagatagatactatcatagaaaactgaaaattactatataatgagaaaataatttagactgggggttaggaaaggcctctttgaggaagtgaagctgtgacttaaaggaagaataggatttatccaggaaaagttttcagcaaattctatggacatcttaaagtaaataaggaacagcttatagtgacactgaattttgtggaacaacaacaaaaacaaatactctactaattttctttaaaaggctttttaaggaaatgttcttattccgtaagtgatgctaagatgcagtaaatcttctatgtcagggcttcttggaccttaatgtgcctacagatttacctgagaatcttgtaagatgtgggctctgatgcagtagctctgggctggggcctgagactcagggaatgcccacattgctctgcagaggaccatgctgaactgaggaaaacaggcagacatttcagaattcttgaattattttgtaaactctctattttcagttcaagcaagtttgctgctgttggatttcataaaactttgacagatgaactggctgccttacaaataactggagtcaaaacaacatgtctgtgtcctaatttcgtaaacactggcttcatcaaaaatccaagtacaaggtaagttgagaaattgagacaaaaggattggtggttgctatgaataccagccattctgtgggttttcctaaatgttttaatcctgaaaacacctgatagttaaagctcttagttcattttgatttcagtttctgcagattgtgggaaaacaggtggaaagccaaaaagagagaaagcaagggagcgtgactaaaaaagtaaatatgaatgacattggtaaacttgctaactcttccttttttcttctcctgagtaatgattcacaggcttaaatatgcatacatgtcaccaggtgtgcttgggaactatgttggggcttcaccctcagatatgttgacttactgggtttggttggggtagggtagtggcagggaagggagcctggaactctacatttaaaaaaggtgattatcataggtgattctgatagagataacccaagaccacatgtgaaaaacacttcccttggaggtaatctagagattagcctccgaaaggagtaccagatcatactctttacttggttaaaaaataaaattataaaggattaatttgaagataatttttaatgttttctctctttagaaatagctttaatgtctttgtaaacatgatgcatacttatttgtttaaattccaatgttaatgaaaaatacaaatcgaaaagtttcttttttaatttccttaaaaccctctattgagtggaaaccactctcaaaattttgataaacatccttctagacttctctgaattttctataactggcgtatgttacacatggggtcctggaagcagcaagtatactgcatacttccctcagcattatgttacagacatctaataaagtacagagcattataataaattgtattgattattgggagcaatagcatctcctagtgatgattttagggttgtttttagtgttctggatttttaacagcaaatcagcaataagcatcctcgggcacacatattttcacttttggataattatctccctcaggtagattcataaagggggattactgggccaaagggtatataacttgtaaaaattcctacatattgccaaactcctctccagaaatgctccactgatttgcactcctacccacagtgcagggagagcaacttactctctacttcttcatcagtctgccttctgtgactcttttaatcaccgccaatccagtacgcgaagaatcatctttgtttttaccctgatgactagctacattcatgttcgcatatgatttttggacattgcacttccttttatgaattgcctattttcatggcatcagctcactttttgctattgagctctagagttgtttttgtttgtttctttgtttgttttttgttttttttgagacagggtttcactctgttgcccaggctggagtgcagtggcgcaatctcggctcactgcaacctccacctcccaggttcaagcgactcttgtgcctcagcctcccgagtatctgagattacaggcacgcacgaccacgcccaactaatttccgtatttttaatagagatggggtttcgccacgttggccaggctgttctcaaactccaggcctcaagtgatccgcccaccttggcctcccaaagtgctgggattacaggcatgagccaccatgcccagctgagctctagagatttttaattaatacataagaaacaattcttcatacatttgagaaacccctttatatatcacatctgttgcatatgttttttttttccccagttgttttttgtttgcttttaagcctattttcatttagttttacattaaaattttcttagggatttttttctcatggactttaggttctgtgaggtgtttagaaaggtctttctcattccaagtttttgaaaatatttacccatattttttctagcatatattttatggttgcatttttcatatttaaatcattgccccacccaaatttattttgatttaagaagtaaggtcacagtatagttttttccaaatagttaatgagttttctgcactatttattaaataatacatcattttcctcactgatattaaattcatattataagttcacatgcttacttggatagacttttggattctcaattttattgtaatgatgagattcaattttgcttggttttgttttgtttttcagacagggtctcatttaggctgaagtgcagtggtgtgatcatggctcactgtaaccttgaactgggctcaagcaaccctccacctcagcctcctgagtaggactacagtgtgtgtgccatcatgcccagctaatttttttttttttttttttttttgagagccaggattttgctgtttgcccaggctggtctcaaattggccttgagcaattctcccacctccacctcacctcccaaagtgccaagattataagcatgagtcattgcatccagccaagattcaatttttaagttttattctgccccctcaaacttccccatatttcccccaattcagctgcctttgttgaaaatgtatttaaaattaatgaaaaatattcagtgtggccacttgaagggttaatttgaaggtaaaattgaagattctaatttttttcctttttttattttttttattttttttgagacaaggattcgctctgtcacccaggctggatgcagtggcacaatcacagctcgctgcagccttgacctcctgggctcaacctattctcccacatcagcctccccagtccctgggaccatacaggcatgtgtccccacacctggctaatttctaaattttttgtagagacagggtctccctatgttgcacaggctgggctcaagggctccttgaactcaattgaactcctgggctcaagtcattctcccaacttcagcctctcaaagtgctgggattacaggcatgagtcaccatgcctggcctaacagttctattttattattattattatttttttagtggagacggagtttcatcatattggtcaggctggtctcgaactcttgacagctgatccacggccgccaggttctattttaaacacacttaatttaagtcatcccacagggaagcagaacagaaagccaacgttagacagaaatttgggagctgtccaaagatctcaagcccccaagaatctatcaaacagtctttaaaatctatttttaatacacaatttttgttagaaaacaaaagtaagagtgtatattttagaggtcaatgtttaaatttatcagtattaaacaagagaaccctaattggagtctgaagagagaagagaagggacagatatgtttttcaggttgggaaatggatctgaggaatgaaagtagtgaggataagcttcactaaaactgaaagcagatgttgaagataaaacttgccagtttcctcaatttctttttcagtatgtggatactaaaataacatatttgagtcaagttttaaagtcatactgtctttcagtagttaaaaacagacatcctattttcaaaagttataattgaattttttaaccttgccccccctacaaggccgcacagagctgaccttaacgtgggctccagcgccctctcctgacaaaacttactagtgccattaattcctacatattgccaaactcctctccagaaatgctgcactgatttgcactctggaggaaaagtgtgaaaagaggctaagatgattctaggctgaatataaacctggctaaggaagggcctaaagattggtcctgacatatgaacctctttgaggctaagctggtactaaagtagaccccaaagatgaagttggttttaatatagaaacttattacttctaattagaagagagaacatgttcctcgttaaatacctgtttacatttcagacaccaaataaaatgtcattttcttaaacctcacaacaatacttttggggagatgttattagtccctcttcagtagatgagagagatctgaggtttagagaaattaaattacaagttatataccctttggcccagtaatccccctttatgaatctacctgagggagataattatccaaaagtgaaaatatgtgtgcccgaggatgcttattgctgatttgctgttaaaaatccagaatactagagggaggagccaagatggccgaataggaacagctccggtctacagctcccagcgtgagcgacgcagaagacggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcggagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgactcctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatgggggaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgttgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaatttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatcgaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaaccggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacactgtgaaggacctcttcaaggagaactacaaaccactgctcaaggaaataaaagaggagacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacaatgatagactggattaagaaaatgtggcatatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggagtggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaaaagaaaaaaaaaaaatccagaatactaaaaacaaccctaaaatcatcactaggagatgctattgctcccaataatcaatacaatttactgtttactataaaggtataatacagcataatctgggtttattggaattaaatgtaaatcaggtgttccaattatttttttaagctcagttatttttgttaaacttgaatttcaacaaatagtttttaaaattttttaaaaatatacatatatatattttttcttttagagacaaggtcttgctttgttccccaggctgatcttgcctcagtgtcccaagtagctgggctataggcgtgagctgccacacccagcttagcacacttttaatctttgccagtatgataggaaaaaaacagtacttccatgttatattaatatgatatttttatcattaaattggccaacaataatattttcattcatttaattatttatgtttgagacagggtctcgctctgtcgcccaggctagagtgcagtggcatgatcccagctaactgcggcctccacctcccagattcaagcgattgtcctgcctcagcctcccaagtagctgggagtacaggtgcgtgccaccatgcccagctaatttttctatttttagtagagatgggggttttgccatgtgggccaggctgatctcaaactcctgacctcaagcgatccgcctgcctcggcctcccaaagtgttgggattacagtcgtgagccaccgcacccggcccatccttttatatttaataaatcctactatctttgctactccattttgattatataaatcagactgcattacacaaatgcttataaaacaggttgaagaaatgcccttctgttcctagtttgttgagtgtttttatcacgaaggaacgttgtatcatgtcaaatgcgtttttgatacctactgagatgatggtgtaggttttttcccttcattttattaaaatggtatatttcactgttttgtgtatggtgagccactttgtattcctgggataatggcatgtagttattttaatataatgctagatttaatttgccaatcttttgttgagaatttttgcatctatattcctaagagatactggtcagtagttttcatgtgatctcttactctgtttttagtatcggggtaattcgggactcagagaatgaattaagaatttcctcctcttctatttttttgggagaatttgaaggattggtgttaattcttttttaaacattgggtagaattcattatgaagccatctagtcctgggctcctctttcctggaagtttcttgattgctgattcaatctcttattaaagatctcagattttctgtttttccttgagtcagttttggtagtttgtgtattcctgagagtttgtatatttcatgtaggtttctaatttgttggcatgcaattgtcctagtattctattataatcttatttatttctgtaaggtcagcaggaatgtccctgctttcattcctggttttagtagtttgagtcttctctctttttgccttggtcagtgtagctaaaggtttgctaattttgtttatctttttaaagaacctattttaagtttcattgattttctctgtagtttttctgtcctctaattcattcatttgtgcttcaatcttttttttctgcttgctttgggtttgtttttattttttgtttctatagtttcttaatgtggaatttcactttactgatttgagatcttcttctttttttaatgcaggcatttgcagctataaatttgcctctgagcactgctttcactgcacctcatgagtctttatttgtttatttatttattttgagataggatctcactctgtcacccaggctggagtgccagttggtgcagtcataactcactgcagcctctacctccctgggctcaagtgatcctcctgcctcagcctcctgagtatctaggactacaggtgcgtgccaccacactcagctaatttttaaaaattgtttgtagagacagggtctcactctgttgtccaggctgatctcaaactcctgggctcaagcaatcttcctgcctcagcctccaaagtgctgggattatgggcttgagccactatgctcacctcatcccataaatcttgatatgttgtgttctcatttatgttcacctcaaagtattttctaatttcttgtggtttctcatttgtctcattgcttatttaggggtactgtttaatttctgtatatttgtgagttttccagttttccttctgttattttctgattttactccattgtagtcagagaacatagtttgtataactttaatcttttaaaacatattgagatttgctttgtggtctgatgtatggtctacctgggagaaaattttccatgtgttcttgagaataatgtgtattctgctgttgttgggatggtgtgaggcatctgttaggtatagttgatttatagtgttattcaagtcttctatttctgctggtcttctgtctagttcttcaatatgttgttgaaagtggaaaataaagtccccggctattattgttgaaactgtcttatgtctccctccctttaattctgacaggttttgcttcatgtataatattttgggatctcttgttagctacacaagcaatttttagttaaatgtttttttcctgaaataaattatctctttccaactaatgatagaaacaatgccgcataacctgaatttattagattaagtgtaattgagtgttctgatcattttgggggcagccaagatttatttctgttgaacatcattttaaaacatctaatttcccatctgtaatatatataacacaatttattttttctctaaaaatttaggagtttgtatgtgtgtgtcacagaaagatattagttttattgactagtaccataaaaagatgttatataagaaaatgcctcatgtaacatttgtctagtgtaactgtataaagtgcttgtatatatacatttccatttaaccgtcatattcccagtggagtgctggtgctggcttatatagtagtactcattcagtgatgtcaggtagatagtttaaaattagttgtcgtgggaatatttacactgtggaaatcaacaaatgctactaaactgagatttttgtcccctagagagccagtggttaaacatttgccactgcaccactgcactatccttatttttcagattaggaaataacaaaaacaaaaacctgagatttaaagagttgaggccaggcacagtggctcacgcctgtaatcccagcactttgggaggccaagacaggcagattacctgagatcaggagttcgagaccagcctggctaacatggtgaaaccccgtctctactaaaaatacaaaaattagccaggcgtggtggcacatgcctgtaatcccagctacttgggaggctgaagcaggagaattgcttgagcctgggagacggaggttgcagtgagctgagatcgtgccactgcactccagcctgggcgacagagcgagactctgtctcaaaaaaaaaaaaaaaaaagagttgaaatgttttccccaaaattactcattacttaagtggttaaagtaggtcatcaaatacaatccttcagacgaaaatactccttccccctcagtatttctctaccccaacatgcaccctcctttcccaccccagcagattggcttgaagtgtttttggatagtttctacaaaatccattaagaacatttgtttaatgggatttgtaactctcgttaactttagcgtattgggaaaaaaaatgtttccacatactgacattttaatgattaagatactattttgctaagaaattgagttttttctgaaagccttttcttttggcttttaaaattatgatattgaacagtcattgtatttcaataagaagttatctgacaggggctaaaaaccttaggtaaagaaatcgggtacactagaaaagtttggtgaatgcagcaccgcttgataggtaggttagcaaggccacagtgtggatgagagagtgctctatttacacaggtgtctataagctttcattgagcttgagaatattgaagtctggtagcaatgtgctacaaaatgaatttccctctaaatgcttttcaaggcatagcatccttcagtttctggattcatcctccttgatacccctgcctgtttatgctgcaagcttccgttgcctttgattttttgcttccattaggccaaaagccatcgatttcattattacatttcctctcctatcaaatctccaagattttcatatgtaatactattgcttcaaggtcccatggtgaacacaatattctaataaatgaatgaactgtgctgagaattaaagcttatatatttttaagctctactctccttcatggatccaataatcatgctcacttttaaatacaatattatacttctcaattgtcccagttttacttcaaaatatattttttttctgaatgaattattctttatttatttctaaagaatttcatccagttttgtttttgtttttgtttttttgagacgagatctcaccatcttgcctaggctggtttccaactcctgggctcaagtgatcctcccgcctaaccctcccaaattgctaagattacaggcgtgagtcactctgcctggcacatccagtactttttgcctcacttcttttttttttttttttttgcagcgaagtttcactttgttgcccaggctggggtgcagtggcacgatcttgggtcactacaatctctgcctcctgggttctagtgattctcctgcctcagcctctcgagtagctggaattacaggtgcctgccatcatgcctggctaattttgtatttttagtagagatggggtttcatcatgttggccaggctggtctcagactcctgacctcaagtgatctgcttgcctcggcctcccaaagtcctgggattacaggcattgagcaccacgcctggtgtctcacttcttttaactagacacacacattaaaaataagcctccccaaaatgttagccacccaaatagtttagtggcatggcaaatttcatgagtacatttaattatgtatcattttttctaagtcattaataaaatgttaaaaagtctcagtactaactcttgtgcagctcctctctaattgcacttctgtaactgatttttttaagccacttatctatctatttatttatttagagacagggtctagctctgttgtccaggctggaatgcagtggaacagtcatgacccactgcagcctcagcctcccaggctcaaaggatcctctagcctcagcctcctgagtagctagcactacaagagtgcaccaccactcttgcctaattttcttttgtatttctttgtagagacaggattttgccatgatggctaggctgatctcgaagtcctgggctcaagcgctccacccgcctcagcctcccaaagtgctgggattacggggatacaggcctgaaccgtcacacccagcctaaaacccactttttgggggccacctgctagtctgtggtacatatacttgagtgattacacaacaaagatgtaacatggaactaagtaacaaagccaaaacctaattgcagtggctcctgcctgcaatcccggcactttgggaggccgaggctggcggatcacttgagtccaggagttcaagaccagcctgggcaatatggtgaaaccctatctctactaaaaatacaaaaaatagcctggagtggtggcgtacatctgtagtcccagctacttgaggggccaaggcaggaaaatcgcttgaacccagtaggtggaggttgcagtgagccaagatctcaccactgcactccagcctgggtgacagagtgagaccctgcctcaaaaaaacaaacaaaccaaaaaaaacaacaacaaccaaaaaaaccaaagacctaataaatataagcatatcatgtggagatgaagggcctaaaggtgggcacgtacctgtcatattctaattcctctgatgctttaggaattgttcactaaggagactgagtatataataaaacttgtataatagtatctgatttttttcccgagactgcttaaagtttaaaagtaaagttgtcagacctaatctagctcaattatatttgaatcttagttacttctataattcttatttgtggaataggaattataatattgccttcataaagttattgtcaaacgtcaatggaataacctatgtagaaggtttagcacagtgtgtggtacacgataagcactaagtgaatgattgttattattattatcaatggtaaagtagctaccatttctgagcacctatactaggctagacactacaaatcagttatgttatggtgtctgtaccatactaaagctgttggttagcaccaaactaaagctgaagcctcggtgaagtattttgtttctgaagactgactctgatttcagtttgggacccactctggaacctgaggaagtggtaaacaggctgatgcatgggattctgactgagcagaagatgatttttattccatcttctatagcttttttaacaacattggaaaggtaagtgacagttaagaaaccttagaaatgaaaggtaaaataacaattatctattgcattttttactgacatttaaatcaggcagttgataaagtacagttaaatggaattgacttaataaaaataacaggctcaataacattgaggcaagattgatacagctcttgggtaaatgaaccgagtaatttccacacatttttactttttgtaaagaaagaaatttgtatatttctgcaagtcttgtcttataaatgaatgactctgaagaaggatagtttttaagcatctttacataatggaatcatagaacaatgatattaaaggagaccagagttaggttttaggtatttatttaaagatacaacagataatcattgagcttttgttttgtgcaaaatcatactgaagtatatgaattgctaaatttttttttataattttagaaatccttgagtcttgcttcttccaatgtggttcttggactacacacattacctgggagtttgttagaaatacagactctcctgatctcttgagtcagaatttgcatttcaataagttctcctagatgatttgtacgcatattaaaatttgagaagcatttctttggagcagtagctctcaactttggtgcacactggaattcacctgggaagtttaaaaaatgctgctgcctgagaccaactcccccaaattctgattgacttggtttggagtgtggcctgggctttgagagatacaataactttctaggtgattcaattatccagccaagattggaaaccactagtttcacgaatgtctcatcataacacactgcttcattcctcatctgggaaagctgtgtggcaatgaggctggccacataaggaggggaaaggggagaggtgccttaggacagctgggagaaaaagcctcttgctgcctgtcctagactgggcttctccaagtcagtgggatatcaggatcacttgggaagtctatttaaaaatagatcccttgatctcacttctaaagattttaacatggatgtttgagttggaccggaaatctgtattttaataggcaactgccacagacagtggtccagagattatattttgagaattactgatgcgaagagcaaaaaactcaagaaatgaaaagcatgacatatgttaggctttcttgccccttctgctaaaaactatgatgaacatgccttggaggtttagatagtaaagctcagggatctctttggtgagtagacgagttaaagcctgtgatgtttctggcattgtacttgtcatgttacgtaagtatgcactcagtgatcgcagccccttagaatataaacctatagaagaaggaattttgcctagttttcatcactgtatgctctgcattttgaagagtgactgacacattagaggcaccaaaatgtttgttgattgaataaattaattctagtttctagacctttaaacataaagactcaaagtttgtgctctggagttgaatgaagctgtgtttgtgtgacttgcttgcaacatgaacatggattagttttttaacttatctgaagttcagtttctttatctgtaacatggagaaaacaattggactttatagggctgagacgaataaagaaaataatgctcttaaagtactcagggctgggcacggtggctcacgcctgtaatcccagcactttgagaggctgaggcaggaggattgcttgaggtcaagagttcaagacaagcctgggcaacataataagaccttgtctctactagaaatcaaaaacattagccaggcgtgttggaacacacctgtagtaccagctactcaggaggctgaagtgggagaattgcttgagctcagaaagttgaggctgcagtgagccatgatcatgccactgcactccatcttgagcaacagagcaagaccctacctcaaaaataaataaataaaataaaaagtactcagtacattgtaagtactcaataaatgttatatgccactgttattataactactactattattattatcattgccctaattcttgttatgaggtcacattggtgtcatatttccaaaccctcttttcatgccatctaggcagatttctgtatattattatgttgatttacatattctgttttgttttctcccagacccactggaatgtgacaactccctaaatattctaagtgtagtgtctggagaaaagagatgagacctgctagtgtccgtcactgttcaagacattttttgggggggtgctgtgggggacggagtctcgctctgtcgcccaggctggagcgcaatggcatgatctgggctcactgcaacctccacctcccaggttcaagcaattcttctgccttagcctcctgaatagctgggactataggcacccgccaccatgcctggctaattttttgtatttttagtagagacagggtttcaccgtgttagccaggatgatctcggtctcctgacctcgtgatccacccgcctctgcctcccaaagtgctgggattacaggcgtgagccaccacgccaggccaagacattttatttaatatagtaacacattgattccacaaaagaacactgagggatagatgttaatttttccatttacacgtgaggaatttaaactgaaaggtgaaataattggttcagcattatgctcaaaaccaaagcgttgtctgcatttttatttagcagttctacttccgcagtctcttagtggaacattttaataatattctgcattataaagtacaaaattagttcctattctcatttcctttttaatgtcgggtttctttttgtaaagtctttagtatctcaactcttcagttcttacacctcctccctcagatcttttgtttcaaaaactgactacttcaggttattctactgtaaagaaggctaagccttcttttccatttgaaaaggaaatagatttaatgggaaagaatatatagtagtgactcagatttaagatgcttaatcttatttaacatgaacatgactatacatgataacttaaaagtatttctaaagagggtattctacaaatgcacttaatattaattttctaattatttgcatatatctttcttttaggatccttcctgagcgtttcctggcagttttaaaacaaaaaatcagtgttaagtttgatgcagttattggatataaaatgaaagcgcaataagcacctagttttctgaaaactgatttaccaggtttaggttgatgtcatctaatagtgccagaattttaatgtttgaacttctgttttttctaattatccccatttcttcaatatcatttttgaggctttggcagtcttcatttactaccacttgttctttagccaaaagctgattacatatgatataaacagagaaatacctttagaggtgactttaaggaaaatgaagaaaaagaaccaaaatgactttattaaaataatttccaagattatttgtggctcacctgaaggctttgcaaaatttgtaccataaccgtttatttaacatatatttttatttttgattgcacttaaattttgtataatttgtgtttctttttctgttctacataaaatcagaaacttcaagctctctaaataaaatgaaggactatatctagtggtatttcacaatgaatatcatgaactctcaatgggtaggtttcatcctacccattgccactctgtttcctgagagatacctcacattccaatgccaaacatttctgcacagggaagctagaggtggatacacgtgttgcaagtataaaagcatcactgggatttaaggagaattgagagaatgtacccacaaatggcagcaataataaatggatcacactt

SEQ ID NO: 38266 - DNA, 56227 bp, Homo sapiens
gagcgaaggtttttgctgcgccaacgcagtgaccgaaggctccgctcacgcccgggtaagaggcatccgcggccgatctttggccctgggccagcggagggagactgggcggggacagcgaccaccactgaggctgtttgttagcttaactcggtttccgcagctgggactccgcagacccggtgcgccgcgccccaaactttgcttcctcaactccggacacctgcagctcttgctgcccttgtctggaacccgggtcttgggactcttgcttccttctcagagtgtcagagcctcagggccgcggagaggccaacccgcgaggggtgcttaaaaaccgaagtatccgtggtcttggtgtgtggacgtttctggcgccttccacctgttgactgtcactcggcaccgtcctggagcgggagtgggtgctcggcgtccgggggccagggattgacacagtcatccaccgacactgcgcgtgggacagagggggcgctcgaggggtcggctgcagctgaaacctgaaggggagaggatttagggcacctgctgaacaggaattggtggaaagggagaaggggtcttctggtggaatctgggctcatttcctttcctcttcatctgtctcttttatttatcaaaattccaacctggctttttgctcaaagacgctgaacagagcccctggctttgcctgcgctgcccattgctataatgcagggctctgttccatttttgtgctgtgcacccctttggcatttctgggaaggctaaagactctcagaacaatacttttttttgagacagagtcttgctctgtcgcccaagctggagtgcagtggcgcgatctcggctcactgccacctccacctcccgggttcaagcgattctcctgcctcagcctgccgagtaactgggattacaggcgcagcacacctggctaattttagtatttgtagtagaggcgggtttcaccatgttgcccagctggtctcgaactcctggcctcaaatgatccgcacacttcggccttccaaagtgctgggattacacgagtgagccaccgcgctggaccagaacaatgcttttttaaaggtataaaacaaaaggaagagtattataaaggaaaccaattgcaaaacacatgtcaaaacattaaaagaatttatgatatggtaatatatatgtctttaaaaaacgaatgcgttatttaataacaaggttattaaataacaagatctagcagtggattaaatagttaccataattttgaagtagtaaagaacataaacaattatttcaagatataggtaatacttgtaatataagaaaatatctgtaatttctttcttcttttttttttttttttgagacggagtctcactctgtcaccaggctggagtgcagtggcgcgatctcggttcaatgcaacctccgcctgctgggttcaagtgattctcctgcctcagcctcccgagtagatgggactacaggtgtgtgccaccacacccagctaatttttgtatttttagtagagacaggatttcaccatattgtccaggatggtctcgatctcttgaccttgtgatacgcccaccttggactcccaaagttctgggattacaggcatgagccactgcgcacggccaatatctgtgatttctattggtgacaaagtcttagtattgccaatactgctgtggtttgttggctacatacataattgaagtaaatgttaaatttcagttagatactagagaaataaaagatgtaaatattaaatatccgtaaaaataaagatgtaaaatacttttccatctaagtttttgggtccaggttaagatcctctgatagtagaaagggcactgacccaatgacttggcttctgggcttgacacttccattgacatttccaaggcccattgtaaccttggcttttttttttttttgagacatggtcttgctgtgtcgcctaagctggagtacagtgaggtgatctctgctcactgcaacctcctcgcaggttcgagtgattcgcctgcctcagcatccctagtagctgggattacaccagccacccaccaccacacctggctaatttttgtattttttggtagagacagggtttcaccatattggctaggctggtcttgaactgctgacctcaagtgatctgcccttgtctgcttcccaaagcaaccaccacacccagcttaactttggcttttgaatttcttttcgcctcagcttcttcattgtacagtggagataataacaccttcccaagtatttaaggcacccagcactgcacttagtgtagagggctgaagtagataccatttatcagaacttatttgtatccctcccaagcttatggccttatatccccaagcctggggaggtactcattatttattgaatgaataagtgggtcagaaagggttgcttgtgactaagtccaaaaaacaaaattcattaaggagacagctggtggtttgggaaatgactttgtttaaatttggggctttttttctggctggaaaaatatataaacacatttggaacgggggtgtttgaaatgtcagtcagggcccagggtctgtgtgtgcgtgtctgtgtggctggtgttctgccagtgaaaatgaaactgaatgttgaaaggaaaccggattcctttgcagaacagtttctcctccatgttgcctgtgtctagctttgttaatccgatgtgttgtaacacaggaaatgtcttataaagaatggagacggacccatgacaaggcatttctgggcatagatgtacttttttcttctcctttcacgtttccctgctccactatctactatataactcctctttgactctgaagacttggtaaataggagcagtttggatagcttatggaaagctgcccagacctggctggaagccaactagttgcttcttaatcccagccttaaaaatctttgtaatccccagatgtaggtggtaataataataaagaaaagtagatctagccaaccatccctgtgatttacattgagaaagtgctaaattgggacaggaggtagagaactttgtggaaaaaaacaaaacagaacaaaaaaaccctcggaaatttagaacacactgggactatctatgtctgtaactttgggaagggcaaatactggtgttatggactcaccaaattcatatattgaaaccctagcccccaggatcttagaatgtgactgtattaggagatagtgccttagttagaagtggtggtgagcacctgtagccccagctacttgggaggctgaggtgggagaactgcttgagctcagaagttcgaggctagcctgagcaacatagcaagaccttgtctcaataaaagaataattagccaggcacggtggctcacgcctgtaatcccagcactttgggaggccgaggtaagcagatcgcttgaggctgggagtttgaggccagcctggccaacatagaggaaccccgtctctactaaaaattcaaaatattagctgggtggggtagtgtgcacctgtaattccaactactcagggggctgaggcatgagacttgcttgaaccggagaggaggaagttgcattgagccaagattatcatgccactgcattctagcctgcgcaacagagcaagactctgtctcaaaaaaagaaagaaagaaaaaaaaaaaaggaaaattaagttaggtcattaaggtggagccctaatccaatatgaatagtatccttataagaagatgactcgtcaggagcacatgtgcacagagaaaaggccacgcaaaggcacactgagaaggtggccatctgcaaaccagggagagagatcccaggagaaaccagtctcatcagcactgaggtcttggactttcaatctccagaactttgagaaaataaatttctgttctctagacttcatctagtctatagtgttttgttatggcagccctagaaaattaatacaactggttctaccaaatggacaataggtttaaaaaaaatggctacaactaggcaccatctcttttaagtcatgatcccgacatgtccatcacttgctcttaggatctcttacccaacctatgcagaagagtctcccatgtactttccttctacagacaccctgtgtggtccctaggatcttgcctgaagttgttaaagccatattcagcttcatgattttgactgttaggaaaagaaaaacttggcctcttcagcaagtgacctaggttagctgttgtgccatgtacatagtaagtactttgtaaatgtatggtgggtgatgggtgatgatgttatgatcatccttaaataccatggggtgactcccttctgatcataatgaatctccatgttttggccctagcccagccctcagggaactttcatgccacctagctgggaaccagcagctctggccctagctacatgaatggagagaaaatggctatgtctgtatcctggtaccaattcctgacttctgggagggagggctgcttctggaagtggggattgtggtgatttcactctatgataactttcttatatctttggctatttgttctaaggtagcccatgatgtctccataggaaaatgatgtgttttaacaaccaccatgtttggagtatagattgtgagagctcttcaagacagtgctgggtctagtaaatgtggttttgtgtttctgtgagcacataaatgatgcttgagatggatgaggggccatctgagtttggaggaaaatcatgagcctttcaaggtctaggtgatcaaatctaagcttgttttgaatcattgagtaagaaaggtctttaatggcaactagacacctccacttattttacactcagggaaatggactcaaaatggtaaatgactatctcatggtcttacaatctccatttcctcacttataaaatgggaataataattcccacctctctggtttttgtgagtaattacgtaaagtgcatagcacaatgcctgtcacatatcaacacttccacaaatgatttggggacttgcggggagagattgagaggaatggtttccattctaattatgttccagacctgcttattaaagccttgttattctttgccacaaaaattcacatctctgatcaatctaaggagttattagaacaagcgtccccatttgaaagcctgcttgtgaacttccattttccttttctcatttagaggatagcaaagttttagagaagcaggggacctttgatgccacccaatctgatcctttattccattgatgaagaaagcatggcccaaaatgggtcaggaagagctgtacctagcactccctggactgtggtcctgggtctcttgactcttgatatgccctcagacaaagcttcaccaggaacgggtcattgtcatctagctggacacagaagagacgtgagctgtctacacctcattctgtctcaactattaaaggattgagtttagagtctctccaactatgtccaaatagcaaatgtataccttgaaattaaagagtgttttctcattatggtaagacctcacacactggattccaaggaatgatatacttgaatgaaatggccagtcccgtttacagtgaactccttgcatgtgagactctgagtggaaatcccaatgctcctgaggctgatgagtaattttaatgtggtcatttaacaaactcaggaaaacaagttcatccctgttgtgtgactgggagtacactgattccacctcaggcttctttttccagtgagtcatgtcctacagtctgcagatgggcacacacaggcatatacagactagaaaggaaacctgaaaattacctgaccagaggccaactatgagtggtggggttgaaggggagctaagtcgtgcttctttatgtactagaatgtgagaagtcaggctcccactggctacagcaagcagaaaaacaaggtgttctttcattttttttccccctatataattcagtcaaaactcttaactttcatttgaaataatccaattgactgacatattttttctttcctggaatctgaatgcaagcattttccttatgtaaatataatttgtgttttctgcttagcaattgtattggtttggtgaaattgtcagttctcttgttacaatgcattctctgattgtaaaataaggataggtcaggataatttgtaggaaatttctcaggagcaaagggagccactgtttcattgtaaagtcctcattagcaactcttaatcagtaactctgcaaagaaaattcctacagttttgcccctgaagagtgagggaactaaagaaccccagtgcagctcccagtccttgaatcatcagagagctatatagattgttcctatttccccagtgactcagtcctggcccactactggtgtacttgcttcacagcttaatatttaaacaaatgtttggatttataacagctccagagggagagtttcaacatggccctgcagggctaagtgaagattgctccattttctttatttgttaacagtatagtaatccagttcctgaacacacaaggcaagaatagcactgccattactcaagcagaggtgtgccaagaggaagagcacagctgctatcctttctcggaacaacactcattcagttttcaaggggggtgctttccttctccctcacagtgccttggacctttactccactttgagtaattctagtattgctgctcacatcctgtcttcattatattcacctgaacaagtggatataatgtcatcgttcacattcttccttcttctttatcccctatagctgattgtcgcaaaaatgtcaatgtgtgtctcacattcacacccctcatctctgttcccattcagaccccaccctcactgtgcctgaatttctgaaacagccgcttaatggatcttcatattcctggtctttcctgttataacagacagactcttcttacccatcactggctgtgcagtgcctagcacaatccctggcatttagtaaacaatcaaaaatgctgaactcaactgaattgctccagttcatcctctcagcttcccctggggactctttataaatccagttttattaagaccttccaagggctctcactgccattagcagtaaccacaggctgaaatgcacaccagggctgagcaggtaacaaatgaacaacataggctgagtggggctggagtgaactgaaaccttgtgcatggtggagaagaccaatgactgctcagctccagccaagagtttccatgtgagaatgtgggcttagtgttagaggccaagaatctggaatattttttgtcgagatctccaaattttttaatgttgatgactaattcaaaattcaagaaaagcactgtgagccaagcaaaacacagctctggcctgcacttggcctgcaggttgctgctttgtgactcctagatcaaattgccattgtctgggaataagctctcagacctaaactttagtaacacatgcctatccaatctcatttctccctcttcccagagcgctagactgccctcctttatatccaccgttaggagattctcattgcaagtgattctcctttcaaaatcttgaacccaactgtccaaaagtagcccgaacaggtccctgacataacttccctttttctgctcacataattcctttttcttcagctgtctagatgtcaactttgacttttttttttcttccagaagcctttcccacgtcttccgaaattattctctcttcccagcctctatcttatctgaatctttgtttgcatttctaatgctaacacctaattcaggagcttatcgctcacacctggaccactccaatagtctcctaactgatttgtcaaaattagcccatgtgaaactggttttgtttctcctccaacaggagggttaatttgttccaacaccagaagattctcttactcaaagctgcccctttgtgcgatcactttccagaactttgttttcccatgtaaagcctcaatgccctagctaaaagagtgggagggggtcaggcctggagaaattgctgtctctcagcttgcatccttacatacagtgggcgctcaatgaatacttgtggacacattcttttttctttttgagatggagtcttgctctgtcacccaggctggagtgtagtggtgcgatctcggctcactgcagcctccgcctcccaggttcaagcaattcttctgcttcagtctcccaagtagctgggactacaggtgcgtgccaccacgcccagctaattttttgtatttttaatacagatagggtttcactgtgttagccaggatggtctcaatctcctgacctcatgatccgcctgcctcagcctcccaaagtgttgggattacaggcgtgagccaccatgcctggcctggaaacattcttaaacagcagcagaattgtgaccatgcgaatttcatgtaagtctatttcacaaagatacacttacatatttagcatagctaaatgtaagtaatttaatcgtatatcatttgcgcaggtaaaaattctcctaataaaaattcagcttagattatctttcctgattttcagttctgcaaacttagcccctgtgtgattgagacaaattcagtgtaggtataaacctgaatttgcacatagacttatatgctgcagaaaacttgtttctcaccttcttttctgagcacttctggctgatgccctcctttatcaaggttaaatggataaaatagatgtgaagatttttcttggtggagaagatatcttaagtttcaatagaatggaggatagtatatgacaaaggaaaggaaggccacgtgctgcttcttctagagcggttactgccttaaaaactcaaactgtagctatgttatttagttgcaaaaatttataaaaatttagctcaatcacccacaaattgtaacattcttcggtactatgtaattaaattgcattttagagacggcatagagacggcgtattttttttttctcctttttgagacggagtcttgctctgttgtgcccaggctggagtgcagtgacgcgatctcggctcactgcaacctctgcctcccaggttcaagcgtttctcctgcctcagcctcctgagtagctgggattacaggcacccgccatcatgcctggctaatttttgtatttttcagagacagggtttcaccatgttggccaggctggtcttaaactcctgacctcaagtgatccacctgcctcggccttctaaagtgctgggattacaggcatgagccaccgcgcctggcttttaagatgccgcctgacagtttagtggatatgtgaggagaagaagccgagcaaaaatgtgttaaacatgtaaaagcttccatctgactgaatagttggcacatgcattttaatctagatgtattacaacgtacctgggatttgttttaatcaagtatggtgaggccaacagatcaggaggtgactgccatgaaggaagaagctcttactcacagttccctagaaacaggaggcataacacctcacatggggccatatgggaaagcacctgcgtaggtgaaggggcagaaaaagtgaggggaaagaacaggcaaaagactgtattgtgaggcaggggaaagggctggctaggtttgggattggctagtttgaataattttagagtgctccaggattcatgagctgcctatagttgtagttgtctgatgcctggccctggaataataagggcaggggaaaattgcctcttgcagggttaaagccaaatagaggaggtggttcagaatatggctctggattgattggtttacatatcaaaggtgtggtcataggcaagccaggcaagccatttaccatctctcagagttagctagtcctgggaggggcagtctctgggattagcaagaccccaaaatgtcaaaccataaaaaaatacagacaatgaaaaacagaattaatacagcaggattcagaatattgacaggaaggggaaacagtcagttgccttcctggtttcatgaagtatctaatgcagtgccattgatatgtgctgtaaatattactggacacgttacttgcatgtattttggattaagaggagattatgctaaggatctcatttatgggctaatgtttggcattttcttggcaaccaaagtcatgctaatcaggtgacagtaacaatttcctttttaaggtatttccagatttagacccgccttcttagagtttaagtcagagggtgtgatggttaattttatgttccagtttgactggactatggggtgcctagaaatttggtcaaacggtattctgggtgtgcctgtgagggggtttctggatgagagtaacatttgaatgggtagattgagcaaaacagattgtcttccccaatgtgggttggccttacgcaatcagctgaaagcctcagtagaacaaaaaggcgaacactcccgtgaatgagagacaatcagccctgcctgcctgagtgtcttggagctgggatatcggatgttcttctgtgttgagagtcaactgaaacatggcttgtcctgtgtcttgagctggccttgagactgaaactgtaccataggctctcccgggtcttcagcctgctgactacagaattgggacttagcttctataatcttgtgagccagtttccaggaatgtccttcatgtaatagggaaatgatgatgtttgctttggttgcctccctcattcctttcacctcctccagttaaatcttgttttgaccctttattggctgtgggtgcagggagttttcccatgttccaggaggcagccagcttgtaactagcaagcattgctatgtttgtatttctgatacattttctaaaagagatcgcagaacaaagggtcctgactcaccaaggatacaggtatttgttgtgatttactttctcattcaaaatacatattggatattgtatctaattttgtattggtaattttgggttatgaaaccccagatttgaagccccaaattgtatagggttcaatgcccataaaacccagatctgcccctgcttagaggccggcccctctaggagacagcatgtggggccacccagagatgcaggactcttctgttctgccctatcgcagcagagaggccatccctggagctggaaggtgcagactgggaattgctccttctctgaattgctagctcctgctaatgcctgcattgctgctgcaaaggatattcagaaaaagttgctcgtcagaaaaagaattcatgctagctctggccctgctgctgatgcattgtgtgaaacccttgagtgacttcacctcttggaactcagttttcccatttgtaaagtgatatcaatacttccggtgtgggctcaggtttgggccctgtgaattgtaaagctctatgcacatgggaggatgtatgattataagttgtgttgctattacttgtattgctaatatcttgctattattgaaatatgcccaaaccttaacatttcagtgactaaagagcaaaaccagtgttcactctgacatagtttttttaaatttttcattcattcactcattttaagtttttattgtgtaaactttcatcaaacatgtacaaaaatagactgccacaaggaatgcccatatatatccatccactgatttcaaattattgccaactcatggcccattttgtttcatctacacccctacccacttacacctcctaaaatattttcaagcaaattccgagtcatttcaactataagaatctcggtgtatatttctgaaagataaagactcctaaaaaattaaatcagtactattattgtaccttgcccttctctgccaaaaaaacttaatttctttcttttcagtttatttagtaagctaaaatttagtaacagggaggccgaggctggtggatcaactgaggtcaggagttcgacaccagcttggccaacatggtgaaactcagtctctattaaaaatatataaattagctgggtgttgtggtgggcgcctgtaatcccagctactcaggaggctgagacaggagaatcgcttgaatccgggaggaggaggttgcagtgagccgagatcatgccaccgcactccagtctgggcaacagagtgaaactctgttagaaaaaaacaaaacaaaacaaaacatatattcactctcacctcccacctcactccatgggattcaaccaagctactttaacttttttttttttttttgagacagggtctttgtctgtggcccaggcaggagtgcagtgaggcagtctccactcactgcaacctcctcttcctgggttcaagtgattctcctgcctcagcctccctagtagctgggattatagaagcacaccaccacgcttggctaaattttgtacttttagtagagatggggtttcgccctgttgcccaggctggtctcgaactcctgagctcaagcagtgcgcccgccttggcctcccaaagtgctgggattattttattttcattcaaatttaaagtagcttgggccaggcccggtggctcaggccggtaaatcgcagcactttgggaggccaaggcgggtggatctcttgaggccaggagtttgagaccaacctggccaacatggcaaaatcccgcctctactaaaagtagaaaaattagctgggcgtggttgtgggtgcctgtaatcccagctactcgggagacttgaagcacaagaatcgcttaagcccaggaggcggaggctgcagtgagtggagatcatgctgctgcactccagcctgggcgacaagtgacagagcaagactgtctcaaaaacaaaataaaataaaataatttcagccaacaggcatttttcctgaattattagatagtttgaattaagttctgttgcttagtcatgtgaccttaggcaagttctctatctctactcaaaccctcaattttatcatctgtaaaatggggattttatttataaggttatgaggagtctttgagacagcacaagtacaactggtaaacaataaatgttagttattatttcaatgatagttttttgtttttttgtttttttgttttttttttgagacggaatcttgcgccaccgtcaccaggctggagtgcagtggcacgatcttggctcactgcaacctccgccttctgggttcaagcgattctcatgcttcagccttcccagtagctgggataacaggcatgtgccaccatacccagctaatttttgtatttttaggagagacggggtttcaccatattggccaggatggtctccatctcctgacctcgtgatccgcccaccttggcctcgcaaagtgctgggattacaggcgtgagccaccacacccagccagaatagattattttcctaccaaatcctgtcttctggatttgaaataagaaaatatttggttaagaggtgtaaataactgataatagcattagggctgacttaattaattaaatacgcccagaaagcccaagtgggaggatttagttgaggaggaggaggagttttccaacagtccctccacctgggcaccaggtgtaagcctgacctgtgccgtgtacacagtgctcattcgtgccctgagacaggaagctacagagatccagaccaacagctcacagtaagcttgggccaggtctggcgggaagaacagagtaggcaacaagagctggacactgtttaatgattagactgttttcctctttgattttggaagtgttctacaaaggtgatctgttaaaggttggccctgtggttattgaaacccaaagcagagtgggcccagcctggcctaggcttgagaggaaacaattgtaaatcaaagacccactgtgtcctcaaaagcaaaaatagctgaagggttgatgacaatccttggcttggtgaatctttcattaagaatgctctgagtaattcttgcttagccagcagctctgtttgaactctgccaggtgccctggctgctcacaaaccatgtcatgtgacataagattaggaagcttttgacacaggcagtctgtattgcttgtccaggaagggctgtagtggaaaggtatgaagtcccaaagacttgtccagaccaggtctggaactaggggccagtgatggaagtaggggatgcccagtccgctgtcttatctttcaatcaacagggactttacttctccagttagactgcagtcatatcaaagcattcattcccatcctttgaaggagggacacaatcaatttagaatagaggaattttaatctaacttaaaagcataatactatttgattataaaatatattgcatgtgccatttggtaaatgaaagttaaatttaccttatttattgatgtttttctttttcttttttttgagacagagtcttgctctgttgcccaggctggagtgcagtggtgcaatcttggctcactgcaacctccgcctccctggctcaagcaattgattctcctgcctcagcctcctgagtagctgggattacaggcacctgcctccatgcccagctaattttttttgtatttttggtagagacagggtttcaccatgttggccaggctagtctcaaactcctggcctgaggtgatctacctgacttggcctaccaaagtgctggaattacaggcgtgagccactgtgcctggcctcattttttaagaattgctggggtaaggggaaatgagaaggtgggatatgggcaatgctttttgttgttgttgtttttgtgtgtgtttttttgagacagtcttcctgtcacccaggctggcgtgacctcagctcactgcaacctctgcctcccgggttcaagtgggggtcctgcctcaggctcccaagtacctgggattacagttatgtgccaccacagcccgctaatttttgtatttttagtagagatgcggtttcaccatgttggccaggctggtctttaactcatgacctcaagtgatccatctgcctcagcctcccaaagtgctgggattacaggcacgagccactgtgcctgacttttttttaagcctttgcaatgtggtctggctctgtcgcccaggctagagtgcaatggcatgatcttgactcattgccacctccacttcctgggctgaaaccgtcctcctactgtgtccggaattggtgggttcttggtctgactgacttcaagaatcaccctgtggaccctcgtggggagtgttacagttcttaaaggcggcgtgtccggagtttgttccttctaacgttcgaatgtgtttggagtttctttcttccttctggtgggttcgtggtctccctggctcaggagtgaagctgcagaccttcacagtgagtgttacagcacataagggtaatgccagtgtggactcaaagagcgagcaacagcaagatttatggcaaagagcaaaagaagaaagcatccacaacacgaaagaggaccagaaaggactgccaccgctcgctcgggcagcctgcttttattcccttatctggccccacccacatcctgctgattggtccattttacagagagctgattggtctgtttttatagagagctgattggtccgttttgacagggtgctgattggtgtgtttacaaaccttgagctagacacagagtgctgattggtgtatttacaaaccttgagctagacacagagtgctgattggtgtatctacaatcccttagctagacataaaggttctccaagtccccaccagattagctagacactgggtactgattggtgcctttacaaaccttgaactagacgtaaaagttctccaagtccccacctgactcaggagcccagctggcttcacctagtggatcccgtgccagagccgaggcggagctgcccccgggtcccgcaccgcgcacctgcactcctcagcccttgggcggtcaatgggacagggcatcacagagcagggggcggcgcccatcagggaggctcacccgtgtgggagcccaccgctggggggctggggcatggcgggctgcaggtcccaagccctgccctgtggggaggcagctgaggcctggagaagaattcaagcgcagcacctgcgggccggcactgctgggggacctggtgcaccctccgcagctgctggcccgtgctaagcccctcactgcccgggcctgtggcaccagcctgccactccaagtgcggggcctgctgagcccacgcccacccagaactcgtgctggcccgcgagcgtcgctggcagccccggttcccgcccgcgcctctccctccacacctccctgcaagcagagggagctggctctggcccctgccagcccatagaggggcccccacagcgcagtggcggcctgaagggctccttgagcatggccagagcggatgccaagtccgaggaggtgctgagagcgagtgagggctgcgagggctgccagcacgctgtcacctctcactacctcagcctccaaggtagctgggactacaggcatgtgccactatgcccgtctaatttctttttttttgtatttttggtagagatggggttttggcatcttggctatggctggtctcaaactcctggcctcaagcaatcctcccacctgggcctcccaaagtgctaggattacaggcatgagccaccgtacccggccttgatttttaagtgtatttcatcttgtaagaatgtagagatgaagtggctgcattctcctgtatcattggtagttaattcttcttcttcttctccttctcctccttctccttcttcttcttcttctttcttttttttaaaaacagactctcactctgttgcccaggctggagtgcagtggcatgatctcagctcactgcaaccccccgcctcctgggttcaagcaattcttgtgcctcagcctcccaagcgtgtgccaccacgcctggctaatttttgtatttttagtagacagggggttttgatatgttggccaggctagtctcaaattcctgacctcaagtgatctgcccaccttggcctcctgaggtgctgggattacaggcgtgagccaccacgtccggccggtagttaattcttatttcttaaaaaagctgtatgtttcaggctatcttctgaggagactaagaaatcatatcagatttatgctccttgttgacagaagttttcagttttctatttcttctctgctgactttagggtccagtttgatcttccattgagtgattgattgattgattgattgagacagagtcccactctgttgcccaggctggagtgcaggggtgtgatctcagctcacagccaccaccacctcccaggttgaagcaattcttgtgcctcagctttcacagtagctgggattacatgcacggggtaccacgccggcaggtccggctacttttttctagtttttgtagagaccaggtttcaccatgttggccaggctgttctgaaactcctgatcttaagtaagtgacccgcccacctcagcctccctaaagttttggtattacaggcgtgagcctccttttttttttttttttttttttttttgccttctcgttaagattgtgtggctggccgggcacggtggctcacacctgtaatcccagcattgtgggaggccgaggcaggtggatcacttgaggtcaggagttcaagaccagtctggccaacgtggtgaaaccccatttctactaataatacaaacttaggtaggtgtggtggcaggcacctgtaatcccagctactcgtgggggccggagacaggaaaattgcttgaacctgggaggtggaggttgcagtgagtcgagatccagcctgggcgacagagcaagattccgcctcaaaaaaaaaagaaaaaagaaagattgtgtggctgttgcttccttcaattttatctttctctgcttgttgctataaacttggtttaggtcaatgtcagaaattactgttggttcctaagtgatgttttctgatgccacttctaacatcaaatatatgttctctttttcaataccaatcaataccaactaggtgcccaataattcaattcaattgtggcattagctcccggagttagtggaggccccgtagtttaaagctcagtcccacaagactgccctcacttcagacgccagccaggcagggcatctgctgctggccccaaggggacccacacctgtgtctagctgactacaaatcccaaggctcccatgatccatcctcctcaggttctataatcagctagaactactcaaagaactcaggggaacactctacctcagtttactggtttagtataagggatacagctcaggaatggccatatggaagagacatatggggcaaggtagcagggtggtgcagagcttacaggccctctccggtcacaccaccatccagcacatcagtgagttcaccaacccagaagctcttgtcttgttatagagctcaatttccagccccattctccctcccaaggttagaggtggggctgagagttccaaccctctaatcgtagtcacgtgtttggtttttctggtgaccagccccctcctgaagccatctagggatcccaccttgagtcaccttactagcataaactcagggactcattatgaaaaacaaatgacacttccatcactcaggtaatcccaagagttttaggaacttggagctgggaaccaggaacaaagacagaatatgttttatattacaccatggtttaaaagtggcatttaggctgggtggggtggtttatgcctgtaatcccagcactttggacggcaaggcgggcagattacatgaggccagcctggctaacatggtgaaaccctgtgtcaactaaaaataccaaaattagccaggcatggtggtttgtgcctgtaatcccagctactcaggaggctgaaatggggaaatcgcttgaactcaggaagtggaagttgcagtgagccaagatctccccactgtactccagcctgggtgacagagtgagactcaaaaaaaaaaaaaaaaaaagtggcattaaaaaattatgattctgcattattgccctggtttgtttctggtctttgacattgcatcatgctccaccttctctataggcagggttggattatggttctgggttttctgatttggaagtttaggtgatgttacattgttagaattagaaagtaattgagatttttgggcattttgaaacttggacatttcttataacacattcttttgtgtttgtgaagttgtttcttatagttggaaagtgaaatttgactgcaaaggccaggacattctgcttcatgactattaatgatgtcaataaatctggttcagaggactttttatttataaatactgaatccaggaataggctatggataattaatgaaataaagcagaagtagccttcttggctgagtgagggaaatatttgtgtaaattttcaagagaggaaccatgaagtattagactggaagggagctagtgaagtggctacattgactggcgtgtatacccatggtttatcgtgttgcgccaggaaaatttaggacatggacacacacaaggagtttcggagtggaggtttaatagacaggagaaaagagaaagaaaaacaactctctctattgagagagaggggtcttctgagtggaaagacgtggccggtggtggatatgtcagattttatagtcaggttggtggaggcggtgtctgatttacatagggctcacagattggtttgatcaggtatgatgtttacatagtgcatcaggaaggctggcctccccaccctcatcttattatgcaaatgaactttccccttagttggggccatcttgtctgctccttactgtacacatggctgacaaagcaaagggaaaatggagccgccatcttgaacatgattgccagcatctatgtctgcagctcgattttacaggctgcttttgttagacaggaaaatgatttggggctgcttttcattaaaaggaaaaccttaccgaggacttccataccctcactatctgcctaagtaaatttttcttaactcttgtatcacttggaggccaaataacctcagacagggtggctggaaaccagaaacttagccaggcctcctcctagattgctcctcctgcccctgccccatggggcgcttcctatggggcttttcccatggagatagatatagtgtcaggaccatgaaaaacatgatttttcttttctggaaagtgagaagttttgctgtgattctatcattctgtggacatttagaaagaaaagcaggatgtgatgactgggtacacaccataaaatatcttcttccttccgtatgaaacatcaatatcttacttggtgatttcttcttctcttcaatctaaaaaaaatctatttgagtaatttttaaaatttaaaatgtacagtgtattaaagaaaatttgtgaaaagtacatacaaagaagagggaaaataattataatcattaaaaccattgctaatatttaggtatcagtatcatgaaaaatggtttcccttttctgggaagttgtagaaagtatatcttttttttttttttctttttgagacagagtctcactctgttgcccaggctggagtgcagtggcgcaatcttggcttactgcaaccttcgcctcacgggttcaagtgattcccctgcctcagcctccccagtagctgggactacaggtgtacaccaccatgcccagctaatttttttttgtattttagtagagacgggatttcaccatgttggccaggatggtctcgatctcctgaccttgtgatccgcccgccttggcctcccaaagtgctaggattacaggcgtgagccaccgtgcctggcctatttttttttttttccccgtttaacattatcacacaagcattgttttgttgctgttgagacatattgttctaaagatcatagagatagtatggtgtagtggtttaaagtagaggctctcacaccaaaatacctgggtacaaatcacagtccacccatgggctatataactttgagagtcacttaactgctatctgccttagttttaccatctgttaaatgggaatgatggtggtagccaactcacaagttaaatgcttatgtaaaggactttgtaaatgttaattatcatctaaaggaagattttattaatattaattttatttatttattttgagacagggtctccctctcttcccaggctggagtacagtggtgaaatcacagatcactgtggccttcacctcccgggcttgagtgatccttccacttcagccttggtagtagctgggtgcaccaccatgcctggctaattttttttttttttaaatagagttggggtttccccatgttttccatgctagtctcaaactcctgggctcaggtgatccctctctctcagcctcctaaagtgctgggattacaggtgtgagccaccatgcccagccaatattaatgtatgtgtatagtagagacttttataaaatacataaaagcagaagaaatcaaaatcactcattattctaaaacccagagaaaaccacttgccagtgttaaaattttggctttgttttttctaatatatttcctcttacatagttgagagaatattgcatttctaatttgtatcctgatcatgatgtaaacattttttatttattttattttattgtttttttcagacagagtctcactctgtcacccaggttggagtgcagtggcatgatctcagcttactgcaacctctgcctcctgggttcaagcaattctcatggctcagcctccctagtagctgggattacaggcacacaccaccacgcctggctaaaaatttttgtatttttagtagagacagggtttcaccatgttggccagggtggtcttgaactgctgacctcaggtgatccacctgtcttggcctcccaaagtgctgggattaccggtgtgaaccaccacgcctggtctatatattgtttatgaacataattttaaaagacttcagaaatcatcttgtgttccatattttagttaacctttccccagtgttttgatatttgcattgctctctgcccccatattaaagtggtgacctgagccttccctggcccgtgtggagcctgcatttttttttttctgtccccaggacataattagccctaatccacaaaccaattagtagaggggtgaccagattatgaatacatttgtgaaaaacatctttgtagtggtttttcttcttcagtattagaggttatttccttagattagattcctagaaatggaaatgcagggtcaaagggtaagtttccagaagggttttattgactctagactcctggaaacactgtatgagcctgtcctacttaccgtgggcctccaaatccccttcctacagctctaggttgcttctcagatctgaaatattgaagaagttgtcggggcaccaaaactctggaattaagttaatcttaacagcccctcagctcctctttcccattccctattatttttccccctctccaaggcctttctttctttttgtagctcctctgccctgccagctttctctaatccccttgtgcaggcttcctcttctccagtcgggaggatggaaatgatataattaagtcattttattaagtagttagtaaccttagcagctagaagtgttagtccccagctggacacttgcattttaataaagggttcttggagcagtggtgaaccctaagaactggacttgacggtaggatttggggcactgtcatacccagggagggagatatcatgagccggagccactcaaggtttacaagtagatggagtcctggatgtcaggccagctttgtgtgtggggtaaagcaaaggtcagtctttgagaagccttaatttcctctctgccaaagcactaactgctgagagtagaaacaggttttcttaaaggtaaagtgagtctctcggaggaactattaaggagaaattgtttactgaattggatgtaataaaagactagtcagcagcatatacagattccttccataaaatataactttatgataccaggcagggctccttttatggctttctaaaatcgtttggttgaaattgctagaggtgtggagggccttcacttgtgtgtcggtagccagtgatttgattacattatatttccctgggcaagcagagccaggaggcctctggatgggggctgaggccttgattgccctggtgggtactctgagttgcagaaggtgggtttcttgctagacggtttctgtttcaacaaggtctcaggtgccttttactgcaaggaatgttgtaggtctctaattgtggactcgtatatcagttttaatggactgaaaatccacagaaagcactggggagtgtgcctccgtggagaatgggccaacagctggatacaaccagatggtgccctagatcttacggatggacaaggatgggtacagacaggttattaggaaggacttaaagagttggggaacctgattcaaacaaagtcctcgatagcctgaacgtaggcggaaggggagaaatggtaagtgtagtcaactgatagctaccaattgggtgctctcaggagaccttgggaccacagccagtggggaaagtggtcttgagagatgatggggaccagctggagcgggccagatgccggcctcccttcctcctggaaagaaaacgcttcagtcccacgatggtttctaccttggcactcacagccctgtctcttcccttccagcctgatcctgcctgaagatggtgccactggtggctgtggtatcagggccccgtgcccagctctttgcctgcctgctcaggctgggcactcagcaggtcggcccccttcagctgcacaccggggccagccatgcggccaggaaccattatgaggtgctggtgctgggtgggggcagtggcggaatcaccatggctgcccgcatgaagaggaaagtgggtgcagagaatgtggccattgttgagcccagtgaggtaagcctccccttttgagggcctgggtgtgtgtgtacgtgtgtgtgtgtgtgagtgtgtgtgtgtgtgtgttctggggttggatatgactatcaagcaatgggtcttcatatgttcaggttagggcttctcctgggcacagaaagcagcctatccagaaggactgggaggaagtggagggaaagagagagggagaacagatctcttggcttttagtgttctcctctgtattagtttcttagggctgccataacaaattactgcaaattgggtggcttaaaacaacagacatctattccctcacagttctggaggctagaagcctgaaaccaagctatgggcaaggccatgctccctctgcagcctgggtgagagggatgggcaggtggctttgtctcatgcctctctcccagcttctggtggttaccctgaaatccttgccactctctggcttgtagctgtgccactcctttctctgcctccatcttcacagaatgttctctgtgtgtctctgtgtccctgtgtcttcacatgacccttttataaagccaccattcattggatttatggcacactctattcaagaatgacctcatcttaatttgattacatttgcaaagaccctatttccaaataaggttacattcccaggtactggggttagaacgtcaacatccttctttgagagagatacaattcaacccatgacactctcccagtgccaacctcctgcccagaggaaaatcaatggccactgcacttgcctatctgttcctgtctggagaagggatgatgagttggggagcaggaaggcctctggaaagctgtcagtgggcttagaaatttaaatgcaagggcagattataagggagaaaaggtagctgacactaggagggaagactgagtaaggcgctgtctcacaaaaaacatgttaagattgtccaaaagcttcagaaaaatattcaagatttttggtggtttgcctaatgtttcctgtggaactaggcatgtactggttgggagctgtatccttgggaggaaaaagcaaaatggatcaggtgcctgtttcagggggaggacaggacaaggaagacatactccttttcaagatttgtccccagcagggaatgatgttaaccagggccatgatttgagaggaaactagggggcagtctctatcattttcctttttaaagtgacgtctgttcaattcaggaacctcactttaaatgacagtggtctgagagctgtgtcaggtggctactgtttctggtatatgttgtattttagctaatgcgtgggcgggtctcccagtcaggcttctctttgtaaggagactggctcttctgggacctgggcacaattcaggcggccagaatcaagtttgtcctgccccgtgaggaagtacaggacaggaatttctggaaggagctgccagagccccaggcttggtactttccctgctgagtctgatttagtgatagctggagctgatgttcatagtctaaaaataaaatctgagcttgtatttttgctcctcttactgttcaagatagactggccattgatgagctctcataaatggagacctctgtcttcctccctcttggatcacattattgcttgtagggagattgcaaagtcattcctggtgtcctcttcacctctctgtgggttttggcagtgctggccagctactttgaggcattttggcaatattgagagctcttggtccccagtctactctaagtggattggaattcttagaggccattaaacaaatctgccctttgcccctatgtccagaacttttacaactaacttagatcaagaatggactgttgctgggcacagtggctcagggctgtaatcccagcactttgagaggctgaggaaggcagatcacctgaggtcaggagttcaagaccaacctaggcaacatggtgaaatgccatctctactaaaaatgcaaaaattagccaggcatggtggcacatgcctgtagtcccagctactcaggaggctgaggcagaagaatcgcctgaacctgggaggtggaggttgcagtgagccgagatcgtgccactgcactccagcctgggtgattggggtgattgggcgagactctgtcttaaaaaaaaaaaaaaaaaaaaaaaaggaccatctgaagcaagaaaactccagaagatagtgaaagtttgggtatgcattgcattgtggagtaggatctggtacttattgtctttggtgtaaaatctctgagtctctgagaaagtagaagaagggctgttcaggaaacacagccctcactgggcttgggaaacacagttggaagttaatgaagtttagaggacctctggaaggggctgtaaactttccagacttaccactgtctccacatgctcctgaggaaccatatctaggctgctgggcttaatttttaaaatatttgttcacatgaagtatccataatatgtgtgtagatatgcacgtgcatataacatgtacatattaaacaccaaatcaactttcagcaatacataatgcagtggtcactaaagatagtttatagcttttctgatgatcttggaagaattcttgtgtggagtgactgtccttcagagcttaccataataggagacgcctaatagacggagctaactttgtggagacttttccatacgatgctctaaaggtcaggagggagtgattgaaagaatctagcccatactgttagctatgaccccttttgatcagtgtcaaattgcaataaatcttcaaatactttgtttctcagagacatttctaccagccaatctggacactggtgggtgctggtgccaaacaattgtcctcatctggtcgtcccacggcaagtgtgattccatctggtgtagaatggatcaaagctagagtgactgagttgaacccagacaagaactgcattcacacagatgacgacgagaaggtaaccactgaggcctttagattttttgttaatctgacagcttgtattaatatgcagccatcttaaactggatagccttgtgttgaaagagcggtatatatgcatgtgtgtgcatgaacgtatgtgtgttgaatactacacaagatggcagggtatgtggtaagtggaggatagatggaaggactgagtgatattgagttaataaacaactaagataagtatttgttgaacacccactgtgcaccctattgcttagtatactatcttgcacctgaatgtttatcagaccatttgtttatacgttgctacatgttaaaatagcaagcaccttcctccttctctttttctgaagcaatcagattttctaccggtcgcctagcctcccagaacaataggatgctggaaaatatccatccagccaccctggggggcgctctaccagaactgtaggggaatcctgtgactctgaggttcatgccagcgctaaggagaattgttgctggagcttgaggctcacaactgctcagcaccttttagaagtctcccaccctcaccactcaggggtcaaagcttttcagcagtggccgccccatgtttgactgaggtgataagagcaggatggtggaaggcctgctcagaagccatctgcagctttcttttcccccacctgctgctgagcccagggcaggggcaggcagtgcagccaccgtgctctgacctgttccaggctcctgtggtttttggactcacaaggtgttattggtcttaatcctctgccccttcccccttcaactgggactctggcattttcacggaattgtagaatcagagttgggtgaggatcctaaaacgttttcaagtccaacccttcctccaacagagattcatctgctgaggcattattttttttgagacagagtctcactttgtcacccaggctggagtgcagtggcacaatcttggctcactgcaacctctacctcctgggttcaagcgattctcccacctcagcctccccagtagctgggactacaggtgcgcatcaccatgcctggataatttttgtattttttggtagtgacggggttttaccatgttggccaggctggctcgaactcttgacctcaagtgatccacctgcctcagcctcccaaagtgttgggattataggggtgagccattgtgcccggcctgctgaggcattgttaagctttttttgggtcatggatctttctgggtaccagatgaaagccctctctagaaaaatgcacctatgtatcagattttgcatttgcttttagggagttcagagattttctgtagcttttccctggaccctgatcaagagtacctgctttggctgagcatggtggttcacacctgtaatcccaacaccttgggaggctgaggtaggaagatcacttgagcccatgaggtcaaggccagcctgggcaacatagtaagaccctgtctctacaaaaaaaattaagacattagctaggtgtggtggtgtgtgctgtggttccagctacttgggaggctaaggtgggaggatcacttgagcccaggagttcaaggctgtggtgagctgtgattgcgccactgcactccgtcttaggtgacagagctgtctccaaaaaataaaaaaataaaaaaaacacaaaaagaaaaaaagagtacctgctgtatagcatttatgatccttggctttctggcctccattcattcattctacaaatatttattaagcatctactataagccaggtgcagttttaggcattaaggatatgtgtagtgaacaaaaacagacacaaattcttattgaactggatattatattctagtcagggagaacatacaatcaacatagacatgataagtaaattatatagtatgttagaatgtgatggttattcatgaaaaaaaatagagctgatttggagctaattggtattggggcacatggaggtgggggattgaatttaaaataggttggtatttacatagtccatggccaaggagttctctgataagttaactcttcatctttttagacacgtgggttatatgaaagttctgtcttcactgagccagaatccaccttcctgtaactttttttgtattctttcttggacacccaggatgttattgtttttaatacacttaatacctttcttaatacttttattccttgttttgtcctgttgtgtatgagagaagaatgtcttctctcttttctgtggagaaacccttcagctatttgaagatggctcttatgttttatgtaaattttctctaggtatatgtgtcccccccatcctcatgtccctcaattcttcctcacatttcatggtttccagtccccccagccccctctttattctgctttaaacaccatctggcttgttagtgccccatgaaagaggtgcctggaaagaaggcaactttacagaacagcccagaatagcgtggagccattctctcccatgatctcatgctgcataagttagcatttgcctttttcgtgacagttaccacggtgctgattcatgctgggcttgaggtcggtgcaaattgctgggcccttttcacatgacccacgatcaagtcaggcttcccccatcctgaaaaagtatagttgttattgattttacctaaaggcagaaatgaatatatataagcaaatacctatatgcatatatatttattttaattaaaatttttatatatggcttttgtcctgttactagttcagaactttcttatttttctcaatgtctccgggagaccagactgaattacactcaagattgttctcaatcacaaggttgagcttggtggctctcttaccttgccagtctcctgaacacagggccaggagacctctctcatatcacacacagcatctctttggtacagcagggcctgcctcattgtttggaccccttcaagctacaggaagagctttagagccttcggtggttgggttcatgctcatctcaaggaccatatactttactcatctcttgggaatgacaggcactactaggtgttctcactgctgagtcctacctattactcctaaggttagacacttaggaaagctgtagtgtcttgttttagggcagagaagttggtgcaatgtagtgggactttcttccaagattttatgaagcaaaacgacttcatagccagatatcagaaatacacatgacatctcatgtgagaaatcatcctgctggttttaattcatcctcccaacacatctgggtcttttggatttatgactctgtcaatccattagcaatttttctatctgttattcacaggtggtttcatataagttcaaagttttaactctgtaacatgtcactagagagcttttttagattgcacaaaattagtcaacatttctttagcaaatattattcaagtgaccaaatcattccattctgtcttttttttttttttttggagacagagtctcactcttttgtccaggctggagtgcagtggtgtgatcttggctcactgcaacctctgcctcccaggttcaagtgattctcctgcctcagcctcccgagtagctgggattacaggcatgtgccaccacgcccagctaatttttgtgtttttagtagagacagggttttgccatgttggccaggctggtctcaaactcctgacgtcagatgatctgcccacctcggcctcccaaagtgttgggattacaggtgtgagccaccgtgcccagcccattccattcttagtttacactttcccaccttattggtgaaagactgagctgaaggcactgttgaaacccagactcagtgtgtctctgattcttccctgatccgggggtgtgtttgtctgaaacacatctcaaggccctgtgtagactggtccttgctccttctccaggcttaacctggttctattctctccttgttcctgctcctgccatactggcctcctatttcctcaaatgcctcagcctttttcttaccccaggacatttgcacatgctgcttccacctctatccctagctaactgctactcatctttagcttcgatatgactccttcaggcaagccttccttgacttcccagactaggtcaggttatcccttgatgtgctatcacagcattctgtgatttagtaattatttgtgtcattatctggtaatgcctatctcactcactagatggagttcctgaagggcaggaagtgtatctttcttgtccattgttttatgcccaggacctagcacaatatctggcacatagaaggtgctcagtaaatatttgtgagcaaattgtgtctgtttcttcatttgtaaaataataataataatagtacctagataccttatgaagttgttgtgagtgttaaatgaatgaaaccatatgaagcacttagaacagcaccttgcacagagtaaatgctcaataaatgttgctgttatttttaaaagaatacataaaaaggaaaaggatatatttattgagtatctactatatgccagcagttcttgattgctgattgaaagcagcaggcttatcatctgtgaacctatgttggtgctccttttcctctcccctccccttccctcctctcctctctcctcccctccccttctcttccctcccctccccttctctcccctcccctcctctcctctcccctcccctcctctcctctcccctcccctcccctcctctcctctcccctcccctcccctcccctcctttctcctcctctcccctcccctctcctttcctttctcccatcccctcccctctcctctcctttctcccatcccctcccctctcctctcctttctcccctctcctcccctctctttcttccttctccttccccctccctccctccctcccttccttccttccttcctttcttccttccttcctctctccctcccttccttccttcctcccttcctctctttgtctccttcctccctcccctccccttccctcctctcccctcccctcccctcctctcccttcagccttgctctgttgcccaggctggagtgcagtggtgagatcacagctcactgctccttgaactcttgggctcaagagttctgagccgatctaccttagcctcctgagtagctgggactacaggcacacactaccatgcccagctaatcttttaaaaaattactatgaaatgtctatttagtagttgagtctagagttttgcaaaggattaatagcctatttactaagatgttcgtgtcagagtttacgtcttctgacccctgtgtaatatgagaatacttgcagatattcagccttctggcaaggtctacactgttgtgcgtaactgctcaaaagtcttgtctataagcttttgctgttcctgggggtttaggtcatctgacctgaaaacttgaactcattcaaaaggcttgaggttttcttcttgctttcttgctatggagggtttattctctcttaatgattttttccccataatcttaagctggcatgtttttagtccttagacataatgaatattatgctctaataaaatagagcataatcaatattatttgcatcatgtttggtggtggcctgcacaaaccaaaagctcctcttgtttccagtggtcatatgtttcacctgtagatcatcactaccagaccccatgctagctcttacctaatatgcccggattgctcaacatggtttggccggccatttaacgggcctggtgccctttcctacagaagatggaatttcaatacatcatctttctttatttctttctttctttctttttttttttttttttttttgagatagagtctctcactgtcacccatgctggagtgcagtggcgtgatcttggctcactgcaacctctacctcctggattcaagcaattcttctgcctcagcctcctgagtagctgggactacaggcgcccgccaccatacccagctaattttttgtatttttagtagagacagggtttcgctatgtgggccaggctggtctcgaactcctgaccttttgatccacccgcctcagcctcccaaagtgctgggattacaggcatgagccactgcactggccaagacatcatctttctatggataggcaaaacatacagatgaaaatgcttatattatcttccacttagagaaattgtacttttcacaagcaactgaaatcattcatctatccattcacccaccaaacattacagagttcctcactttaatttagtgactgtgctagattctaggaatgtaaggaataagacataacttttatcctctaggagtggtcagtgtgctggggagaacaagtgctaggaagcctcatgcacactatgctggggagctcctgggaggggccagtggtgagggtgatcgtgtcatagtgggaaagcctgctgtggaggtggctttggggctgaagctcccggatgccagggcagggcctcttgactgcacgttacttcccttggctcctcagccagagccaagcactctcaggtcttggagtcctctctctccaactgcgattcgctcgggttgcttgctctgctctgccatttagtacaggatcatggtaatcaccacctgtttcttctttctgggctcctgagtctcactgcaatcatttcctaactccagttttctaggcaagttcttgtactttacggccactttgtttacactttttggcctaaacttgtcttcctctttgtcctaaacccacatttccatcatgctacttatgcatacaatacccgtatttgaagaagggacttttttcatcccatacaggtcattaaataagatcaggtacactatgtcatagcctttcaatgaccttgagattgctcaaaagagcaatctcccaattacgatattggtccaatccacatgacaggtcagacttgcttgggactcacatattacccaatagattttagttttttatttttaatatacaatatactaatatatattttttatatatatattttttatttttttttaatttttttttgagacagggtctcactctatcaacaaggctggagtgcagtggtgtgatctctgctcactgcaacctccacctcccaggctcaagcgattctcccacttcagcccccctggggactacaggtgcatgccaccgcacctaggtaatttttgtattttttgcagagacagggttttgccatgttgcccaggctggtctccaactcctgagctcaagtgatccacctgcctcggcctcccaaggtgctgggatgacaggtgtgagccactgtgcctggcctaccccatagattttagacagtggattgtcttttaagattaggaagcccttctcttacctctcaatatgaaaaagtgttaatacaagcactgtacaaataattgtggcctctcactgtgtaaacacatagctgtctcaagctttctggggctaggcagcttacaaaatatttgtgaagcagtgaggtgtgaggcatagacggcagagggcatgatgggagtggacacgcatccctccctgccagtctgcccacctcccccagccccaagacattcagattaaaaaatgggaacctgggcaggactcccaaccttgttctgcttcgattttctcatctgttctatgggctaataatatttccctgcctcccttagaccacatggaaccacatctggggcctgagtcagtccttgagttgatgcttcttgagtcctggtctaaaataatgtctttttgtgttgcagatctcctaccgatatcttattattgctctcggaatccagctggactatgagaaggtaccgtgtgaaactgtttctgtgttacgctggcttatctatgccaagagcaaatgctgcatttagttgctttattatattcattttgacaagaaaggggttctaagaaaatctcttctggttttatttcttggcagtccttttacagttttaaggaagtcttctctaagattctgtcgataataaccatatgttctagctttaagctttaattagagttcagcatgctcatgccttaatgattaattcttgcaaaacagcagttttctttccacatttgtaagaaacatgtctttctatgtgggacagagttggctgtattgaagattacattccgctttggaagtagggtttagattataaattttaaagcagactttaaggggtggaacaccagcagttagctcgtctgttgctggagggacatctgggttttgttgtgtcgatactgggtttttagtgtgaagtaaccgatgcaatggaaatgccactcagaagttcctcagatccccgttttcagtgagctagggagccagatgcaatttgaaagttttgagattcaacttcatttttctaaaacatagcagagtaaatcggtaaatattatcatttccagaaggttgttggggactacagataaatagttggagtacaggaaacatctgtgctaaccgggtaacaagcttcaggaatgtgacctgggcaagggcctcaacagagttggcccagtaagaatctttgaagtgtgttgaattgtgtcatgtccaggggaagggtagtgaaaatgtcttgggttgtgttgtgggaaagttcagagaagctacaagttgttgtgaatgttgtaagatggttttgagtcatggtgccatgggtcgtgagtctgttagaatgacagacaagctatgaagtagacgatatggagaaaggtgtttattacaactactttcaagggggccataccttccaaaaaggcccccacagtgttgacctagcaaaggcaatgcgtctccatggtactgtcttcccaaagccccagtgtcatgtgagaagcactgcagaggccagtgctcagagttcatagcagcctcttgtagcaaaccaagtcacagagatatttaaaagtagccattattatggaatctctattacataccaggaaccatggtaggaatcaaatattgtttcttttttcttttgagatggagtcttgtcaccgaggctggagtgaagtggtgtgatctcagctcacttgcaatttccatttcccaggttaaagcaatctcctgcctcatcctccagagtagctgggattacaggtgcccaccaccatgcccggctaatttttgtattttttttagtagagacggagtttcactgtgttggtcaggctggtctcaaactcctggcctcaagtgatccacccgcctcagcctctcaaagtgctgggattacaggcgtgaaccactgcacccagccaggaatcaaaaattgattctttacaactacttgtgagggaggcatttttatcttcacttaatagatgaggaaactgaggctaagggaatgtaataaccatggtcactgtgctacttgggactctttgattgcaatttcaaggaaactactcaggttggtgtaaataaaaagtagagatcattgatgaaaatactgagatgtttctagaacactagggcaaggatgtagctgggcctctggcagggctggatctccactttgggttctgttggactcaggcagcctctctttgtccatctctcttagcctctttctcaggccagcttcacagggtctctgcagcaggccgtcctgcctgccggtctactctgtgtgataggatagtccacggctccccagtgcacagcctgttgctggaagccaaaggaggagtcacatctcatctctttccctgactctccctttccctctctcccctcctctctagctctctctgcttcagaattcccagggaagcaactctgactagatgaggggtcaaaaccaccctttttgacgcaggttttcctgaaaggagcttggttaccactttacggcaacttttccatcaacgacagcttcttaaaactagagaaaactaatgaaggtgataagacatcaactgcttgtttctgcttgtttatctcttggatagtgagatttgctttgggaactagaaggtatggcggtcctgtgcgaagacccccaggcaggtgggcagaggccttggtgtctggttctttaagattctgggcagggctccatccattctaggggttaatattcccctgcctccctcagaagtacatagtgaatatccattgttagcattgatgtgaaactttgaaaacatttaaatgcaaggtgattttataataataatgatattattattgagactgccaatgttactactatctaactgtaacaggggtgaacagtaacaaatagttgcttttaacattgagtgtgataagtaatgaactcaggccactgaggagatgagaggactctgtttccttgagacctcagggataagtgtctggagtgactttggaggtggcccagagaatgggctggggaggctctgaaggaccaggccatcttgatgactgtttcttgatgattgaagttgaacctgctcttgctgagaactgaggcttaagtctctttaactcagtctgtgacatcttcattgcactctacgagccttctaacatttataataggtgtctagttgatcttattggcaataatcagctaacatttacaggacatttgccatgtgcatgtgtcctgtacatgcatggcctcatttgcttctgcctacaaccctgtgaagcagataccttatccccatttcacagatggtgaacgttaggattctcaaacctgagtgtgcatctgaatcagctggagggcttgttaaaacacagattgctgggcctgctcccagtttctgattcagtaggtctagggtggggcctgataatctgcatttctagcaagttcccaggtggtgcttgtgctgctggtctgagcaccacacttggagacctactggcttagaagtattaggtaatttacacagggtcacaatgctagtaagtggaagagccaggactcaaactggtatgtgggatcctaaagtccatgtttttaggcacctggctttagtgcctttatctagagtttggtctggtacaacctgataaagagtgatttaagtttgctattcttgatgatataaatggctcttggtcctgccagttgttctttccagtgaggcaactgggtctcctaaaaggaaggctggctggcgtcttgtcctcactccgatggtgggaaaagttgtattcaaattgtattctcaaggccagggagttgaagggttcctctgagctgagcccattctgcagtttgacaggtgactacaggtgccacagctctggtcttagaaccctcacccacctgcctgctctaggcatgtgggtattggagggtaatgatagtactgaaatatttgaaaggttgtagaaatggcaaagaacaaggactctaaagacatttgcacttttgtttaaaataatttttgtgtactttgttgcagattaaaggcctacctgaaggtttcgctcatcccaaaatagggtcgaattattcagttaagactgtagagaagacatggaaagctctgcaggacttcaaagagggcaatgccatcttcaccttcccaaatactccagtgaagtgtgctggagcccctcagaagatcatgtacttatcagaagcctacttcaggaaggtatgcttcctttctggggacagagatgagcagggcggacagtgctaattcactgattgcaagaattccattttatctctattgtaatcccttttttatctcggaatttttattacatgtgtacaaaattagttaactggaagtttataaaatataaaagaggagaaaatcactcatgatccaattgctttaataaagctgcagttttcaatttgacatggctttccagctttttttctgtatacttaaatatggttacagtcatagtgtacatgaaaaatttagctgtattatgtaatattaaatagtctttgttacatactttttaaatgtgtgtgtaaaagtctactggatgctgggtgtggtggctctcgcctctaatcccagcactttgggaggccaaggtgggtggatcacctgaggttaggagttcaagaccagcctgaccaacatggagaaatcccgtctctactaaaaatacaaaaaaaattagctgggcgtggtggtgcatgcctgtaattccagctactggggaggctgagacaggagaattgctcgaacctgggaggcggaggttgtggtgagccaagattgtgccattgcactccagcctgggcaacaagagcgaagctccgtcttaaaaaaaaaaaaaaagtctactggagagatatgttagagactgtttaaatatttccatatagttagacaattagttgcagattgttcatttttatccataatgctatccactacttccactcaagtttaaggtcatgaatattttctgtcccttgggtatacattaaaaaaatatgatacggaaaatgccaatttaaaaagcaaaaaaatgttctcatagaactttaaaccttcatgaaaagagatatttgggcaggaggagactttctcagcattctccaaatgctctctgtgtaagagcagttgtctgcagctcaagtacacctggcttaagcttgtaagggaagctgttcttgccctccctgctcttgcctggggtttgacatttagtttaccaaagtgcggtttggcttgagacagtggcaggatttctagcagctagtcgtgtatggggacagatgggaagaagggtggggaagaacgggctggggagtggttgaatgtgctcatggaggctgggactgatcaagaccttcccctgagctctgtaaactgcaacaaccctgtgaggtagggaattaaaggcagttccagtaatcatttctgaccccaagaaagttcattctgggtcataaagggctggcacagccttttgagacacttacccacctgaattcttcaaatggtgagatccgggtgagcaaatcatgaaaggagccgagcaaaggaaagaagaagaaaccagctgtttcttccgtcctggaaacttctttgtgtaactcttttctcccaagtcttagatggcctacgaggaaggttcgagtaccataagatcttaggcatttgggagaatattggcctctctgatcttaggcatttgggagaatattggcctctctgaacaatatcaagaaggtaggaactcagggttttgttgttactgttttttagtttgtttattttttttttttggagacagaattttgctctgtcacccaggctggagtgcaatggtgcaatctcagctccctgcaaactccgcttcctgggttcaagccattctcctgcctcagcctcctgagtagctgggattacaggcgcctgtcaccatgcccagctaatttttatatttttggtagagacaggcttgtctcaaaccatgttggccaggctggtctggaactcctgacgtcaggtgatctgcctgcctcggcctcccaaagtgctaggattacaggtgtgaggtactgcgcctggctggaactcagttttgctcactgctgttccctcagcacctaggacagtatctggccaactctagaactttgttaaatatttattgagtaaatgaatacatgaatatatgaataaacattccgttctactctactctgtcttgacctggacctaaccttcacctctggccttcagctggacagtgcccacctcagcccccaactcaagtgtgtacttagttgtatgtcatgggcagaacataaggaggaggcagtggattggtctacccattgctctgccaggacataatggtggcaaaagctagcaaggtccctgctgagggttttaattcttgtctggattaaaaaaaaaaaaggcagctgcagtcatgctttggtgtgaatggttttcttatttttctcagacagggaagcgatccaaggccaatatcattttcaacacttctcttggagccattttcggggttaagaagtatgcagatgccctgcaggagatcatccaggagcggaacctcactgttaactacaagaaaaacctcattgaagtccgagccgataaacaagaggctgtatttgagaacctggacaaaccaggagagacccaagtgatttcagtgagtggtgaggctaagctgtcagcatgaagcgttgtctgctgaaacgtgccatagatacatgggggctcacaccaccctatctgccatcattgtgtgctggggaagactgggtgaaatgagcatcttagggaagtgttagggcaagaaggtaggccaaaatggttggggaagagaaagatgtaagaggctgtgtcagtgggaggtgagaaggtgtcgttagctggtgccaagtgaatttttgtcctattcctttgactcaacttttcctggcatcgagtcacttgaggtagccaaaaatattccacaactttggttactgtgtagaggtaagggagggcttcctcgaatgcaagatctggtgattgtctcaattggtggcatgtgagaaacagtcctgcttgtgagcaggaagtaaccctgtgggtagttgaagaaaacagggattggctgggcatggtggctcacgcctgtaatcccagcactttggaaggccaaggcaggtggatcacttgaggtcaggagttcgagaccaggctggccaacatggtgaagccccatctctactaaaaatacaaaaattagctgggcgtggtggcacatccctgtaatcccagctacccgggaggctgaggcaggagaatcgctggaacccagaaggcggaggctgcagtgagccgagattgtaccactgcactccagcctgggtgacagagtgagactccgtctaaaaaaaaaaaaaaaaagaaataatctcaaacttagagaagttacaaaataaaaatagtacaaagaaaattgtatgtagcttttacctagattcacttgtagaattttaccatttgctttagctttatcatttgatttcttccttccttccttccttccttctttcctttctttctttctctctttcttctatctgcctttgtctatctatctatccatccatatctagtttttccaaggaaatttacatatatcatgcatcagctctctttagccccaaatactttagtgttaattttctaaaatagaagtgttctcttacataaccacagtaccattatcaactcaggaaatttagcacagatacaattttttaacttactatttgtattccaatttagttgattggcccaactgtgtttgtagcattttttcctccagtgcaggactcaggctacagtcaggtattacattcaattgtgaggtctatttagcctcctttaatctgtgatgtttctatagcttttctttgtcttctatgacgttgatattttgaaataatacagccctctcccccaccacttttctttcagtagaatgttcctcattttgagtttgtcagtgttttcttgtgattagtttcaggctttgatatgtatttatttatttatttatttttgagacgaagtctcgctgtgttacccaggctggagtgcagtggtgcaatctcagctcactgcagcctctgcttcccaggttcaagcgattctcttgcctcagcttcatgagtagctgggactacaggtgtgcaccaccatgcccggctaatttttttattttttatttttagtagcggcgaggtttcaccatgttggccaggctggtctcgaactgctgacctcaagccatccacctgctcggcctcctgaagtgctgggattacaggcatgagccatcgcacctggcctcaggctctgtttgttagactggaacattgcataagcattgtgccattctaaggtatcacatttgcaagcatacagtgttcatctgcccttcattggtgatgttaattttgatcagcagtcaagatgtggtccagtttttccaggggataattacaatttgttttctcccttgctactaataagaagtctgtgggaagacactttaaaaccatgtaaatagtctactcattcaagtctccccactagagttagcatccattgatgatccttgcctaatcaaatctttactatggtggttgcaaaatggtgatttgctaactgtgacatttcctgcacatttaccagtaagctcttggcattctttcagcgagagtctttgcttcttagttaattaactattggtatgaactcatgagttcctatattttttcttacagtgttatcattcattattgtttttaattattatggtgctcaaattgttttggatttggtcagtagatttcccttccagctggctcttgtgtccctgtgacatgccccatcatgtgtttgagcacttcctttactttctggtgtcacaggttgtcccaggctcatctagtatctatctgcagcagctcagggtcatcattttgaatagctcctgtgtagttatgcacacagaggctactggaatgtttggagctagttatcactttataaaagggtctcaaattactgctgtttgttttttgtgtgtcctttttgtagttttcctttttcctggctgtcaggccgttgttagtgactttgggaggtccctccagctttagcttttttaaattgctgctcctcaaatggcctcactcaaatgggctatgagtgagagctcatatgagtgaactcatttttactttacaaaagagcccatttgagagagtccgtttgagtgagcccaagttgggctttcactaaaatgagctatgagtaagagcccgaagcatccttttatgagcaaagtgtatgaacttgagtgcatgaacttaactttgttagtacttcgtttcccagctgtcctctggatagctgaggttgtaggtaggggtgtggataaatgaatggttattattcttctaaggggtttgtaattaaagaagatatttgtgtcccctttgaattataggatttcaggtcagatatttagttccactcttaaaatctgaatttcaaaaaatccaccagaaggatgtaaagctgtggctcttaaccctggctacatattagggagcttttaaaatgtgctgatgcctggcctctttataagaggttttaattaattggtttggggtgcagattgaggatggggagtttcaaaaattcccctaatgactaatgttcaaccaggattgaaaacaactggtgtgaagaattgggccggacgtggtggctcaagtctataatcccagcactttgggaggccgaggcgggtggatcacgaagtcaggagtttgagacctgcctggccaagatggtgaaacctgtatctactgaaaatacaaaaattagccgggcatggtggcaggagcctgtaatcccagctacttgggaggctgaggcagagaattgcttgaacctgggaggcggaggaactagaagacactttggagattgtctagtctagtgcatttctttatggataagcaaactaaagaccaaagagatgaagtgacttgtccaaataatagcattctatttttctttgtaaatgaacctgttccttcaagccagagattgtaagcatgtgatccacagattttacatatcagaatcactagcagattttaaagtacagattcccgtgctttacccagatctactagattgggatcttggcatggtgtagcctgggaacctgtattttccacaagtctccccaatgctgctaataaacattaaagtttgaaaaccaccacactgattggactatgtatgttaatgaaggaggaccaagttatttatcctatacagttacagaaataaatgatagataatgaacaagctacaactaagtgccagtgtttgtttgtttgtttttttctttctttctttttttttgtagacagggtctcactctgttacctaggttggagtgcagtggtacaaccgtggctcatggctcactgcagcctctacttcccaggctcaggcaatcctcctacctcagcctcctgagtagctgggtctataggcatgcactaccatgcccgggtaatttttgtatttttttaaagactgggttttgctgtgttgctcaggctggcctcaaactcctgggctcaagtgatctgcccaccttggcctcccaaagtgttgggattacaggtgtgagccaccacacctggcccaatgttaatttctttttatttctttttttcttttggaggcaggatcttgctctgtcacccaggctggagtgcagtggtgccatcttggctcactgcaacccccacctcccagcctcaagcaagccatcctcctacctcaatctcctgaggagctgggacaacaggcatgtgctactatgcctagataattttttgtgtttttggtagagaggggtttgactacgttacccaggctggtctcgaactcctgagctcaagcgatctgcccaccttggccccccaaagtgttgggattacaggcatgagccactgcacctggccattaatttctaataaatccataaagtagacccttttgtaggatgttagctcaggtaaaactccatacctttatgatgattatatgaaagtatttagcttttcttttagaaaagagttgtggaatttgtgtgtacttgtgaaattcaaacacattaactccaccgagatgactctagtaaggtttagacctcagttcaaaaacgtagttctaggtcaggtatggtagcttgcacctgtaatcccagcactttgggaggctgagacaggtggattgcttgagcccaggagttcgagaccagcctgggcaacagagcaagaccgagtctctaataaaagaaaaaacaacaacaacaaactagctgggtgtggtggtgcgtgcctcctggctgaggcaggaggattgcttgagcccaggggttcgaggctgtagtgagctatgatcaagccactgtcctccagtctggcaacagagtgaaacactgtctcaaaagtagttctagttgactgcagaaatgcagacaggagattaataatttagtagatgatagctgttgaccatttcatccattatcctgcaaacatgcattcagtttcaacgttcatgaacagacctgacctcagggacccatgtgcccaagagccaccctccacccaaggttatcctgcagatgagcagcagccatttgcagtgctccttccctgaggttaattaagcttatatttgtctgagagttgtaataagtacaagtcatcttcctaattcccattgccatcagtgactgctgagcctctcggagggcatgggaacattggacttcttgtggaaatgaagggctattgactatctcaaaaggttggaattgtcttcaactgcttaagtttttaccctaatgacatgtcgtgaacatttcaatcaatgtgtccttaactggacccactagcaaattgatgaatttgctggaaggagtttgttaaaaataaataaaaagaataataagaaccaactacaaaacgtgaaagaatattacataaacaaaaaaattaaatgagccctcaaaagtgattaggatgggtcagtgcaccactaccaaaggtaaccttgatacggtgttttggaaaaaaattcacccctgccttctgcactgaaaagtaaatccagtactgaatcagaccccttgctccttttccaaagtgctagctaatatttttaccaccccttttcatcttaaattggtgttctgacagtttcctttatgtgttttgaagttgacacatatttgggaatgatgctttcttaccagctcctaacatatcctttacaagtttaagggatgctgagcatcaccttacagaataacgctgaggtgctaaactttgcaagttgacagctgagggtcagggagactgcaactgaaatataccacccccttattttagtactaataaaaacatcaatggattttttcagaatattagtgagctttactccaatatctcatgtacccgtacgtgtgtccacagggctctcttggtctctgtatggggagatcacgtcaactgagagaatggttatttagcttatcaccattccccaggagaacacataagatcttggagagggcgtggactggtacaagtgctgattgtataatgctccatgcagccatagcacagtgtatagagtaaggaaggtagggggagagcttgtggagctgtagaaatattgaataaatgaaaatgtggattctctctttgtgtgtagtatgaaatgcttcatgtcacacctccaatgagcccaccagatgtcctcaagaccagtcctgtggctgatgctgctggttgggtggatgtggataaagaaactctgcaacacaggaggtacccaaatgtgtttgggattggggactgcaccaaccttcctacgtcaaagaccgctgctgcagtaggtaagtcaaccagctccatttctccctttctcaaaaatatgtcacctcaaggcatgattgtaacaaaaacacaagcttggcatcggccagagacggtggttcctgcctgtaatcccagcactttgggagactcaggcaggcaggtcatttgaggccaggagtttgagaccagcctggccaacatggtgaaaccccgtctctactaaaaatacaaaaattagtcaggcgtgtggtgggcgcctgcaatcccagctactcaggaggctgaggcagaagaattgcttgaacacgggaggtggaggttgcagtgagccaagatcgcaccactcctttccagcctgggtgacagagcaaggcttcatctcaaaaaaaaaaaaaaaaggccttcctaagacagaagcaagttgtcaatgaacccagtgtcatatacagcaaaaaataccttttgagtgctttgccccagagtagcatgatcttatctaccttttctaggtcagaggggttgttgtcagaagagggggccttagagtgcatcacttttctagctctcttgaattctgttacttctcatactgccatactggcatccctggtatctttgcctctgacaccaggcaggttggctatttttcttctgcctgaaacaccataaagctcgaggagcatttgttttcccagaaaacacatggaagtcaatgaaagcttgcagaccagaaaattgtcctgttaagacaaatacagtggagcatgccctgagtggtacacgattaaggcctcagcctggaaaactaaattcttcacctcgatgttctgcaccagcagtgatggggagaattgccttttagattctgtcctctactgacaggaactgtcttctctggatgctataaaacacaagaccttcagtatggtcatgttttgtgtgaattagacacctgtggaacagattgtgttacttttgctgactatttcaacctcaaggtagaccatctaggaaactcactgagtgtctttttcattattaatattaatttccttccaactttttatttaaaaaaaaatctcaaacctatacaaatttgaaataaattataatactcatatacccttcaggtattaaccaattattaatattttgtgacatttgcttcatcgtatttatgtatatatgtatattatgtatgtatatattatgtgtgtgtgtgtgtgtgtacatatatatatatatatttttgtttgtttgtttgtttgtttgttttttggtggggggacagaatttcactcttgttgcctggactggagtgcagtggcgcactctcagctcactgcaacctctgtctcccaggttcaagcgattctccttcctcagcctcccaagtagctggtattacaggcacccaccaccacacctggctaattttttttatttttagtagagatggggtttcaccatgttggccaggctggtctcgaactcctggctgcaggtgatctgcccaccttggcctcccaaagtgctaggattacaggcgtgagccaccacgcccagcctgtatttatgtatattttcctaaaaatgtccttttttgtcccagcccctccttaaatccaccagccagtcaaggatcacacactgcattgggcgtcatgcctctttggttccctttaatatagagcaggccttctgacatttttttctttactttcatgacattgacatttttgaagattccaggccagttaccttgtagaataccccaaaatttagaattgtctagttgctttcttacggttagattcaggttatatgttttggcaaaaatctccatacctgagtctgtgtacctccctctgtggcacctcaggagcctgtcatgttagtttgtcttgtctttagtgaagctagacttcctcactgggttaaggggtgttctctctctctctctctctctttttttttcattgtaaaagtactctctctctctttgtaatttgtaggtagtctgtggggtgatactttgaaatgacactcatttaatgtaagcctgcagcatttatgtggtgaaactacctgtgatgtgaggcccagattacccagcttttagccttcttcaaacaaatatttaattcgatgttccagatagataagactgaatatgactgaacaaaaatattctaagtggaaagtcttgttcccagtcctgcagtgcatctgcgtggctttcacagtcccccaaccatggagggagcatccccattgtttttacatttgtgtcttacaatctgcaacctattctatggttgctctagagcttatttaaagagtccactcttaattatatctgggttgtttccaaccatttttattcaaacagtaccataatgagtgctctttacctgctatttaggttggtgcaaaagtaattgcggtttttgccattaagagtaatgtctctaaatttttgccattaagaggagtggcaaaaaccgcagttacttgcaccaagctaatatttcacctgtgtgaaagtctatttactcttctcttcaatgtccaaattacaatagtactagctgttcccaagcagatcttcatttcttcttagattcccttccccaaatcctctgagtatcccaaggcaatgctacactttttccacaaatctgtccttgggtttacttgccaccaatcctctgttcagacccttatgcgattgtgagcgagacccatcttgccatgttgagtctggctttccggagctcatgtccccttctctgcttctctctgccccaggatgctcctttaattactcccagcacagctaagatcaggatgtggcatttaacaaaagttaactgaaggcatgggcatgatagaaggggattgtaatacagggcaaaaacccaagtcccgcacgcctgcacccatgcacactttaagcctggacgttgagtgactgcttcctggctccacaggcctcacctctctgtggtggcacccactggatgtctccactccttttccattggccttgatgtcctgctgctgtggcctcctcaagtgttctcagtccagattccaaactctttatggccctcaaaaaggaacacagttttccaaaagggaaatatgatctttagagatgttgctttgcccacagtgaatatagccatttaatttttttttgttttttagagacaaggtctcgctctgtcgcccagggtggagtgtagtagagtgatcacggctcgctgcagacttgacctcttgggctcaagtgatccttccacttcaacccccacccccccacccaagtagctggaactgtaggcatgtgtcaccatacccagctaatttttaagttatctgtagagatagggtctccctatgttgcccaagtctcaaactcctgggctcaagcgatcctcctgctttggcctcccaaaatgttgggattataggcattagccactgtgcttggcctcatttaatatatatatatatatttagatggagtcttgctctgttgcccgggctggagtgcagtggcacgatcttggctcactgcaacctctgcctcctgggttcaagcaattctcttgtcttagcctcctgagtagctaggattataggcacctgccaccacgcctggctaattttcctatttttagtagagacggggttttaccatgttggccaggctgttcttgaactcctgaactcaagtgatccacccacctcagcctcccaaagtgctgggattacaggcgtgagccaccgcgcccggcctcatttaatatttttaagtagagttgtttactcttcatttttgtgaccctcacccattctagaaaaaaaatcattgcttctttgatttggacatcagcaaactatagcttatggggcaatgcagtccactgcctgtttttgtatggtggaaattttgttttttctcattatataatatctttgatttgccgtgggcccacaaggcctgcaatttttcttacagaaaaagtttgctaacccctgatttgggagattgcaaaataaccactttaataagcattttataatacaaaggtaacccatctttcctcaaacgtgaatcccatgttctacctctagagacacaaactgctgtatcttcattttattttatttttgagacagagtctcattccgtcatgcaggctggagggcagtggtgcaatctcagctcattgcaacctctgcctccggattcaatctattcttgtgcctcagcctcctgagtagctggaattacaggagcgacaccacgcctggctaattttttgtatttttagtagagacaggtttcaccatgttggccaggctggtctcaaactcctgtgatctgctcaccttggtcccccaaagtgctgagattacaggcgtaagccaccatgctcggccacaaactgctgtctccttaaaagggtagtctttttttgtttttctgaggtggcgtctcactttatccccaagggtggagtgcagtggtgccatctcggcttgctgcaacctccgcgattctcctgcctcagcctcctgagtagctgggattacaggcgtgtaccatcatgcctgactaatttttgtatttttagtagagatggggtttcatcatattggccaggctggtcttgaactcctgacctcaaatgatccactttcctcggcctcccaaagtgttgggattacaggcatgagccaccatgcccatctgggcagtcttaattattcaacattgaacacaaactgggtttagattatatgaagaaactattactaatattttgggggtgcgaaaatactgcgggtttgtgttaagaaaattccccatcagagatacagacaggagatttatgagtgaactgatgtgatatctgctctaaaaatacagcgggaaaaaaatagcatgtgtgatgagatgcatgaaacaaaacgatggaatttgaacattttcctaataaaaaaggcagtctccccattcttgccaaagaaaaacagaaacaaatcccgatgtatgtatgtatctatctgtatctgtctgtcgttctgtctgtctgtctgtctatctaggaaagagacagagagatggaaatacaggtagatctatatatctgtatctctatatctatagatctatatctatatccacagatctatatctatatctgtatctatatccacctggtcctgcctcagccaggacagtccggtagagaggaaggcctgctttgtcttattggaaatgcctggggctaccaatccagactgcctgtgaacagggacacagggataacccacatggtcaagaacactgactaagtggacacacagactaagttgacagcctcaaccccaagaggagaggcagtggatttggggtaggtccctccttacagccacactggagggagtcggctctttagtatcaaacccatggaaacacatgcgcaggccttccatgaattaaagaaccccctccggtagtcagaatttcaattagtaagaaggtcatgttctagtcacagtcttgagggatgggaaatggaatcttcttgtttacattaaagttatttgcaaattagttttcatggaaaaccttgatgcttacatttttctgactttcccatttctcttatagctgcccagtcaggaatacttgataggacaatttctgtaattatgaagaatcaaacaccaacaaagaaggtttgtatgccttgtaagaatcactgtctcaatgatcatcttccattctgtgtaaaagtagtgttttcccacaattttgcactttctgtcttttctttttttctgtttttcttttttttttttttgagatgcagtttgctcttgttgcccaggctggagtgcaatggcacgatctcagctcaccgcaacctccacctcctgggttcaagcgattctcctgcctcagcctcccgaatagatggaattacaggcatgtgccaccacacctggctaattttttgtatttttagtagagacagggtttctccatgttggtcaggctgatctcaaactcctgacctcagatgatccacccgccttggcctcccaaactgctgggattacaggtgtgagccaccgcgcctggcccagttttgcacttttttaattagtgtctccaatatgggcatttctgtttttgccattagtactattttttttgtaatataatttacatttttcacagtacaaaaagctagaatatacagaaaagaaaaaatatataagcactcacagcaaataataaattctatagtgttaatatagtaccatgaaaaaaatctactttccaactcagtctgatttacaattttagtatgatggctacacatcatgtccactggtgaccggctacaaccgtgtgattcttgctgagtttgactacaaagcagagccgctagaaaccttcccctttgatcaaagcaaagagcgcctttccatgtatctcatgaaagctgacctgatgcctttcctgtattggaatatgatgctaaggtaagtgcactgcctggttcctggatgaggaaagggatttgtagcacatctccacccaaaggggatgcagcctcttttcttcattattagcagtgaccaagtgttctgtcttccatgctctaggccctcttttgctgctggataaataataatagtaaatcactttcacataccaagtactctatcatctgctaccttacttttttttttttttttttgagacagagtcttgctctgttgcccaggttggagtgcagtggcacaatcttggctcactgcaacctccacttcctgggttcatgcaattttcctgccccagcctcctgagtagctgggattacaggtgcctgccaccacgcctggctaatttttatatttttagtagagacgggtctctactaaatgttggccaggctggtctcaaactcccaacctcaagtgatccgcccgcctcggcctcccaatgtgttgggattacaggcatgagccaccgctcctggccccttacctttgtttttattgttatgggagaaaccaaacagtgagtaagagcacagactttggagtcagacctgcatttgagtcatacttctgctattagcatggcagaagtcattagcagtgtcattatggccattagcagtgtcatgctattagcatgacatacatagctgtgtgtcccagggaaagttctgtttaatttaattaaacactctttgtgtttaaatttctcatctgcaaaatgaaagtaacattgcctacctcacaagatggaggttaatgagataacacataaagaggcaggtacatagtagggattcaataagtaaatagagtaataaaaacgagtaattcctcttcctccttttttttttttttttggaggcaaagtcttgccctgcccgtggtgtgatctcagctcgctgcaacctccacctcccgggttcaagcaattttcctgcctcagcctcccaagtagctgggattacaggaatgcaccaccatgcccagctaatttttgtatttttagtagagacagggttttgccatgttggccaggctggtctcaaactcctggcctcaaatgatccacctgcctcagcctcccaaagtgctgggattaccggtgtgagccactgcacccagccactcttctgcattctaaaagctgatgacctcctttgacttttctaaacccatatgagagagaaatctgggtgtctacatcagtggtcctgaaccaagagtgatcttcctaccccttgctgccccagggacatttgataatttctggagacactttttggttgttacaactggaggggtgctacttgcatttagtgagcagaggccagggatactgctaaacgtcctataatgccaggtcagcccccaacagcaaagaattatctggtccaacatatcaatagggccaagattgcaaaatcctacagttaattatgaggtaatgaaagcagaaagagtagcagtttgcatgtagtagaggctttagacacatttgccaaattgagttagcacatccaggctcacacagcaagtctttgtcaaagcttaggaatggaagtaggttgtcccctcctagtcatgggatctctccaactcactagacaatcttgctttacgtgctgatgaacatgctctgtgagcagcctggcttccctttcagcatcctcctgactgaagtcgccccatctctcttgctgcaggtacatttttttgtgttatttcttacaggggttactggggaggaccagcgtttctgcgcaagttgtttcatctaggtatgagttaaggatggctcagcacttgctcatcttggatggcttctgggccaaaactgcagtcactgaatgaccaagagcagcacgaaggacttggaacctatccttgtaaagagttccttgatgggtaatggtgaccaaatgcctcccttttcagtacctttgaacagcaaccatgtgggctactcatgatgggcttgattctttgggaataataaaatgaaataatacttttattttctgaataaaagtttgtcactg

SEQ ID NO: 38267 - DNA, 3977 bp, Homo sapiens
gccccgcgtcccagccatggcgacatcctcggccgcgctgccccgaatactcggcgcgggtgagcgcgcgcttgcgggaccctggggaggagcatgcgaggaggatgcggaggggcgcggggacccgatggagcggcggggacgtggaggggacccggggcgagcgcggaggggactcggggagggcgcggggacgcggaggggacccgttagggacgcggaggggcccgttggggatgcggtggggagcgggcgtggtgcattcgggactcggcgccaggacctctatctacttccccccaggtgcccgggccccgtcgcgctggttgggctttctcgggaaggcgaccccccggcctgctcggccgagccgcaggacgcttggaagcgcgacggcccttatgatccgcgagtcggaggacagcaccggtaacactgggcgcccagccgagttgggtgggaacgaggagaggccggcagccgcgggggatgcgaaccctagaggggcctgggcgctgcacgcggtcgaaactgcgcgctccgctgggctcctcccactcccgtgctcgccgccgctcggtcctgcctgacgtagcacagcgggctgaggccaccgcctcaccatggatagggtgagagggagcgggcgggccagtggttagcacaggcttcgctccctaggggggtgtcactggaccaccgaggcccggagccccgagctcgcccaggcgggcccaagtgacctgggggcactgggcttggagtctgcccaccttgctggactcctgatggggactttctggctggccacctgagaccacaaggcggggaggtgccagaaagacctgagcaacccgctgggcccctctctttttctcctctgtcttccaagtaagaccaagggacggggttgaccaggttcgaccaggcttacccaggagcaaggtcgggatcagaacctggctccagccctctgtttcctgaaaaggtccctgtgcttccaggtctttcctggggctgctgggctcccggctccccacctcggtgtcacagaaggcacttgggagcaggggtgggcgggaactgcgctctgcctgtctctgctgccaccggtgggagacgcagcgtcgctcctcctccctgccgtagatttcaacgacaagattttgaatgagcccctcaagcactctgacttcttcaatgtcaaggaactgttttccgtgagaagcctcttcgatgcccgagtccatctgggacacaaagctggctgtcggcacaggtaggtgacacccccatctgagcccggggcggttcccaggaggaacctgggacctgctctggttctagggccacttttgaactggcctatgtcagttttaggtgattacagccccatcctcctccacatgggaatacagagccccacagagaagcaggagtttattcctcagcttggcggacgctcttgtgtgccttggtgtggcgctcacagcccttgatagggcaggcctgctgggggttgcaggactccacgggttcagaaatggaaaggctgagggcagaacctgtaaggttggtccccccggatcgggctgggccttctgggctgcggggaggaggaatgactggtcctgtattctcacatggtcattttgactgctgtggggggaggggatgggaggggcaggtgggaggccagggaggaggttggtgtgggcgttcagggtgaaggtggcggggcttaaatcgcagtagcggaagagctggagcagcaggtggacatgaggcagcagggcagagccagtgggccttgggctggggtgggaggtggctggggccgaagggatcaaacacctgctcttcgggtggagcctggtactggttactgagatggtgaaaaccaggggagacctgggggacatcacaagcttggttcctaccaggtatgaaccctttgctgccccagtggagaggtcacacggttaccaggagggatgggcctgggcccagggagccatcagcatcgggggctggcaggtgtttccagagcatcggaaaaggaggtccaaggtggagccctgggtgctccagtgtttggagtcagtgaagagggacagccgggggtaggggagatgtggttctctgttgatgctgctgagaagtgaattcaaggctgtgaccttggcaagatggaggtcgccagtgccttgatgggcagggttgcttgagaggaagggacagaacccagtgggagtagactggaggtgaggacctgggaaccgcaaatgtggatgactcgcctgtcacgcaccgagaggcgggggtgtctcccatgccccgcttttctcagcccaggccagcagtggtccagtgctttggatcagggttccccgcccaggcttggccactcctgccctgatcccttaatgcttttggcccagagcaccccgctaagtccaaccccagaggggcctcatccgcaaagcctcgggaagaggacagtgacggaggcggctgccctgtgagctgcacggggcagaatgtccttttggcgtcatgttggatgtccacacatccatatggggtcagttctattaggattccttcgggaagaggtagagggtaggaggggttaagccacgagacgaggcatgcagaggggtggcctggatgggtctgcactgctgtccatgcacacggggagcgttgcaaattgtgcttcccagcccatagtgcccccacagaggagcccgggagtccctggtgggcgtctgtgttcctgcaaggagccagtggagatggccccgtgaactctcatcccccttgccttggtggggtctctggcaggtttatggagccgtacatctttgggagccgcctggaccacgacatcatcgacctggaacagacagccacgcacctccagctggccttgaacttcaccgcccacatggcctaccgcaagggcatcatcttgtttataagccgcaaccggcagttctcgtacctgattgagaacatggcccgtgactgtggcgagtacgcccacactcgctacttcaggggcggcatgctgaccaacgcgcgcctcctctttggccccacggtccgcctgccggacctcatcatcttcctgcacacgctcaacaacatctttgagccacacgtggccgtgagagacgcagccaagatgaacatccccacagtgggcatcgtggacaccaactgcaacccctgcctcatcacctaccctgtacccggcaatgacgactctccgctggctgtgcacctctactgcaggctcttccagacggccatcacccgggccaaggagaagcggcagcaggttgaggctctctatcgcctgcagggccagaaggagcccggggaccaggggccagcccaccctcctggggctgacatgagccattccctgtgatgttcactctcctcccaaagcaaaccacagccaagcctgtctgagctgggagtccccttccccagccctgggtcagcggcatcctcagtcgttgttacttactcagctgatgtcacagtgcagacatccaccgttccaccacagaaccagtggctgagcggaccaacgttgccatgtgcgtttgctctgtggggaacagagcacagagggtgagcgacatgtgcagaacggccccttggctgcagttaggacctcagtggctggtatggccaagctgctagaagatgctgctgtccctgtgatcccagcagccctcccttcaccgtgacccctgacctttgtcaggaaggtgcagtttttcttctcaatctaaatgcctttcaggtgggccgcttccttggctacctggttccagggggctgttttgtaatgagatgctgctggcaggccactcagaggctcccagctgggttggtgggacagccaggccagatgacctgattccagcaaaaataaaactcagatttgggcaaaatga

SEQ ID NO: 38268 - DNA, 34907 bp, Homo sapiens
agcccgaactgaggcggcggcgggagcccggttggcgtctggtcttcgcgtcggccccgcggagccagacgctgcccccggcgcggggagaagatggtgcctagcggcctcgggcccgccacgcgccgccacgagtgagcccagcgcgaccgcgggcgtccgccgagcagctggcccggctgggcccggggcgcgcagctgcccgccggggcggggtgagccggggctggagggcgggctggggtcgggcccagtcggggctgcccgcggggccgggagcggggagcgtgctggtcgggagcggctcctccgccggcttttttcaccgcttctcagggtgcagaccccgccccaactgctggcgggggtcgcccagcatcggccgacctcggcctggtccccccacactggggtttgcccactcgcgtcccccgagccagggttccctgccggccttggagatggcgggacttcccacgtctggagccgaggcctggataattcggatttggcacgggaaacatcttggtcgtttgccatttttcggctttggggagtgtttgcgtttcttctccgtttggcagtgaaacacatctcagaaaggtgggagggagagactcacgtacgtccacaaagttaaatggcatagtggtgttccctgtgtcaagcttggtaaatatccggaatggggtggattctttcttcatgtttttaataaaatgaggagtgatcgcaaggtaatctagaggcatgtagtttcagttcccttgatggggaccatcagaaataaaaccaggcttgttgtgctgttttgagtcgtttgaacgccgtacccatcggacagctggtgaggaggcctttgtggaagaatctgatgtctgagtttagttctcaactagcaggtgacagccctcactggctgatgaatggtgagcttctctgaagcctgctttgtaaagattgtggcttccgcctgaactgcttctttcctgcctcaaaggtgagccgctacgggagggaatgggaagaaaaactccgagactgctgatgaatatgtgataaagtggtttgtctcgatagcaccatcagcttgggtcagcttagggtctcagcatgtgtatctcatttgtagatgagtgttccatcagcgcttgaccgataagggtgtccatctacttcctcttttcatctagggattctgacaggaaatagacctgtcgcgcacctaaggtatacttaggtgtgcattgaccctaagtgcatttactctctaggattaaggatttggagtttcaacttgtagtgaagattctgggagaattcctgtggcctgaatcaggtggactggaatcactgctagcaccggagtctcaatgctaaaatcaccaaaggctagttaactggcaccttctccgtttaggctctagctgcatctgtggcaaggaggaaaggtagattatatatatatatgtttttgagacagagtctcactcttgtcgcccaggctggagtgcagtggtgcgatctctgctcactgcaacctctgcctcccaggtccaagcaatcctcctgcctcagcctccctagtagctgggattacaggtgcccgccaccatgcccagctaatttttgtatttttagtagagacaaggtttcaccatgttggccaggctggtcttgaactcctgacctcaggtgatccatcctcctcggcctcccaaagttctggaattataggcgtgaaccacccgcacctggcataagtgcgaatatattaatagtttctgcctgtaaggaatgtacttagaggaagcaataggctagaaaatgtggcaggactgaattgccatagtggtataccaactgttcaggattttgttatggttaggatcagaaactaacttttttttttttcttgaggcggagtcttgctctgttgcctaggctggagtgcagtggcgcgaagttagctcactgcaacctctgcctctcaggttcaagcgatttttctgcctcagctgcctgagtagctgggattacagttgcctgccaccacgcctggctaatttttgtatttttggtagagacgaggtttcatgttgttggccaggccttgaactcctgacctcaggtgatctgcccaccttggcctcccaaagtgctggaagtataggtgtgagccaccttgctcagcccgaaactcgtgaagtaaactttgaggtggacctagaaagatcaagaggatttgggccattcagaattagctgggaaatgaaaaaactagggccagttggtggacaagcacccaggctaggtagctggacaatcagtgcctagaaatattggcagaggcagctagttaagggttaaatgcttttctaagaaagataagcataagctacccagtctagtttctcgtagatttctgggtttttttgtttttgttttctttgagatggagtcttgctctgttgcccaggttggagtgcagtgacgcagtcggcaacctctgccttctgggttcaagcgattcctcagcctcctgagtagctgggactacaggtgcatgccgccacacccagctaatttgtgtatttttaatggagacagggtttcaccatgttggccaggctggtctcaaacccttgacgtcaagtgatccgcctgcctcagcctcccaatgtgctgggattacaggcgtgagccaccaggcctggcctttggtttctaaagaattgttttcatttaatgagtttgtcttgttctgtaagaggccgttggcataaaacaatgcttaacttattttattaaggacaatgaaaaagatgctgattgtcattcctgtctggtattgacaatcaggaaattaaatttgatgtctgtgagttgtttcagtgcctgtgttcagtttgcaggagcacagctctagtctggtctctgcagctctggctacagccaaaggataaatggcaagcccttcagtcctctccagagggtttttagtgaaatctggtccatgtcacagagatggtgtgtttcccttgcccagtactgaagaacctttgaagccattcacacaggatgccatgtaattgctctagatgatatgactgatctcaggacctcactggcctcagccttagcccttattttattttattttatatatattttttgagacagagtcttgctctgtcgtccaggctagagtacagtggcgcgatctcagctcactgcaacctccgccttccgggttcaagcgattctcctgcctcagcctcttgagtagctgggattacagatgcccgccaccatgcctggctaatttttctatttttagtagagacagggtttcatcatgttggtcaggctggtctcaaactcctgacctcaggtggtccgcccactgcggcctcccaaagtgctgggattacaggcatgagccaccacacctggccttatttttatttatttatttatttgagatggagtctcaccttgttgtctgggctggagtgtagtggcatgacctcggtcactgcaaccttcgccgcccagtttcaaacgattcttctggctcagcctcccgtgtagctgggactacaggcacgcaccaccacgcctggctaatttttttgtattttagtagagatggggtttcgccatgttggtcaggctggttttgaactcctgacctcgtgatccgcccgccttggcctctcaaagtgctgggattacaggcgtgagccaccagccccggccctattttttaattaaaaaaaataattattacgggacagagttttgctctgttgtcctggctggagtgctgtgggtgatcatggctcactgcaccctcctcctcctgggctcaagtcatactcctgcctcagtctcctgagtggctgggagcacagatgtacaccaccacacctggctaattttttgattttttgtagaggcaaggtctcactctgttgctcaggctggtctcaaactcctgggcacaagtgatcctcccatcttggcctcccaaaatgctagcattaaaggtgtgagccacccaaaaataactgtattaactatatttaccacactgtgcaatataactcaaaaaagaaaaaatatattccttttctctaacggactttgtaccctttgaccatcatctccctgttccccaccccctgcttctgtaaccatagttctgctctctgctgcaatgagttccattgtcttctagattccacatataagtggaatcctatattgtgcttctatgcctggcttatttctcttagtataacgttcatcgcttctgtccatgttgtggcaaatagtgctgcagtgaacagacatctctttgacaatctgatttcaatttggggtagtatatattcagcagtgggattgctggatcatgaaataattctatttgtagttttttcttttttttttttttggagacagagtctcgctctgttgcctggattcaagcgattctcctgcctcagcctcccgagtagctgagattacaggtgcacgccaccacgccacgctaattttttgtatttttagtagagacagggtttcaccatgttggtcaggctggtcttgaactcctgacctcataatccacccgcctcagcctcccaaagtgctgggattacagacgtgagccaccacgcccggcctatttttagtttttaaaggaatttctgtgctgttttccatcttggctgtactaatttacattcccacagtgcatgacggctcccttagctccacattctcaccagcatttgtttttctttgataaaagtcatcctgacaggcgcgagatgatatctcattgtgattttaatttgcacttctctagtgattgtgatatgttggccaactatatctgttggccatttgtcggtctcttgagaaacatctgttcgtgtcccttgcccattttttaatccctagggatttggagaagctacttgcaaaccatacgtctgaaaaggggttaatatccaaaatatatacaaagctcaaacaactcagtagcaagaaaacaaaaaatccaattgaaaaatgggcagccaggcaccgtggcttacgcctgtaatgccagcactttgggaggccaaggctggtggattgcttgaggtcaggagttcgagactaacctggccaacatggtgaaaccctgtctctactaaaagtacaagaattagctgggcgtggtggcacatggttgtaagcatgcttacaagctacttcagctactcaggaggctgaagcaggagaatcacttgaacctgggatgtggaggttgtggtgagccgggttcgcaccactgcagtccagcctgggtgacagagcaagactccatctgaaacaaaaaaaaaaaaaaagaaaagaaagaaaaatggacaaagaaccttggcctttctttaaaatgaaaaaacagaaaggaggaaagatagaggttttagcaaattgaattttcatttagattgatttcgaacatggaaatccttaagttaactttctcatgtacgaatcaaatacatttgacaagaggtctgtagtgttttttctgcgtgtgattacatacctgagtgtgatcctggggagtacatgacacagccttcgaaacactgccgtttggacttttgtgttgtttggttacaagtgctgtttttcaaacatgtcccagtcttacacactgagtttggttacagaaaggtttcatactgaactattagcttttgtttgatcttggcatccctcatgacttgttttcttaaaaattaagccccagattattaaattttaatatgggagtacttttaattttggtgtttaagatggttggcaattatttaaaaaactaaagaacaaagataaattattttccatcttgagactgtagtgaatttttttaagaagcgggggggttgaacgttaccatggttttatatcatgattttgaaaatggaacgatgcattcattaacaaccgtaagtgaggagaaataaacgggaagtctgagttttagaagtaagtctggttccagacatgtaattatgtcagcctacattcctttccttttgtctttatgagactactgatgttgcctaaactacacgtttagcaactaaaactatgctttctcttgtaatttcttatttgatcttttttttttttttgagacaaggtttctccctgtcaccgaggctggagtgcagtggtgtgaccatagccgtggctcacagtagccttgaactcttggactcaactgatcctcctgccttgccctcccaattagctgggactataggtgaaaccatgcccagctaattttttttaatttgggttttgtttttttttttttttagggacggggtctcactgtgttgtccaggctggtctcgaactcctgtgctcaagtgatcctctgaccttggcctcccaaagtgttgggattacaggcatgaaacaccatgcccagtctctctttggttccttttaaacgtgagttattgtgaaagtctgttctacactgtgaattgtatcacattaagaaacaagacactattggcagaagactgtgccagtctttgcttcatactcttaactgatgaatgagtgctgagatgggaggaatcctgctaaagaaatggaaaataggctgagcacggtagctcacacctgtaatcccagcactttgggaagccaaggcaggtggatcacctgaggtcaggaattcaagaccagcctgaccagcttggtgaaaccctgtctctactaaaaatacaaaaattagctaggcctgctggtgggcgcctgtaatcccatttagtcaggagtctgaagcaggagaatcactcgaacccaggaagcagaggttgcagtgagctgagattgtgccattgcactccagcctgggtgatgagagtgaaactcagtcttgaaaaaaaaagaaactaagttaaacattttaaacttcaaaaaagttgatctcttacttgtgtctttgttaaaatcagtgactaaaatgcactttgtatatctatggcatgtgagttgtttttttttttcactttggcatttgacttgaaactgtcttatcaaccttggcattgtgattgatagcatggcttttggggtcagatgaattaagtcagaatccatttctgccatttatttgcagcatgacctagtacaaattacttaagctcatttgcttcagttttctcatctgtaaagtgggaatagtagtatctatctagcagtgttgcaaggattaaaaaatatgttaagcgcttggcacggtgcctgggaatggcatgttctaagtggtagctgttaagaatgctctcttctcactccttcgtccttgtcacctggtttttgcctctatcaccctagtgaaaggggttttgcttacatcactattgatgtctcgattgcaaaattatatggatgcttttctgccttttctcatttgatgggattgactcttaaaaaaattttttttttcctttttattttcattttttgagatagggtttaactctgtctcccaggctagagtgcagtggtgccatcacagctcactgtagcctcaaactcctgggttccggtgatccctccacctcagcctcccaagtagctgggactacaggtgtgcaccaccacacccagctaaattttgtattctttgtagacacagggtcttcttgtgttttccaggctggtctcgaattcctgggctcaagtgatcggctggcctcagcctcccagagtgctagaattatgggcaggagccattgtgccctgccagattgacttctttatgcaaacctatatcatttattggaccgaagtagaacttaatggttaatgcatgggctctggaggccaactggatttgaatccaggttcacttcccgtgtgatcatgggcacattagctgacttctatatgccttaatttccgtatctgtaaaatagagatgttttagggatcatacacaataggtgcaaaactcttagagcagtgcctctctcaaaaagtaggcaatgacggtagacgttattattgttaagcaccttcctggtgtcaggcactgtccaaggtaggaggaatgcagaaacaatatcatggaaatgagagacaaattttttttttttttttttttttttttttgatacagactcttgctctcgtgcccaggctggagttcagtggcttgattttggctcactgcaacctccgcctcccgggttcaagcgattctcctgtctcagcttcctgagtagctggcattataggcgtgcaccgccatgcccagctaatttttgtatttttattagagatggggtttcatgttggccaggatgctctcaaactcctggcctcaggtgatccacctgcctcggcctcccaaaatgctggcattacatctgtgagcacccggctcagacaacaatttaatttggctgagggtgcagggaggcagtgtcagtggggatggagtgagagctgcccttgagagacacttaaaatgtggaaacgataggacttggtaactggttgtaggagagccagagtgtcaaggatgactggcaggagctgggcgcagtggctcacgtctgtaatcccagcatttgggaggctgacgcgggaggatcgcttgagcccaggagtttgagaccagcctgggcaacatggcaaaatcccatctctacaaaaaatacaaaaattagccaggagtggtagcatgcacttgtagtcccagctacttgggaggccaaggtgggaggatcgcttgcgcccaggaagtcaaggcggctgccatgctcataccactgcactctagcctgggcaccagagccagaccctgtctcaaaaaaaagaatgactggcagggatcactaggtaaatgacggtgtttttccttagggaaggagccagtttggtgccttgggataagttttggccttgatggcctttgggtcatctaaggagatagctccagtaggtgactgtttggatctggaggtgagtaggtacataaaatgggattaaggcatgaatgagcgtgtcccccttgagcagaggccccagctggaacttgggaacaccagcttttgaaggatcctgagaaggaaggggtggccagatgaatgttaagaaaacccggagtggaaactgggagaggatccaccccacttctgtatcagatgctgcagcaacatgagttagggactggagctccagctttggacttagcagcccagagattactggagaccttgaagttctcctgtgtcttcgttgcttctcacttgtctctctgaaggttcattctgcctgcactgctttgcggtggggcaggaagatggtttctgcgcagtgcttggggcagctgggtgctggagcttgcacagggtttctttgataccagtaagtgtcttcagctctaagtgttggataatctggcatcgcatcgatgactgttgtttactaggctcagggtttgtaaccccggccttaaagctctttgagggtctcagacatcacaggatatttgagaaatgctactttctgctacatgaaggtgagtttctgtcattctgtcttagcacaagtccgatgtatttcctttggttggcgtagagagcaggcttgcttctcccatcctctcttcctcaactttcagaaacttcccatttaacctaaggtagaaaatctcatttaagatgaatggtgggcctggtgtggtggtttgtgcctggaatcccagcactttgggaggctgaggcaggtggatcacttgaagtcaggagtttgagaccagcctggccaacatggtgaaaccccatctctactaaaaatatcaaaattagccggacgtggtgatgtgcacctgtagtctcagctatttgggaggctgaggtaggagaatcgcttgaacctgggaggcagaggttgagcagagatcacactgctgcatgccagcctgggtgacagtgcgagacaatatctcaaaaaaaaaaaaaaaaaaaaaaaagaacagtttaaaactacaataaagttagtttaaaacttggacaagtagccatgtgtacatatgcgggctttggagagagggagaaactgaaaggcttcctgtgtctgtggcataatgaatgttaacttactttttttctgataaaatgttattaagttgcaaaattacattttttttttccaccatgttggccaggctggagtgcagtggcatgatcatagctcactatagctttgacctcctgggctgagccagtcctcccacctcagactcccaagtagctgggccattggtgtacaccaccatgcttagctaatttattaaaaaattgttttttgtagagacggggtcttgttgtgttggccaggctggtttctaactcctggcctcaagcaatccttccatctcagcctcccaaagtgctgggattacaggtgtgagttattgtgcccaaccaggaggccttcctccttttttttttttttttttttttttttttttgaggcagagtctcgctctgtcacccaggctggagtgcagtggtgctatctcggctcactgcaagctccgtctcctggattcatgccattctcctgcctcagcctctcaagtagctgggactacaggcgcccgccaccacacctggctaattttttgtacttttagtagagacggggtttcaccatgttagtcaggatagtctcgatctcctgacctcatgatccacccaccttggcctcccaaagtgctgggattacaggcgtgagccactgcacccatccggccttcctcctttactagctgctttcctccccttatattaggttggtacaaaagtaatcgtggtttttgccattatgtattggtgaaaaccgcgattccttttgcaccaacacaattaactgtgtttttgttaactcatgtaataaaaagtaagcatctcctcccacacctctccctttcacctgaactagtagtgttttgaaagtttataacacagtcttttcctggccacccttaaggaacttgtgttcttgcaacctgtgggttgcttgaaatattatcagggtaacctggatattgccttttgcttacgtaaagcgccttctgttggttacctgttgcctcagtttctccatccctgttctcacctcgccagatggaggattgtgcagagcacagttttccctgagaacttttttttttttttttgagatggagtcttagtctgacacccaggctggagtgcagtggcgtgatctcggctcactgcaacctctgcctcccaggttcaagcaattctcctgtctcagcctcccaatagctgggattacaggcgcacgctgccactcccggctaatttgttgtatttttagtagagatggggtttcaccatgttgcccaagctagtctcgaactcctgagctcaggcagtccacccgcctcagcctcccaaagtgctaggattacaggcatgagccaccgcgcctggccgattttatttttttatggcaactgtatgtgatattttaagatcctgtgggtgttttgtttgtttgttttgagacagagtctcactccatcacccaggctggagtgtagtggcacgatcttagctcaattcaacctcccaggttcaagcaatttgtgcctcagcctcctgagtaggtgggactacaaccacgcgccaccacacccggctaattttttgtgtttttagtagagacagggtttcaccatgttgccctggctggtctcgaactcctgacctcaggtgatccgcctgcttcgacctcccaaagtgctgggattacaggcgtgagccactgtgcctagctcccgctttgttttggtggttgtgggggataagaactcactctgttgctcaggctagagtgcagtggcgtaatcaatcatagctcactgccgcctcaaactcccaggctcaagccatcctcctgcctcagccccccacgtagctgggactatggacgtgtgccaccacgcccagatcttgtgtttttgataggtacaatactggggagaaatcctgctttattcagttgtcccctgctattgttggatatgtagttttccattttttaacaattgcaaacactccaaaaataactctgagtagttaaatctttggagcaatgggtgtttccttaggtttagttcttagaagtagaatgttggagataaaatatgccagattttaacactattgatatgtatagccaagttggtttccagaaagtttataacacagctgtttccacgcccctttttaaggaacttgtgttcttgtaacttgtgggttgctagagatatctttgggataatcttggtattgccttttgcttgcttacagtgccgtctgatgtttagcgtcttcactgagttagtctcagagatctaaggtactgtgctgatagattttcatcacatgttctcacgtgcttgtgaatttgccttttggccatgttcagtgtaccctaaatccctgaacttttcagagaggcagcttcccagcagtggtcatttctttcttcatcttggtcaataccaggatgccctaattggagttggaatgaatttagcgggaggggtcaaatagtgtgctttcttttatctctttttctttttttttttcctaaacagaacttaatttattcattaattaaaactaacatttgccactgtgacgcttacagaaattttctcgtaactctttgcagaggggatacatttatttagtcttcattaatttcctatttgaaaacgcttgtgaatggtagaaaggaattttaagtttgtaaaatgtttggaatcttaatagttttattcaagctttcttttattattattattattttattattattattattttgagatggacttttgctcttgttgcccaggctggagtgcagtggcacaaagtcagctcactgcaacctctgcctcctgggttcaagtgattctcctgcctcagactcctgagtagctgggattacaggcacacgccgccatgcccagctaatttttgtatttttagtagaaatggggtttcatcatgtcagtcaggcagatctcgaacgcctgacctcaggtgatccacccgctttggcctcccaaagtgctgggattacaggcgtgaaccactgcgcccggtccattctttcgcttttttagtgactataattgtcctgtgctggaagtttccctaaattaaattggcttatgttgacaatatttgccattttgtgggtatttctgttgatataattgtttaaattctggtgtgatgtgcttttaatgactattagttttccttgaagtgaattctaattcagatttttctactgttttcctgaatgtttcataattgtagttccaagtggtaagtgggtcctattcatttttatataaggctaaggttttgggccaggtgtggtggttcacacctataatcccaacactgtgggaggccagggtgggcgtatcactcgaggacaggagttcaagaccagtctggtcaacatggtgaaaccctgtctctacttaaaaaaagacaaaaattagccaggcatgttggcatgcacctgtaatctcagctactcagaaggctgaggcaggagaatcacttgaacccaggaggcggaggttgcagtgagctgagattgtgcccctgcactccaacctgggcgacagagtgagactcttgtgtccaaaaaaacaaaaaaacaaaaataagtttttgttcttgctcaataaattgaactctgatttactgttgacatttttatttatgaatcatattaatcttaacctaactagtgttgtttccagattattattgttattattatttttgagatggagtcttgctctgtcacccaggctggagtgcagtggcgcaatctcagctcactgcaacctccacctcctgggttccagcagctctcctgcctcagcctcccaagtagctgggattacaggtgcttgccatcacacctgtctaacgtttgtatttttagtagagacagggtttcaccatgttagccaggctagcctcaaactcctgacctcaggtgatccacccaccttggcctcccaaagtgttgggattacaggcgtgagccactgcgtctggccccatttactttaaatcatctctagattacagtacctaatgcaatgcaagtactatgtaaatagtttttatacttttttgaaacggagtcttactttgttgtgcaggctggagtgcagaggcacgacgttggctcactacaacctctgcttcccaggttcaagggattctcatgcctcagcctcatgagtaactgggattatagatgcacaccatcgtgcccagctaatttttattttttttagtagagatggagtttcaccgtgttggccaggctggtctcgaactcctggcttcaagtgatccacctgccttggcctcccaaagtgctgggattacaggcatgagccaccatgcctgacctcttgatttcttttttagattgctctctattggcacgtagaaatgctactgatttttgtaggttgtttttgtgtcctgcaactttactgaaaattggtctatcagttctagttttttgatggagtatttagatttatccaaatataagatcataccatctgcaaacaaggataatttattttattcctttccagtttggatgccctttatttcttgtctgattgctgtatctaggacttctagtactctgttgaattacggtggtgaaagtgggcatccttttcatgttccagatcttagaggaaatgctttcagtttttcaccattcagtgtgatactagttgtgggcctgttgtatatggctttcattgtgtgaggtatgatccttctaagcccagtttttttgagggtttgtatcatgaagagatatttaattttatcaaatgctttttcagcatcagttgaatggatcatatggtttttgtcctttattctgctgatatgatgtatcgctttgatttatctgcatatgttgaaccatccttgcttctaagggataaatcccacttggtcatgatgaatgatctttttaatgttttgaattcggtttgccagtatgttttggaagagatttacaacaatcttcatcagggatatctgcctgtagttttccttttttttttgatgtatctttggttttggtatcagggtgatactggactcctagcatgagtttggaggtactccctcttcttctgctttttgagatagtttacgtaggattggtattagttcttcttttagtgtttggtagaattcagcagtgaagccatcaggtcttggtaggttgtgtgtgtataggaattcatccatttcttctaggttttccagccggtgtgcagttgctcgtggtagcctgtaatgatcctttgaagtcctgtgatgttggtttaatgtctcctttttcatgtctgatactatttctttgaatcttgtctctcttttttctgacttcatctggttcaaaacaccaactctttgtttcattgatcttttatatttttttgtttcaaatttatttatttctgctctgatctttattatttcttctaattttgtgtttggtttgctcttgtttttctaattctttaagatgcattgcatgttgcttttttgatgtttttctacttttttatgtaggtgcttatagctataaactttcctcttagtattgctttcactggatcccataggttttggtatgttgtgttttcattttcatttgtttcaagacactttttaatttccttcttaatttcttgattgacccactggccatccaggagcatgttatttaatttccatgtgtttgtatagtttccagaattcctcttgtaactgatttctagttttattccattgtggtcagagaagatacttgatataattttgtattttttttaatgttttaagacttgttctgtggcctaacgtggtctatttttgggaatgatccatgtgatctgttaggtccatttggtctgtagtgcagattaagtcatttctttcttggttttctgtctagatctgtccaatgctgaaagcagagtgttgaagtctccagctatgattgtactggggtctgtctttccctttagttctaatatttgctttatgtatcttggtgctccagtgttgggtacatatatatttataattgttacatcatcttgctgaattgaccgtttgaccttctttgtctctttttatagttcttgtcttgaaatctatttagtctgattaaatatagctacttctgctctgcgcttttttggtttccatttgcatggaatatctttttccatttctttattttctttttttgagacggagttttgctcttgttgcccaggctggagtgcaatggcgcgaccttggctcaccacaacctctgcctcccaggttcaagtgatcctcctgcctcagtctcccgagtagctgggattataggcatgcaccaccacacctggctaattttttgtatttttagtagagtcagggtttctctactaaagaaactgactgttggtcaggctggtctcgaactcctgacctcaggtgatctgcccacctcagcctcccaaaatgctgagattacaggtgtgagccactgcgcccggttatttctttatttccatttgatgtgtgtctttataggtagggtgtgtttcttgtaggcaacacatcgttggatctggtttttttattcattcagccactgtgtcttttgattggagagtttagtccatttacattcagtgttgttactgataagtaaggatttactcctgccattttgttagttgttttttggttgttttgtggtcttgtcttctttctttccttccttcctgtcttcattttagtgaaggtgatttttctctggtggtatgttttaatttctttttattttttatgtatctgttataggttgggctttctttataggacagtgaaaacatttgaaaattgatagtgagggttgttgttcaaatcagtgaatataccaaaaatcattgaattgtatactttaaatgggtgaattgtatggtatgtgaattatttcttaatactattaaaaatatcaagaacctttctttttcttttctttttgttttcttttgagatggagtctcgctctatcgtcgaagctgaagtgcagtggtgtgatctcgacttgctgcacctccgccctccgggttcaactgattctcctgcttcagcctcccaactagctgggactacaggcacatgccaccatgcccagctactttttgtatttttcatagagacggggtttcaccatattggccaggctggtcttgaactcctgacctcgtgatccacctgccttggcatcccaaagtgctgggattacaggcgtgagccactgtgcctggcttctcaagaacctttcatatggcaaaagataccataaaccatattaaagaaaacccagacttggattaattatacgtaacatataaaactgttaaaggcttagtacccaaaacacaaaaggaatttctaaacatcaataagaaatagactaacaccctattagtaacttaccagaggattcaggcagttcagttaagattgggcctaaatggctgattaaaaaagcggaaagatgctttgtttcagggagataccatttaaaataatagagatatcatttcacatctgtctttttggaccatattaatatgccttaggaaatcaagtgttggcacaaatctcatggaatggagcaggctccttcactgctggggaagtgtaaactggttgatctccttggagagtggtctgacaatatcaggttgaagacaggccctactctgtgactttgttgtactacagccactcttgtacctgttgcaatgcgcttggtgggtgaaacagtaacaggaacccagctaggcccctcagactggaataactcaaccacagaacaattacatatatacatcagtgaaattcaacgaactagatcaacagagatcaacagagatgtcagaaaaacaatgttgagtgaaagtggcatggaaaatgtgttgctgttgatttttaggggctgttgatgcatctttttgtctctaaaatttaaacgctgatacagactttttaaaaaattgctttttgctaatgttgtcgcagtttgctcgtgtttataagtgctcattgtgtgccagctactgttctaggggccaggggccagggctgtagctgtgaacaagacaggcaaaatctccactctcactgggctcataaatgagggatgacagatagtaaacaagtaggaaaataattgtgctcttggttgatgctaaacaatataaaggaaataaagcaggggctgagggtgaccaaggaaggtgtgcaaaatctccgctctcgttgggctcataaatgagggatgacaaacagtaaacaagtaggaaaataattgtgctcttggttgatgctaaacaatataaaggaaataaagcaggggctgagggtgaccagggaaggtgtgctctgaggagctggctattaaacagagacttgcatttttttttttaattgagacagtctcattctgtccctcaggctggagtgcagtggcgtgatcctgtcttactgcaacctccacctcccaggttcaagtgattctcctgcctcagcctccctagtagctgggattacaggtgtgcaccactatacctggctaatttttgtatttgtagtagaggcggggttttgccatgttggccaggctggtctcgaactcctgacctcaagtgatccacccgcctcggcctcccaaagtgctgggattacaagcatgagccactgcgcccagccatagatgtgcgttttaagaagagcaaacgtggaaatgtttggggaaagcatccaggcagatacaaaattcttcagctacatcatggtcaaaaatggcaggaagcattaaatacttatgaataaacttaataaaagaagtgcaaacgttaacactgaaaacagaaaacattattcaaataaggaagctaaatagatggaaaggtctgcaaggctctttgactagcagacaacgttgtttgttaagagagcagcactccccaaagcgatccacagattcagtgcagtccctgtcagtcccagctgatttccttgcagacattgacaagatgatcctgaagaatagcaagtccagtgtggccaaagcccaggagggaggaggggaagtggatggtgatgcagtcagggagactggcagggcttctgagtcctgaaaaccctgtgggccatgacagggagctattgccgacctctcctaggtctggtagaagccttaggagcttttaagcagggctgggatggctgtgagccatatggcaatgagcaggacagaatgtcgaataaatagaattcagcttttcagtggcaggaaatgagagcatcctcactttctttctgtacatgttgtgtatttgtgtcacattactgacccacctaaaccttttcttaagtgatacggaagtaacagtatttattatagaatatttagaagattgagtctgggtacggtgactcacacttgcaatcccagaactttgggaggctgaggcaggaggattgcttgaggctaggagatcaagaccagcctgggcaacatagcgagaccccatctcttaaaaggtaataaattagccgggcacggtggctcacgcctgtaatcccagcactttggggggccaaggcaggcagattacgaggtcaggagttcgagactagcctggccaatatggtgaaaccccatctctactaaaaatacaaaaattagctgggtgtggcggcacatgcctgtagtctcagctacttgggaggctgacgtgggagaatcacttgaacccaggaggcagaggttgcagtgagccaagactacaccattgctccagcctgggtcacagagtgagactccgtctcaaaaaaaaaaaaaaagaaaaaaaaaaattagccgggcatagtggtacacacctttagtcctggctactcgggaggctgaggtgggaggatagcttaagcctaggagttcaaggctgccgtgagctatgatcacgccactgcactctagcctgggtgacagaacgagagaccctgtttcttaaaacacacacacacacacacacacacacacacacacacaatatttagaagattcaaactgaaagagaatatgtattcaggatcctgccactttgaggtaatggcagttaacatttagtgtttcttccttctagtcttttgaatgaagttatgatccgacatttctcaaattcagtaatgagtgcccatcccacccagctcaccccccaacacctcaaaaggaaacaaaagaatcatagctttcctgttggcaagtcagtccttgaagcttctgattcatttctttcaggtggagctgatcagaataatgttcagcatcaaccccctggagaacctgaaggtgtacatcagcagtcggcctcccctggtggtcttcatgatcagcgtaagcgccatggccatagctttcctgaccctgggctacttcttcaaaatcaaggagattaaatccccagaaatggcagaggtatagtatgctctgacttctcccgggctggctggtccttgtgcagtggggcaacaccctgtggcttgccatatagctttcttgggttttggcctttctctcctagtgagaaaaatcagtatttattcagaattttctgttttccatctccccaggactcactttgttaggaaatacctagatgggtattgttcgatttaaatatgctaccagtttcagttagactattttagcagtgaaacatgcactttggagagtacatttgtaaaatgatctgtgtcaaaaagctggagacctcacctctgtaatattccatctcaaatgggttcattgctgttttagaaaactgaacatttggtattttaaaaccacatatcatcatggagttttatcagctatactaatggtttttttcatgagataagaaggaatcctaaagaaattcaaaaacaggacctaatttccaaatatatttgttttttgttttttgagacggagtctcgctccgtcacctagtctggagtgcagtggcgtactctcagctcactgcaacttccacctcccgggctcaagcgattctcctgcctcagcctcctgagtagctgggattacaggtgcctgccaccacgtctggctaatttttgtctttttagtagagacggggtttcgccacgttggccaggctggtctcgaactcctgacctcaggtgatccacccatctcggcctccccaagtgctgggattaccggtgtgagccaccgcatccagcctaattcctgtcttttagtagattccttgggtgccttctcttattctatttccttcttcttgggtttgttggtgggtggaggtgggggtgggagtggggctgggagtgcgtggttgccgcattgagtgtgccttgcaatggagaggagagttgtgttccatgtaattgagatcgtagctttctctcatgctctagggcattctagatcttaagtgatcttggcaaaaggaaccgcctacacatgtgagctctttctagcacagttcaagtaacgagttttagctatttctaccatgtaaccctttcaaagagtttattactaagagacatactggctggcttaattctctctcttttctgaccctgcctcaatctttaaaggttgtgaaaacaggctgcccccacatcagggctgaaaatgaatattctactcaaaactaaagctgcacagcctcctgccatttctttcccgcagagcttgagtccatgttgagcacttggccaaggccagtggttgcactgaagcctggataattagcccttaataatccaaattaggcctggcattggctttagccagctgttcaacgtggactccagctctgtaggaacgcattgttgagatgctgcggaactttggttatgattagtttcgtgatttttgttttcaaatgaggatcctaggttgtaggaaaggcagtggtgtatgggaaacatttggggctgtgaatcagaacttaatgctgattttaccttgaactagaattggagagtccctaatttgccctgggcctcagtttcttcatgtctaggattatgaaggactgagactagaatgttcattttcaaccctaatgtactagaatggtcagttgagtttgtaggtgttagggaaaatgtaatttgatagatccagttgcagtcttactaaatgtcacatacagttaaactgatgctgtaagggtagacttactgggctgggtaggggttgctcagatgacttttttttttttttgaggtggagtgtcactctgacacccaggctgaggctggacttcagtggcgcgatcttggctcacttcagcctctgccccccttcaaacgattttcgtgcctcagccttccaagtagctgggattacaggcatgcgccaccatgtccagctaatttttgtatttttagtagagacaaggtttcaccatgttatccatgctggtctcgaactcctggcctcaagtgatccaccctgcttggcctcccaaagtgctgggattacaggcgtgaactaccgtacctggcctcagatggctttttttttttttttttttgagacagagtctcactgtgtcgcccagggtggagtgcagtggcacgatctcctctcactgcaacctccacctcccaggttcaagcgattctcctgcctcagcctcccaagtaggtgggattacaggcacacaccaccacacccggctaattattgtatttttagtagagacgtggtttcaccatgttgctcaggctggtctcgaactcctgacctcaaatgatccacccaccttggcctcccaaagtgctgggattacaggtgcgagccaccgtacctggccccttcctttttgaaatcgttgctgctctaaggtgtcatcaaaagtccataagaaggggggcagtgtcccaaatgagtattagtattcactgctgttttgtgttctagagaaagagagcaaggtgtatggaattgaccttttgggacattattttaaggtgactttatttaaagaaaagaattgtagttgcaaaatgagtttggattaatgcttttcttcaagcgttcttttcaagtttggttctgaggctagatcattttctctaagtgtaatatgctggattttttaaaaagattttcttgaataaattgatttgatttcacagtttattgagtatcttgtgccagtgaagagttcatattttaggttgtgaatataaaagtgattaggaaagccacatcatgctgcctgtgaagagggtggtggccgagttgtcatgatcttaaatgatcagctctgaattgtagtttgctgatgtgctgcggtgccacactggggtcttacctgtattcccgcagtgggagacaggcgctgcttaacacccatttctctttctttcactttcccaaaggattggaatacttttctgctacggttcaatgatttggacttgtgtgtatcagagaatgaaaccctcaagcatctcacaaacgacaccacaactccggaaagtacaatgaccagcgggcaggcccgagcttccacccagtccccccaggccctggaggactcgggcccggtgaatatctcagtctcaatcaccctaaccctggacccactgaaacccttcggagggtattcccgcaacgtcacccatctgtactcaaccatcttagggcatcagattggactttcaggtatgcagtagccactctccactcaggctccttaggcaaccactgttacaaaaagaggatgcaccgtgtatgtttttactgactatattgtactagattgtagtcttgcgcgtgtcttttttttgttgagtttgaactacatgaaccatttctgttccatcgttacatggtaaagtacctggctagaagtagtttctcaaaagcctgtaggaatgagaaactgtgagaaaactgttaaggcctgtctaatatttacaaacatgtaattttaattcaggcttgtcctgttggagttttcattacttactacacatcttctattgctattagtttacatattttttaatggccattgttagtctggcactgtgctaagctgctgggaagaactagaaaatgactaagatggctgggtgcagtagctcatgcatgtaatcccagcactttgggaggccgaggtgggtggattgcctgagctcgggagtttgagaccagcgtgggcaacatggtgaaaccccatcactactaaaatacaaaaaattggccgggcgcggtggctcacgcctgtaatccgagcactttgggaggccaaggtgggcagatcacaaggtcaagagtttgagaccagcctggccaatatggcaaaaccccgtctctactaaaaatacaaaaattagccgggcgtggtggcaggcacctgtagtcccagctactcgggtggctgaggcaggagaatagcttgaacccaggaggcagaggttgcagtgagctgagattcatgccactgtgctccagcctgggcgacagagggagactctctctccaaaaaaaaaaaaaaagaagtcagctgggcatgcaggcatggtggtgcgcacttgtagtcccagctactcaggaggctgaggcaggagaattgtttgaacccaagacgtggaggttgcggtgagccgagattgcaccactgcactccagcctgggcgacagagcgagactccatctcaaaaaaagaaaagaaaagacaatgcctaagatgggcccgtgcgcagtggctcacgcctgtaatcccagcactttgggaggccgaggtgggtggatcacttgaggtcaggagttcaagaccagtctggccaacatggtgaaaccccatctctactaaaaatgcaaaaaaattagccaggcgtggtggcaggcgcccgtgatcccagccactctggaggctgaggtgggagaatcacttgaaccctggaggcggaggctgcagtgagccaagatcatgccactgcactccagtctaggcaacagagtgagacttcacctcaaaaaaaaaaaaggcctaacatttggtctcttccttttggaattttggggttatggaagagacaaagataaacgtgagttaatgtttatcaagcacttacaatagttcctgccacaaaggaaatgctacgtaagtgcttgataagggatatgaaaaaatacatacttataaaatgtggagcactgccctttgaccagtactaaacccatgacagactgtaagtgttgcaggagaagggctagaaggcagtggaagctggaataatcaggaaaggcttcatatgggacacctgggccttggaagaataaccttttgttctttggttaccaaaaggctttttaaaaattgcttaggctagatgcagtggctcatgcctgtaatcccagcacattgagaggctgaggcaggaagattgcttgagctcaggtgttgaagcccagcctgggcacatagcaaacacctgtctttatgaaaaaattaaaaaaattaaccaggtgttgtggcgtgcacctgtagtcccagctacttgtgaggctgaggtgggaggattgcttgaacctgggaggtcgaggctacagtgagctaagattgtaccactgtactccagcctgggcaatagagtgagaccctgtctcaaaaaaaaaaaaaaaaaaaaacaagaaacaaataaaaagtccttcaaggaatttaagtgcccaccagcctcctattggctgttagaggtgagaatattcccataataatcaaggtatgggtgacttctgggttttccatgtagcaagtggacctgttgcttatggcatggcataaggacaccttcgggattttttgttgttattttgagatggagtctcactctgtcgcccaggttggagtgcagtggcacaatcttggctcactgcaacctctgtctcccgggttcaagcgactgttctgcctcagactcccgcgtagctgggattataggttcgtgacaccatgcccagctaattttgtatttttagtggagacaggattttaccatgttggccaggctggtcttgaacttctgacttcaaatgatccgcccgcctcagcctcccaaagtgctgggattacaggcatgagccaccacgcttggctattttttaattttaattttattttaatattttaattttttattttaatttaatttttatttaaaattttattttaattttgagactgggtcttgatctgtcgccaggctagagtgcagtggtgtgatcatagctcactgcagcctcaaactcctgggctcaagtgatcctccctagtacctgggaccacaggtgtgcaccagtacacctggctgatttttaaaacttttttgtagagacagaatcttgctgtcatgttcaggctggtcgtgaattcccggcctcaagcaatcctcctgcctcagccttctaaagtcaaagtgctgggactacagatgtgaaccactgtgcctggcaatacgttggttttagtttaagcttcatcacttgcctttcttaactctgaaaccctctgacctctgtttgttcatatgtaaaaggggaacagctgcacttcttcagtcatgttcatgggagagtagtaaattttaagtgaaataatacatataaaagatgtttgaaaatggctagacagctgtgcagaaatgctggggataattcacccagcccgagcttttcatctctgatctgcccgaggtctggtttggcatctccaggccatgtactggaaagtggccacttccttcgctgcttcgtggctctgagttgagtaggactcatggtcagggtcaggactgctcttcttcctcagatcccacaaaggcaggtgcctgggctgatagatgattcctgtgtgggtttgatttcaggatttatttgtatcccagagaatgacaagtacgtggttcttgactttataaaaaaatgatttctctttcataggcagggaagcccacgaggagataaacatcaccttcaccctgcctacagcgtggagctcagatgactgcgccctccacggtcactgtgagcaggtggtattcacagcctgcatgaccctcacggccagccctggggtgttccccgtcactgtgtaagtgtacccggcacctgatgaacgtgcgtaacaagctccacttgccgtgagtacggctgggctgcttcagctgtaaattctcaggatggctcacttcacatttctttatagaattatctctactcggacctatctaaaggattatttaatttgtctaaaggattatttaatttggaattctaaagatagaacttctgcatataaaatcagaaagttagtgccccctcgaggcagtaaaagcacctggctgttgttggacattcataggctgtctttcccgcaggagtagaagcagcaagttacagaaaagaggctcactgtggccgggtgccgtggctcaggcctgcgatcccagcactgtggaaggctgaggtgggaggatcacttgagccccggagttcaagaccagcctggacaacatatagggagaccctgtctctatttaaaaaaaaaaaaaaagaaagaaaaagaaaaaagaaaagaggctctctaaagataaaggttttcagccaggtgcggtgtctcatgcctataatcccagcactttgggaggccaaggtgggcagatcacctgaggtcaggagttcaagaccagcctggccaacatagtgaaaccccatctctactaaaaatataaaaattagccaggcatgatggcacatgtctgtaatcccagctactcagaggctaaagcagggaggcagaggttgcagtgagctgagatcgcgccactgcacttcagcctgggcaacagcaagactctgtctcaaaaaaataaataaatcaaataaaacaaagataaaggttttgttcatctccattatccagaaagatattttaaaatcgttgattttagtttatcttgattttagttttaaatcaagtataaatcaaaacttattttctgttaattaactaattttaaaatctaacattttaaatcatttcccattaaacagttactttaattttacctgcgaatttgaaaattagttttaaaatcaaatataaattgaactttattttccattaaacaattaaggtttttgaagcttttccttcagtgtttttgagcagcattcagtgttactgctttgcattttaggttttttttgttgttggttttttttggtctctcctgtctctataaaggagataattatctataaataaataggtgaaatacataagatatagcctatttaaaataattctatggtgaatcctttttaaataagaattatctcaggatttgtctattttagacatttggaggtttgtaggacaagatcagattaagttaaacattactttgtgttgcagtgactgatatagaattttgtaggtaaagcttccagttgtaactaagtgatatgctttgggctgggcgcaatggctcacacctgtaatcccagctacttgagaggctgaggcaggagaatcagttcaacatgggaggtggaggtttcagtgagccgaggtcacaccggcctgggcaacagagcaagactccgtctcaaaaaaaaaaaaaaagatgatatagtttggctgtctccccacccaaatctcgttttgaattgtagttcccataatcctcatgtgtcatgggagggacccagtgggaggtaattgaatcctggagattgttacccccatgctgctgttctcatagtaagagagttcccatgagatatgatggttttataaggggttttccaccttttatttggcacttctctttgctgccgccatgtgaagaaggatgtgtttgcttccacttccgccatgcttgtaagtttcctgaggcttccctgaccatgctgaactgtgagtcaattaagcctgtttcctttataaataacccagtcccgggtatgtctttatcagcagcatgagaaaggactaatatactaagagtttagctcatttgagaagataggcttaaaaggagcttatgtgctttgcatcacatgtgagaggactgtaggctgaattctgaaggcaaaaatccaacacccaaactcctaaatgtcaggcacctatttatttttctgttatatttttattttttaaaaaagaccctcaaactaaaatataatggtatttatctcaaagaagcatgaacgtgtaagttacatttttcctttccatgtgtgttgccgtgttcagtgttttaccagctgctgtgggggtgacacaagtgaatgactcaggccactgagcacgtgtctttcctcctcctcttctcctgcagacagccaccgcactgtgttcctgacacgtacagcaacgccacgctctggtacaagatcttcacaactgccagagatgccaacacaaaatacgcccaagattacaatcctttctggtgttataagggggccattggaaaagtctatcatgctttaaatcccaagcttacagtgattgttccagatgtaagtgagaaaaattgtgtgtgtgtgtgtgcgtgcatgcatatgcacatgtgtgcgcatgtgctgcaaccgttggtgtaggccctgctgacttccctgggtaagcgtatcctctgccactttagatttccaggtgagttaggacactaggcggagtggtggatgcttggaaaaacatgttacccattggttaagaaaaatctggtttttctcttcattttctctgttgttcagcagcagttatttcttgagcaactgcctaatccctggggggggttacaagggatccttctattaatattatcttagagggatgttcacagacgttcatagaagactatctagttagtgtccgtgtgaacaagaaatagtgctgcttagagttctgaaagatagaagggagtagtaggaggagatgaatcttcggctagagagtgaggcctgaataggatttaacttaaccaagaggcaaggggaacaaaatacttacctatctcatctagtagctgtgtgctgctagctcagcttcctacttagacttgagcccacttacttttttagagacaggatcttgctctgtcgcccagattggggtctagtggcgcaatcatagctcactgcagcttcagcctcctgggctcaagcttcccaagtggctgggactacaggtgcatgtcaccatgccgggataatttttaaactttttgtagagacgggggtcttgctgtgttgcccaggctggtcttgaacccctggtctcaagcgatcctcctgccttggcctccaaagtttctgggatgacaggtatgagccgctgcacctggcccaagcccactttttaacactgctttgatattttataaatatgttcctttctggcagtgtgtgttagctggatctctcttcttttggcctggccctttgcccttttctttttttctttattttaatttttttttatttttattttttgagattgagtctttctctgtcacccaggctggagtgcagtggcacaatctcggttcgttgcaacctctgcctcctggattgaagtgattctaagtagctgggattacaggcacctgccaacacgcccagctaatttttgtatttttggtagagataaggtttcgacatgttggccaggttggtgttgaactgctgacttcaggtgatcctcccacctcagcctcccaaagtgctgggattataggcatgagccactatgcccgacctttgcccttttctggggctcatttgtaggccagggtcctgcaggagccagctatggaggtcaggctggatggtgggctgaggcccttagtgcctggccaagggcagtccctgcctgtgtttggggcgtgggtgttggtaaagcagtgtgttgagaagactgagctgccccgctatgttataaatgacctgggggagcccagagctgtcctgaggcctggagatactagagggtaaaggaatggaaccatgtctggggtccctttagtaacttgcagggtctgggaattgactgcatgtgggaggtcaaagggtagtgaatcacggatgatctcagcattttcatccaaggacttagggaaatagagaaaagcaggaggaagggcgtgacccctggggaggggtgaggtgccgaggccttcctggtgggggcatagtcaggagttaggaatgcagcctcggctgtcagccatgcaacctgagggcagtcttgtgacgaggatgtgtccagaaaggagtggggcttaaagatggagtgtctgcagcatttgcaggggaggaagcctgctggaggggcagggttcaggcagtgtgggggtgcagaaggcagggcagaggacagcgctaggaaggcgtggtgctctccaacagaggctcgggagcaccatgtcttcacttaatgagacccagctttggtcatttaggaggcaaaaggagaaacctcctcttgcagcttaagaagaaaagttgtggcaagtctggaggctgtcaatcctgtctctcaaaacccagcattaaaacctttcagtcactcagagcagatgtttctgattttttttctcttctttatttaggatgaccgttcattaataaatttgcatctcatgcacaccagttacttcctctttgtgatggtgataacaatgttttgctatgctgttatcaagggcagacctagcaaattgcgtcagagcaatcctgaattttgtcccgagaaggtgagcggtggatggggtccgggccagcattttactagaggtctctgtatacagaaagtcccagttatccttattctatttattgtgggtggcacctttcgtctaaagaaatgacagtcatcccttggtatccgaggaggattggttccaggaccctggtggatatcgaaattcatgaatgtccaaatcccttctgtaaaatggtacagtatttgcatatgacctctgcacatcctctgtaacttttttttttgagatggagtctcgctctgtctcccaggctggagtgcagtggcactatcttggctcactgcagcctccgcctcccaggttcaagcagttctcccacctcagcctcccgaggagctgggattacagtcgcaagccaccgcgtcccactaagtttttgcatttttagtagagaccgggtctcaccatgttggccaggctggtctcaaactcctgacctcaagtgatccacccgccttggcctcccaaagtgctggaattacaggtgtgagccactgtgcccagctcatcctctgtaacgttaatctctagattactttcttttttttttttttttttttttttgagagagttttgctctgtcaccaaggctggagtgctgtggcacgatcttggctcactgcaacctctgcctcctgggctcaagtgattctcttgcctcagcctcgagagtagctgggattacaggcatgtgccaccacactcagctaatttttgtatttttagtagatacagggtttcaccatgttgtccaggctagtctcgaactgctgttatcaagtgatccacctgccttggcctcccaaagtgctgggatcacaggcgtgagccactgggcccagcttctaggttacttataatacctaatacaatgtaaatactatgtaaatagttgttacagtgtatttttaaaacttgtgttatttttattgttgtattcttatgtattggttttttttcttttgagtatttttgcttttttaattttttttttttttttttttgagacagggtctcactttgtcacccaggctggagtagagtggtgcgatcgtagctcatgactcaatcatagttcactgcagccttgacctcccaggctcaagcgatcgtcaacctcctgagtagctgggaccacaggcatgcatcaccacacctggttaatttttgtattttttgaaaagacagggtttcgccacattgcctaggctggtcttgaattcctgggctcaagcaatccacccacattggcctctcaaagattacaggtgattacaggtgtgagctaccatgcccagccctcttttgtgtatttttggttgaatctgtggatatgaaacccacaattacagaaggccagcggtagtttctgtcttcattagaagtgtctttactctcaacctaaattatgttgttggatttttaatcatatacccaagcctctgttgctattaaagggagtgacttggcagttgttctcaagtctccactggagcactactgactctgggtagctgcctcctctgtagttccatcagcataagaagtcttctaacagaatgcttatcaaggtttaaagacagttacctcagctaggtggacctgtaatcccaggacttttaggaggctgaggcagaaggatcacttgagcccacgagttcaagaccagcctgggcaacatagtgagaacccttctctactaacagttaaaaaattagccagatgtaatggtgcatgcctgtattcccagctactggggaggttgaggaaggagaattgcttgagcccagaagttggaagctgcagtaacctacgattgcaccactgcactccagcctggacaacagagcgagaccgtgtctcaaaaaaacaaaaaccagttaattctgtctccgcacagtggttccagatgggccgcgtcttgcaggagactttgagatttctagtaatttcttcctaggtgagattttctttttagggatttagtaacttcactgtctggttgatatgtgcaattagtgtggcatcctggtctttgggtaggggctgagttacctaggcttcccttttttgactggtttccctggcttgctgtcttccaggtggctttggctgaagcctaattccacagctccttgttttttgagagagactgagagaaccataatccttgcctgctgaacccagcctgggcctggatgctctgtgaatacattatcttgcgatgttgggttattccagccaaagacatttcaagtgcctgtaactgatttgtacatatttataaaaatctattcagaaattggtccaataatgcacgtgctttgccctgggtacagccagagcccttcaaccccaccttggacttgaggacctacctgatgggacgtttccacgtgtctctagagaaggattcctggatctagctggtcacgacgatgttttcaccaaggtcacaggagcattgcgtcgctgatggggttgaagtttggtttggttcttgtttcagcccaatatgtagagaacatttgaaacagtctgcacctttgatacggtattgcatttccaaagccaccaatccattttgtggattttatgtgtttgtggcttaataatcatagtaacaacaataatacctttttctccattttgcttgcaggaaacataccttaagttttttttgttttgtttttgtttttttgttttttgttttcctttatgaagaaaaaataaaatagtcacattttaatacta

SEQ ID NO: 38269 - DNA, 50272 bp, Homo sapiens
gcgtcatcgcctcctccctccccaagatggcgtccttgctgcagtcggaccgggttctctatctagtccagggagaaaagaaggttcgggccccgctctcgcaactctacttctgccgctattgtagcgaactgcggtcgctggaatgtgtgtctcacgaggtaacagagtcgccctatagcgagtatgtggggtggggggggcgcggcgttcatgctagtcactgccaccggaaggctggagctattttccttccttactgattggttatgtcttccgtcactcgggtttgcctgcgatttaatttgcttctaatctgtcacttggaaaggaggagcagcctcgggtgggactgagcggatcttctggttctagagcggcctctgattggacaaacttgacttagggaccgtgtctgtctgcgatggggcttggtaattgggtggactacggagaaaggtctgggggtgcttagttcaggccacttaaggggcgaaaaactgcctttccaggatttattgcgaggatggagggaggcgcaggcgttctcattcatagttctcccatcctgaaagttctgttcctcttttgtccagaaactgggccctcgtcagactgccttgccctgttcctgactcaggccaaggcctgcagccgggaagaggttggggcggcgtgagttatgtgaaaagcgctcagaatacagtatgtcatgtaagaagctgaaagtgtatttatggagctagaggacaatgctgtccttccctggcacaagtgggcgtccgaagttggatttttcaaaaagaagaccccggccagtaaaaagtcaccaaataacaaaaccccaaaacttctgcagcgcttggcacatcttgtttattcagtaagctttagggattaaaaggcgagtaagacataaaatgcgctgtttaataagccatagtcttagtgaagaaaaagctgatagtagtaatagttgctgcttattcgatacttgctatatgtcatgtgctttatgtaatcttcaaaccaatttaagtggatactttttttaaaaaattttttttacaggtaaagaaacagatacagagtgttcgctgtaagtcacacagccagtaatttgggggtgggaaggaggacctggatttgaatctaaacagcctaactcagagtgttttttactgaagatcccgggactgttaaaataaatgcatatgaaaacacatactataagccattttatgtgttattaataacttattttattgaagatacttttcataataggaatagtcaagaaaagcaattaaataatacaagaaaaatcgtatatattaaaaatatggcatcgatttttcttctcatctccattagcactttccttatgtgtatctccttgatgattccctattccagctccacctccagaatttattggatcatattctcctgtggtgaatagagtgctcagtctccatgatctgtctctaagactctcttcaattaggacatccagtctgtgacagcatcttttacagcctgatgtgtacctgtgatatggaggccattagagtttagggaaagatgaagctctgagggctggggcaggcagtgaagttctaatggagaatctgggtctggagctgcacatgaacggacaagcagaatttggaaagggggcaaaaaggaatgacttgtattttgccttttttgatgagtcagtgcagaggttagttagcaatattgtattttatgttcctggagattatttgagcaacaactttattaatcttttcaaattgacctgtttatagcagatgatgaaaaaagccagtttctatcatagtatttatgttccagtgattgtcttttcatttgcaggtgactagagttctataattgtcaaataggacctacattaaagaaaataattattcagacttttaaaaaataaaatgaacttaaattttagactccagttttttaagtacaataagactgtcccattaatttgtttaaaaatctctaattggttggccatagctgactatgtaaataaatatttatgcttgccttcagtcaacctgtattacttcaataatgagaaatctttaaaaaaatgtccttcaaaacctaaaagtatggtcaagttttatagtcatataaagctagcctagacaggaggatattttatcacaatgttacaaattggattattttattaatctctttattaatcatagaattctatggagttcaactggaaattgtagattgttaaataaacaacttttaacacataaaaccctgatgatggaataggaaagatcagaaaaatagaaggattttttaaatccggaagaagaagaaaaaaaaaaaacaggtgactgaagaagaataaaccctaagcagaaaacagtctactttctgctacagtataacatattttaaaattcactatttgacaagacatatacacaagttaaactgagttctcctctggttttttttttctttcttgtttcctcctaggtggactcccattattgtcccagttgtttagaaaatatgccatcggctgaagccaaactaaaaaagaataggtaagacctggactgattttttttttcttcctattttccttgactgttctctaaaatagctagttaaaaagacacatgggccaggcatggtggctcacgcctgtaatcccagcactttgggaggcggaggcagggatcacgaggtcaagaggttgataccatcctggctaacatggcgaaaccccatctctactaaaaatacaaaaaattagctaggtgtggtggcacgcgcctgtagtcccagctacttgggaggctgaggcagatgaattgcttgaacctgggaggcagacattgcagtgagccaagattgtgccactgcactccagcctgggcaacagagcaagtctttgtctcaaaaaaaaaaaaaaaaaaaagacacatgaaattaacttttttaaccagctctttttcatttttaagcatcaccattgccaaagatgaaatcccctttgatttttgaaatagattttctactttagaacagttttgtacttcagaattatggtgaagatagtatggagagttcccatttacctcacatccagtctcccctattgttaactttttacattagtgtggtatatttgttacaattaatgaaccaatacactacattttattcagatttccttagtttttctgtggtctcctttttttccaggattcttttcaggatatcacattatatttatagttatgtctctagactcctcttgggtgtggtgtgataggagaatcttaaaatttccttggttttgatgacctcaaaagtattgaggagtactggtgaggtattttatagaatgtcatttcattaggatttgcatgatgtttttttctcatcagactaggggaatgtattttgcggaggagaaccacagaggtaaagtgccatctttgattacatcatatcaagggtaaatacttatgacttgtcactgttggtgttaaccttgattatctggcttgagctagtgtttgtcaggtttctccactgtaaagttactgcttttccttctttttttgtactctactttttggaaggaaaattactgtcacagcccataaagactagagaattatgctcccctgtccttgaggactatctgcataaattatttggatttggaattcttttgcatggaagatctgtctcttctcctcttgtttatttgttttttaaatcacttacttataggacagtgggattatgaatattcattttatattttggcttgtaatccaatactactttatttattttgctcaaattatttcagctttggccattgggagctctttcagttgactcctagatccctttgacatacccccatcattaggagcaggagagagttctctgttcattactttgatcattttcttaccagtactacaagatactccagactcatcttgtgtgtatgttttgtgtgtatttttttttttttgagacagggtctcactttggcgcctaggttgaagtgcagtggtgcaatcttggctcactgcaacctcaacctcccaggctcaagcagtccttccacctcagcctcctgagtagctgagactaggcacatgctaccacacctggataatttttgtatttttttggagagataggcttttgccatgttgcccaggctggtcttgaactcctggctcaagcacttcacctgccttggcccaaagtgctgggattacaagcgtgagctgctgtgcccagcctcatcttgtatattttctgtctcagtcttagagttgtttctccaaggagccttggttcactttattggagaatagtcttagaaaccaagatatggctgctaggcttgctcattgctactggatggtgtttagtttttagcttgaagtgaaagtccttttgctgttagtcatacccccatacctttatggatgtgaaccactattatttgtctttcctgccctgagaagtaacccctgataaccagatactgttttgtatactttccacaaattaatttttatcatttaatcctcaaagcttccttgtaaggtgagtactattattatcttcttttgatagtatccagatggcagactataacagataatgcaagttatattatagaacagaacttcaagcaggtacaggactgcaggtgaaatcttgataatctgtgctggtgggagagttaaaagcaagaagacatagggacctcctaaaggagaaatgttggctgagcactaggaaaagtagcatttaaggagagaacagaaagccctgaaaatatgctgcttctgaaccattccagtttgatagcattgtttgctttctgttgaagctctctggcacagcagtcggttattttccaaatccagtttcacagcttcttgtattgttgactctaagttttctatggcacagttggtctgtcctctctaaaggcataagctgtgacagttctcttcctcagaaatctttgtgatcaatataagcataaaaagagtctggaatcataaactccatctgttaacaatggttctctctgtggagtaggattgggttgggctctaattcttactttggcgataactgcatattttttaaactaatgaacatatagtactcttgaactgttaaagcaaagttggtaagaggcctgcagaatgttactgttttttcttgagagacacttgtccttatatttgttctctcttgaattccttgataaatatttgttgaatgaatggttgtgtttgtcatgtcacagatgtgccaattgttttgactgtcctggctgcatgcacaccctctctactcgggccacgagcatctccacacagcttccagatgacccagccaagaccaccatgaagaaagcctattacctggcatgtggattttgtcgctggacgtctagagatgtgggcatggcagacaaatctgtaggtgagtgagatggacttcaatatgaaattttgtacaattgacagtgctataattgcccatagattattatttctgtaacccgttggggcgataggagctaaattcagaatattttgtcattaactcttctgtgttcccatatgttcacatttgtagaccttagtgttttatctgagatgggataatatttagttttcttagacttgataaaatagcttttataaatctggtactttcttggaatcaaaatattaatgctcttcatgaaaaataaacattcatgttaagacatcatggataaaactaaaagataaggccgggcacggtggctcacgcctgtaatcccagcactttgggaggttgaggcgggcagatcacaaggtcaggagatcgagaccatcctggctaacacagtgaaaccccgtctctactaaaaaatacaaaaattagctgggcgtggtgggggcacctgtagtcccagctactcgggaggctgaggcaggagaatggcgtgaacctgggaggcagagcttgcggtgagccgagatcgggcctctgcactccagcctgggtgacagagcaagactctgtctcaaaaaaaaaaaaaatctttaaagataaaaatgacaaactaagaaaaatagttgggtcttatataacaggctaaagatgaatactcagaaatgaggaacgcttataagtcaataagaaaaagacttagtagaaaaacaggcaaaggatatgagcagcaattctcatagtagaaataaaaatggtcaatgaatatgcaaaaagatgtattcgacttccctagtagtcatgtaaatgcaaattaaagcttccttctatttggtacaacatgtttaatctggttgtatcaagtgttggctagaacataggagaatagttctctcatacactatggtagtctatcttggagaccaattttaaaacatttattaaaattttaaattgcttatatccttctgcccagtaattcaatgtccaaatgtctgtcctggagcattcaaacatgtgctcaaaaacttttacgtatatatataaaatgtttatcagtgaaagagaaaaattggtatgtttggatttaagaccacctaaggcattatatacctccatcatttgagtgtttgagtgttttagaacagattacacttaattttatcacgaaactttatttttgcaaattctgtatttcatggttaacatcatagagtggaaacattctctgtacagtcagttcaaaatcttgagttgcttttgatttaagtgatccaaagtttaaaaaaaattaataaaatcttgagttgctatttatgctttatataagtagtagcatcactaactccgtatttttttttctgaggtttcattgtttaattttctaaaaacattttaaacttgtaaaaattctcattttgggattttcataaaaagtacagcttattgactaataaatgaggaagctcataacaaattcattatatgtcatttgacataactaaaatgaagcagactggctaaaacctttctatagattcttacacaatttggaagtaaatatgggtgaagttctttagattcaactatgttcttaaaaatttaatccttgattctattgaatttgctctttggtttagaatgctttgagctgttgatggtttttctgactttgtacattgagttgataaaatacatactcttttcaaaaacagaaagttaaataagtatatcttagttccttaaaaatgctcattggtgggtagctatttacctgaagtgtgactgaaaatagaaagattctgtaacatctttgaaaattgccagtaagtatttatgtgtatatgttttagtgtcagtataggagataagttaaagaaagtaagttaaatgttaaaaagcaacctcaaagtggcataatgtaggcctcagtgaactaaagtattgttttttcatgtttgtattttgtgtctttttatcaagtaaaagaaacagcccggaaatccaagtagatttctcagtttgttactctgttagtgagtgttttatgctttttggtttatgagtcatgaagattggagaatttatatttcagaactataaacttatgctggcttctagaactgtatctcctctagggtatctcaacagggataattgaataccaggagctcttaaagcgtacagataatttcatttcctccttgatgtcattggtatctcagaagccctgaaaccacttaagttagaactatttgtttatttataagtacttgtctgtaatgtacggagaaaaacttacaatgagattattatgtctcccaaattgctacttagaataaattaccagttcaaaagaagcaattagataaaatattcagacgtttaaaaatattacagctgaaacatttctttcacataattatttttcatgattgccttaagtgaggcaacttctaaaataatattatactaaagtgttatttctgccatttcttgcaagaggatacaatgtcaccttcagcaaggtaattgcgtcctttttgttttgaaaaaagtgattttatatgaaatatgtatattcatgtacttatcacccagtttaagaaatgaaacagccaaaacagtttaagccctccccctactttatcttcctctctgcccgctagagataataatcacaatcctgaattcagtgtttattagcatccatacatgtctttatacttctccacatatgtatgcagccacaaacaaataacatttttcacttttaagcaaatgaaaacatactgtatatatcctgctacaactttactctatcagcattatgtttctgatacacagttgattcctgtatgactcaccacagtttacttattccgtcttctcttaatgaacatttaggttgttttcattttctttgcttttgaaaaaatatagctgctggaagcaatcttgtatgtgtttcctaaggcacaagtgtaaggacttttctatataactagaagtaaaattgccagtcataagttgtgtacatccttagcactccaaaatgatttagcagtctttgctcctagtagtaatatgtaagagtaaactacctgtagctccagttccttgtcagctcttagtacttttggactctaaaatttttccagactgatggttgtgaaatggtatctcattatacttttatttttccctttatttggctagctttaccaatatataatttatatataataaagcttaccaattttaagtgtagaattctgtgatgtttgacaagtgtgtaatcacatagccaccaccataatcatgatacacaacatttctgtccccctagagaatcctcatgccccattgcagtcagtttcttcccccaacctcccggcccctgactagactgatatgctttctatcactagaattttgccttttctagaagtgtatgtaattggagtcttacattacagtctttcctgtctgtcttcttttatttagcataatgctattgaggttcatctgtgtttcttctttatattatttcttcttattgttgagtagtattctgttgtatgaacatgtttgtttattcattctccacttgaacatttggattgtttttgggttttggcttatgtgaataaaggtgctatgaacatttgcctataactctttgtgtgaatatatgttttcatttttcttaagtgccaaagagtgaaattattaggtcataggataagtgtatgtttaatttgtctagaagctgccaaactatttttatttttttttattttttaaagtagagatggggtttctccatgttacccaggctggtctccaactcctggactctagcagttctcctgcctcagcctcccaaagtgctgggattaaaagcatgaaccactgcacctggccaatgcccaactgttttccaaagtgactgaacaattttggatcctccccagcaaattaggagagttccaatcccttgacaacccttgccatattgtcagtcttacccattttagccattctagcacatgtacagcagtacttcactgtggttttaatttgcattttctcattgtgtttgtttaccagccatatatctttggtgaactgtctgtacaaatcttttccctactttttaactgggttttgttgttgttggtttgttttgatttggttttttaaactgagttataagagttctatattctggatacaagtccattgttgaatatatgttttgcaaatatttactcccagtctgtgccttgccttttccttttctcagcagtgtgtgttgaagaactcaagtttctaatttcagtgaagtctaatttaccaatttttttattttatagtttgtgttttttgtgtcctattaaaaaaactttagcctaacccagtgtcactaagatctacccatgttttcttctagaagtgctgtagttttaacacttacatttaagtcttgctcttttctttttttctttttttttcttattattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccatctatgagtgagaacatgcggtgtttggttttttgtccttgtgatagtttactgagaatgatgatttccaatatcatccatgtccctacaaaggacatgaactcatcattttttgtggctgcatagtattccatggtgtatatgtgccacattttcttaatccagtctatcattgttggacatttgggttggttccaagtctttgctattgtgaatagtgccgcaataaacatatgtgtgcatgtgtctttatagcagcatgatttatagttctttgggtatatacccagtaatgggatggctgggtcaaatagtatttctagttctagatccctgaggaatcgccacactgacttccacaacggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttgatatcctttgcccactttttgatgaggttgtttttttcttgtaaatttgtttgagttcattgtagattctggatcttagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttctcaggttcgtcaaagatcagatagttgtagatatgcggcattatttctgagggctctgttctgttccattgatctacatctctgttttggtaccagtaccatgctgttttggttactgtagccttgtagtatagtttgaagtcagttagtgtgatgcctccagctttgttcttttggcttaggattgacttggcaatgcgggctcttttttagttccatatgaactttaaagtagttttttccaattctgtgaagaaagtcattggtagcttgatggggatggcattgaatctatcaattaccttgggcagtatggccattttcttgatattgattcttcctacccatgagcatggaatgttcttccatttgtttgtatcctcttttatttccttgagcagtggtttgtagttctcctcgaagaggtccttcacgtcccttgtaagttggattcctaagtattttattctctttgaagcaattgtgaatgggagttcactcatgatttggctctctgtttgtctgttattggtgtataagaatgcttgtgatttttgtacattgattttgtatcccgagactttgctgaagttgcttatcagcttaaggagattttgggctgagacgatggggttttctagatatacaatcatgtcatctgcaaacagggacaatttgacttcctcttttcctaattgaataccctttatttccttctcctgcctgattgccctggccagaactcccaacactatgttgaataggagtggtgagagagggcatccctgtcttgtgccagttttcaaagggattgcttccagtttttgcccattcagtatgatattggctgtgggtttgtgatagatagctgttattattttgagatacgtcccatcaataccgaatttattgagagtttttagcatgaagggctgttgaattttgtcaaaggccttttctgcatctattgagataatcatgtggtttttgtctttggctctgtttatatgctgggttacatttattgatttgcgtatgttgaaccagccttgcatcccagggatgaagcccacttgatcatgttggataagctttttgatgtgctgctgcattcggtttgccagtattttattgaggatttttgcatcaatgttcatcaaggatattggtctaaaattctcttttttggttgtgtctctgcccagctttggtatcaggatgatgctggcctcataaaatgagttagggaggattccctctttttctattgattggaatagtttcagaaggaatggtaccagttcctccttgtacgtctggtagaatttggctatgattccatctggtcctggactttttttgattggtaagctattattgcctcaatttcagagcctgttattggtctattcagagattcaacttcttgctggtttagtcttgggagagtatatatgtcgaggaatttatccatttcttctagattttctagtttatttgcatagaggtgtttgtagtattctctgatggtagtttgtatttctgtgggatcggtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttttgctagcttttgaatgtgtttgctcttgcttttctagttcttttaattgtgatgttagggtgtcaattttggatctttcctggtttctcttgtgggcatttagtgctataaatttccctctacacactgctttgaatgtgtcccagagattctggtatgttgtgtctttgttctcgttggtttcaaagaacatctttatttctgccttcattttgttatatacccagcagtcattcaggagcaggttgttcagtttccatgtagttgaacggttttgagtgagtttcttaatcctgagttctagtttgattgcactgtggtctgagagacgctttgttataatttctgttattttacatttgctgaggagagctttacttccaactatgtggtcagttttggaatgggtgtggtgtggtgctgaaaaaaatgtatattctgttgatttggggtggagagttctgtagatgtctataaggtctggttggtgcagagctgagttcaattcctgggtatccttgttaactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagcgcttcttgttgaattgatccctttaccattatgtaatggccttctttgtctcttttgatccttgttggtttaaagtctgttttatcagagactaggattgcaacccctgcctttttttgttttccatttgcttggtagatcttcctccatccttttattttgagcctgtgtgtgtctctgcatgtgagatgggtttcctgaatacagcacactgatgggtcttgactctttatccaatttgccagtctgtgtcttttaattggagcatttagtccattaacatttaaagttaatattgttgtgtgtgaatttgatcctgtcatgatgatgttagctggttattttgctcgttagttgatgcagtttcttcctagtctcgatggtctttacattttggcatgattttgcagcggctggtaccggttgtgcctttccatgtttagtgcttctttcaggagctcttttagggcaggcctggtggcgacaaaatctctcatcatttgcttgtctgtaaagtattttatttctccttcacttatgaagcttagtttggctggatatgaaattctgggttgaaaattcttgtctttaagaatgttgaatattggcccccactctcttctggcttgtagagtttctgctgagagatccgctgttagtctgatgggcttccctttgtgggtaacctgacctttctctctggctgccctttaagttttttctttcatttcaactttggtgaatctgacaattatgtgtcttggagttgctcttcttgaggagtatctttgtggcattctctgtatttcctgaatctgaatgttggcctgccttgctagattggggaagttctcctggataatatcctgcagagtgttttccaacttggttccattctccccatcactttcaggtacaccaatcagacgtagatttggtcttttcacatagtcccatatttcttggaggctttgttcgtttctttttattcttttttctctaaacttcccttctcgcttcatttcattcatttcatcttccgtcactgataccctttcttccagttgatcgcatcgactcctgaggcttctgcattcttcatgtagttctcgagccttggctttcagctccatcagctcctttaagcacttctctgtattggttattctagttatacattcgtctaaatttttttcgaagttttcaacttctttgcctttggttcgaatttcctcctgtagctcggagtagtttgattgtctgaagccttcttctctcaactcgtcaaagtcattctccatccagctttgttccgttgctggtgaggagctgctttcctttggaggaggagaggtgctctgctttttagagtttccagtttttctgctctgttttttccccatctttgtgattttatctacttttggtctttgatgatggtgatgtacagatgtggatgtcctttctgtttgttagttttccttctaacagacaggaccctcagctgcaggtctgttggagtttgctagaggtccacttcagtccccgtttgcctgggtatcagcagtggtgtctgcagaaccacagattttcgtgaatcgcgaatgctgctgtctgatcgttcctctggaagttttgtctcagaggagtacccggccgtgtgaggtgtcagtctgcccctactggagggtgcctcccagttaggctgctcgggggtcagaggtcagggacccacttgaggaggcagtctgcccgttctcagatctccagctgcgtgctgggagaaccactgctctgctcaaagctgtcagacagggacatttaagtctgcagaggttactgctgtctttttgtttgtctgtgccctgccccgagaggtggagcctacagaggcaggcaggcctccttgagctgtggctgcttttttttacctaagcaagcctgggcaatggcaggcgcccctcccccagcctcactgccaccttgcagttttatctcagactgctgtgctagcaatcagtgagactccgtgggcgtaggaccctccgagccaggtgcaggatataatctcctggtgcgccgtttcctaagcctgttggaaaagcgcagtattcgggtgggagtggcccgattttccaggtgccgtctgtcacccctttccttgaccaggaaagggaactccctgatcccttgcgcttcccaagtgaggcaatgccttgccctgcttcggctggcgcacggtgcgctgcacccactgtcctgcacccactgtctggcactccctagtgagatgaacccagtacctcagatggaaatgcagaaatcacccgtcttctgcgtcggtcacgctgggagctgtagaccggagctgttcctattcggccatcttggctcctcctaagtcttgctcttttcaaggtaaattttgtaaatgttgttgaagtaagggtccttttggtttttggtttttgaggtttttgttttgtttttgatgtgtggatattccattgttgcagcaccatttgttaaaagtgttcattatagttttactttcagtactttcagttttcttgaataatcttttcctttgtgatttatgctgtgtgcttcttacgtaagaaattcttctctaagccaaggtcatagaacttagaaaatgcacagtgttacagataagagcaaagtctccggagtcagactgagtttgaatcctggctttaccacttactctccgtgtgactttgagcaagttatttaacatctctgagcctcagtttcctcatatataaaatgagactaataagagtccttacctcagagggttgttatgagaataaaaggaaatgtaatacatttcaagtgcctggcacagtggctgtgcattggtgattgttatcaccatcattagatgttttcttaaaattttgttctgaacattatagtctatagttatatagaccagaatggtctatataacttatgttttaagtttctttttatggcctacagaagacttgttttatgaaaataaaattatcacattatgaaagtcttgtttaatattcttttattttgtagctagtggcggttggcaggaacctgaaaatcctcacacacaacgggtaagtaaagggtcataagagagagaggatgaaatcggaaaaaattgagtaaaagactgaagatcttgcattttatgggtagatatgagctgtgtttataagtccataatacgtctttgcacatagacagtgcttctcattgtaagacattgaaatacactgtcacttttttccaaatgacttaagataatggagaatcctaggtgtagctttagttctgtatttgaattgtgcatcaggaaaaggaaccaagtttttgttttttcttcacacaacccaccagtgagttaaggttccatttgttctcagatactcttagaaatatcataaacagccaggtgtggtggctcatgcctgtaatcccaatactttgggaggctgaggcaggaggattgcttgagcccagaagttcaagaccagcctgggcaatacagtgaaaccccatctctacaaaaaaattaaaaattcagctgagtgtggtggcgcatgcctatagtcccagcaactcaggaggctgaggtgggaggattgctttagcctaggttttcgagtctgcattgagctatgatcataccaccacgctccatcctaggcaatagagcaaggctgtgtctcaaaaaaagaaaaagaatgcggtagagacaaacgcagtggctcatgcctgtaatccccattactcaggaagctaaggcaggaggattgcttgaggccaggaataagtatgtatttttatacacatcaaagctatacatctacacacaagtattttaaaatatatgcaaaatataatatatttgtttctctgagtaagaaagatatctaaaccagtaatagttgatacctctaatgagtagaaaagtcaacttgggcagaagggataaaagagaagttttgctttttattcttttcatgtgtatagtgtttgaactttttttttttttttttttttgagacaggatctcactctgtcacccaggctggcatgcagttgcatgatcacagctcactgcagcctcaacctcccaggcttaagcaatcctcccacctcagccatttaaaagaaaaaaaaataggtttttggggaacacctggtgtttgcttacatggataaattattcagtggtgatttctgagattttggtgtacctatcacctgagcagtgtacactgtacctaatgtgtagtattttatcctcacccccttcccagctttccccctgagtccgcaaagtccattgtatcattcttatgcctttgcatcctcatagcttagctccctcttatgagtgagaatgtatgatgtttggttttccattcctgagttacttcacttagaataatggtctccaacactatccaggttgctgcaaatgctattatttcactagtttttatggctgagtagtattccatggtgtatacataccacatattctttatccactcattgattgatgggcatttggaccggtttcctatttttgcggctgtgaattgtgctgctataaacgtgcaggcaagtgtctttttcatgtaatgacttcttttcctcttgagtagatacccagtagtaggattattggatcaaacggtagatctacttttagttctttaaggaatctccatactgttttccatagtggtgtactagtttacattctcaccaacagtgtaaaagtgtccccttttcaccagatccatgccagcatctattacttttttttttttaattaaggccattcttgcaggagtggtttagatcttcatttccttgatcattagtgatgttgaccatttttttaaatatgtttgttggccatttgtgtatctttgagaaatgtctattcatgtcctctgcctactttttaatgggattatttgttttttttcttgctgatttgtttgagtgtcttgtagacttgagatattagtcctttgttggatgcatagtttgcaaagattttctcccactctatgggctgtctttttagtctgctgattatttcatttgctgtgcagaagctttttagtttaagttccatttatttttgtttttgttgcatttgcttttgggttcttggtaatgaagtctttgcctaagccaatgtctagaaggatttttctcatgttatcttctagaatttttatggtttcaggtcttagatttaagtctttgatacatcttgagttgatttttgtataaggtgagagatgaggatccagtttcattcttctacatttaggttgccaattatcccagcaccatttattgaataggatgtcctttccccagtttatgtttttgtttgctttgtcaaagatcagttggctataagtatttggtttatttctgggttctctattctgtttcattgatctgtgtgcctatttttataccagtattatgctgcgttggtgactatagtcttatatatagtttgaagtcaagtaatgtgatgcctccagagttgttctttttgcttagtcttgctttggctatgtaggctcttttttggttccatgtgaattttaggattgtttttactagttctgtgaagaatgatgatggtattttggtgggaattgcattgaatttgcagattgctttggcagtatggtcattttcacagtatttattctacccagccatgagcatgggatatgtttccatttgtttgtgttatctgtgatttctttcaacagtgttttgtagtttttcttgtagaggtctttcacctccttggctaggtatattcctaagcattttgtttttgttttttgggtggggtttttgcggctgttgtaaacagggttgagttcttgattttattctcagcttggtcactgttggtgtatagcagtgctactgatttctgtacattgatttcatatcctgaaactttactgaattcaaaacttttttttttttttttgagatgaaatctctctctgtcagccagactggagtgcaatggtgcaaactcagctcactgcaacttctgcctctcaagttccagcgattctcttacctcagcctcctgagtagctgggattacaggcgcccgctaccacgcatatttttagtgcagatggggttttaccatgttggccaggctggtctcgagctcctgacctcaagtgatctgtccacctcggcctcccaaagtgttcgggttacaggcatgagccactgtgcccaaccttttattgaattcattgatcagatctaggagctttttggataagtctctagggttttctaggcatacgatcatatcattggcaaacagcaacagtttgacttcctctttactgatttggatgccctttatttctttccttgtctgattgctctggctaagacttccagtactgtgttgaatagaagtggtaaaagtgggcatccttgtcttgttccagttctcagctggaatgttttcaacttttccctgttcagtataatgttggctctgtgtttgtcgtagatggcttttacttaaggcatgttccttctatgctgattttgctgagggttttgctcataaaggatgctggattttgtcaaatgctatttctctgtctattgagatgatcctgtgatttttgtttttaattctgtttatgtggtgtattacatttattgacttgggtatttcaaaccatccctgcatccctggtattaaacccacttgatcatggtgtattatctttatgatatgctgttggatccagttaactagtatttcgttaaggatttttgcatccatgttcatcagggatatctgtctgtagttttcttgttttgttgtgtcccttcctggtttcggtataagggcgatgctggattcatagaatgatttagggaggattccctctttatcttttggaatagtttcagtaggattcataaaaattattctttgaatgtctgatagaaatcagctgtgaatccatctggtcctaggctttttttttgtggacagttttttttaattaccatttcaatctcactgcttgttactggtctgttcagagttcctatttcttcctggtttaatctaggagggttgtatatttccaggaatttatccatctcctctaggttttccagtttgtgtgcataaaggtgttcatggtagccctgaatgatcttttctgtttctgtggtatcagttgtaatatctcccatttcatttctaattgagcttatttggatcttctctcatcttttcttggttaatctcacattctatcaatttggtttatcttttcaaagagccagcttttcgtttcatttatcttttttattgtctcttttgtttcagtttcatttagttctgctctcatctttgttatttcttttcttctgctaggtttgggtttggtttgttcttgtttctctggttctttaaggtatgaccctagattgtctcctgtactcttttagactttttgatgtaggtatttaatgctatgaactttcttcttagcactgcttttgctgtatcccagagcttttgataggttgtgtctcactattatcatgcagatcagagagtttttaaatttccatcctgatttcattgttgacccagtgatcattcagaaggagattatttaatttccatgcaatttgcatcgtttcaagagttccttttggaggtgattttccattttattccactgctgtctgagcgagtacttcatataatttcagttttcttaaatgtattgagacgtgttttgtggcctctcgtatgttctatcttagagaatattctatgtgctaatgaatagaatgtatcttctgcagttgttgggtagaatgatctgtaaatatctgttaagtccatttgttctagggtatagtgtaagtccattgtttctttgttgaccatctatcttgatgacctgtctagtgctgttggtggagcgttgaagtcccccactatttttgtgttgctttgtatctcatttcttaggcgtagtagtaattgttttataaattttggagctccagtgttaggtgcatatatatttaggattgtgatatttcctgttggactagtccttttatcattatataatgtcccactttgtcttttttaactgttgttgctttaaagtctgttttgtctgatataagaatagctactcctgctcacttttggtgtccatttgcatggaatatctttttttacccctttaccataagtttatgtgagtccttaggtgttaggtgagtctcttgaagacggcagatacttggttggtaaattgttatccattctgtaattctgtattttttaagtggagcatttaggccatttacatttaacattagtattgagatgtgaggtactattctattcattgtgctagttgttgcctgaatacttagattttttttttcattgtgttattgttttataggccctgtgagacttatgctttaaggaggttatattttggtgtgtttcaaggttttgtttcaggatttagaactcctttgagcacctcttgtagtgctggcttggtactgacaaattctctcagcatttgtgtgtctgaaaaagactttatccttcattcatttacaaagcttagtttcgctggatacagaattcttggttgataattgttttgtttaaggaggctaaagataggaccccagtcccttctagcttgtagggtttcgccaagaaatctgctgttaacctgataggttttcctttataggttatctgatgtttttgcctcataactcttaagattctttcctttgtcttgactttagataacctgatgactgtgtgcctaggtggtgatctttttgcgatgaatttctcaggtgttctttgagcttcttgtatttggatgtctagatctctagcaaggccagggaagttttcttctattctttcctcaagtaagttttccaaacctttagatttctcttcttccttgggaacaccaattcttagttttggtagcttaatataatcccagacttcttagaggctttattttttattattattgttattattcttttttctttgtatttgtcagattgggttaattcaaaagccttgtctaagtgtgtctgtcatttcaaaaattgtgattgtttattatttatgctgtctttctctggagattttttttgtccataacctgtatttttttttttttttttaattcccttaagttggttttcacctttctctggtgcccctttgagtagctttttgagtagcttaatagttggccttctaaattttttttctgacaattcagagttttcttcttggtttggatccattgctggtgaactagtgtaatctttttggggtgttaaagaaccttgctttgtcatattaccagaattgtttttctggttccttctcatttgggtagactatgtcagaggaaagatctggggcttgagggctactgttcagattattttgtcctacgacattgttccttgatgtggtgctctccccctgtggcttcctgagagctggactgcaattattgttattgctgctctgggtctagccacccggccagagctatcagtctccgagctggtactggggagtgtctgcaaagagtccagtgatgcagtccgtcttcaggtctctcagttgtggataccagcacctgctctggtggagatagcaggagagtgaagtggactctgtgagggtccttggttgtagtttggtttcgtatgctagttttctttaatgctggttgtgctagcagtgaattgtcacgtggacagactcaggacctctggttagccaggatgtcacaggtggtggaattagctgttgttttctccttttgagggcagggttgttcttttatgagttgctataatgagttggttggcctccagccaggaggtggcgctttcaagaaagcatcagctgcagtagtgtggtggggatacaagcttgccctaaggttgcctggataagtatttgggtttcccaggtgatcagtggggccataaagctcccaagagtttacagtcttttgtcttgggctaccagggcaggtagagaaagaccatcaggtgggggcatatctgagctcagaatctccttgggcagggtttgctgcagctgctgtgaaggacagttgtgtggttctcaggccaatggagttatgttcccagggggattatggctgcctctgctgtgtcatactggtggccagggaagtaggggaaagccagcagtgacaggcttcacccagctcccatgcagccagcaaggccagtctcactcccaccatgccccaccaacagcatggggtttgcagggccaagattttggcccaggctacaagcctacttgctgaaaaagcaagctagccttttggactccgccccttcccgactgctgtggcttatgtgctcatatctgtacttcccctttacgccttccccatcttgattgtgcccaggaaaatttgctctccgtcaaagttattacaaagttcacctggaagtttctgtctccaagtggtccttcctcagttccactggcagcactccccaaggacccctgtgagattaaagtcagaaatgacttccctgggcttcactgggaaccgggagtgcctacagggctcttcccgctgttgcttcttctatttttatatttcactcggctctctaaattttgtttcagcactaggtaaggttaaatttttctcccatgatctggatttttaggttctccagtgaggatgtgtgtttgaaggtggattttccccctcttacacatgggcactcacagattttctgctgtctcatggattttgcagcagcaagccacttcttttaaagggtctgtgaattctttcagttttcctagtatgttcctgcagtagttcttggaataaaaattcacagtgtgagtctccacatgttgttctgtctgtctgaggggaagctgcaagttagtcctgcctcctatctgccattttttttttgccacctcatcctcttgagtagctgggactataggcatacaccaccatgcccagctaatttttgcatttttttatagagacaaggtctcactctgttgtccaggctggttttgaactcctggccccaagtgatctacccacttcagcctcccaaagtgctggaattgtaggcgtgagccactgtgcccatcctggtttgaactttttatgattaatatgtattgcttttataattaaaatgtattttaaaaattaaaaagtgtgatggagttggggaataaaatacagtataaaatgctatgttcttagaaataagtggtcctgtggccatgcagaaaaaaaataagagcagttgtgaggggaaataagtaatgaagttagagagcaaaaaatttccaagcctcttcattgcccatttcttcccatccttgaacttcagttttccatttcacttcggaaaacagatcacataacgaagaaaaattatcttagaagaaaaagggcaaacttgcccatcttaataatttgtcttctctattcattatgtgtctagtcagtgtagttgattaatttgatatgttttctgttagcttttttgtgtactgagtctgtgattttcttacagatgaacaaattgattgaatattaccagcagcttgctcagaaagagaaggttgagcgagatcgcaagaaactggcacgacgtagaaactatatgcctctggctttttcggtgagaatttggtactaaaatgatttgcaagacctctaaggcctaagaacagtgatcatttcagaaaatggccattgtcctagattcctgaatggtggatatcagagagagggattcttcaaattatagacgtttaagtccaatagttaggcttttgctatatcattagttctgtttgagttatttgtgttttgaggacatttgtgtttctttctccatcactcccctttatcttctgattatttccccagaaaggctgttaattttgtaggcactgcagagttccacgtacagcttttgtgtattacagaaagtctgagaagaaggaggtgggcaaatggtagatttcagtcatattacccctgtagcccacctttgacatcctggcagtagtggtttctcagctttagttataatttttttaacatcctcccctgtttctccaagatgaaaaacactgactttttacatagtgcacttgtgtggttaaatagtaatatatgcaagtagaatttttgataagaattatttatgagagtcattctctaccagtttacgtactgctagtaagaagaaagaaattaggatttggaatttttgttattttaccccgagttttatttgctctcatagtacagtttgttttctgtgtgcttgcttggggcccagcaaattgacattcaataaataacatttattgaatggcaatgatgtgtcaagctctgtgctaaataaacactttacatgtattactttacttaatcctcacaaaaatcctgtggagtatcatatccccattttacgcttgaggaaatgggacctagttaagcaacttgtcatactgcatccacatgaaaattagttaagtcattgaaaccctaagggttggtaaagtccatataaaaatacctagattaagctgggtgcagtggctcacgcctgtaatcccagcactttgggaggctgaggcggggggatcacttgaggtcaggatttcaagaccagtctggccaacatggcgaaaccctgtctctactaaaaatacaaaaaattagctgggcatggtggcgcacgcctataatctcagctacttgggaggctgaggcatgagaatcgcttgaacccaggaggcggaggttgcagtgagccaagatagcgccactgcactccagcctgggtgacggagtgagactctgtctcaaaaaaaatctagattagaatttaaaaacattaacacttgcaaagcacctacatttgcaaaaagaagtgaatttttctgaatagtccagtggtatagtcagcatatgcaccaatgtgtgttatatttagaggtagaatttgaattaaatgaattattcttccaattttcccatataacctgcctgctatatgcgtttgcttctatcttatgctgcattttttgtctctgttgcaacctgctgctattttggggctctacagcaacatactattcatgtagtggtaagttctcctttatgattcttgctgaccctgaagaagttagcagatgaccactggtgttccaggaagacgtctgttgtgtatcttagacactccacatagttcttgcctgagccgtagcttagatacttttagattactagcagaagctcacatttggttcatttttactgtattaatatagtttcaatctccatgtttagtgctgttattattttaagaatagaataatgatgtggggctacaaattgctttctttaaaagaagcctttagattagctttttttttgcttatttccctgagcttctcatgctatcctacccaaaattctttcttttgataaatagggtgtgtaaaagtggactttctaataggaatttctgaactttgtttaggacaaatatggtcttggaaccaggcttcagcgaccacgagctggtgcatccatcagtacccttgccggactttcgtaagtttagacatgaaatgactttgaggagaacagcaggtatcaaaatgaatatcaaataaatgagattaaaacacacacacacacacagttgtcaatggaaaagaagattctcatacttagaaaagacctacgctatacagatattctatgacagaggaatacttcaattattgatatcatagactgaggataatcaggtggatccgtgagaaattactcttttgttttgttttgttttgtttttttaatttttcagccttaaagaaggagaggatcagaaagagataaagattgagccagctcaggctgtggatgaagtggaacctctacctgaagactattatacaagaccagtaaatttaacagagggtaattttctgtgtttttctactttgtttctagtctacatctaattctgtttttgttatttatgtacctagtgatttgagatttttaatggaatagctgttagtagtaaaaacaatatgtagaaaataaaacagctgtaatagaggtaattgtttgaaatctaaaatgtcaactttctatattttcatttttatgaacaacactgttcgtaaaggcagtaatgcttcgtgtaattactggtacataaaagtctgattttgaaagtcactgtaaactaagcctgttttctgcctttctttctagtaacaacccttcagcagcgtctgttacagcctgacttccagccagtctgtgcttcacagctctatcctcgccacaaacatcttctgatcaaacggtccctgcgctgccgtgtaagtattccattctgtagactgaccatttgtacaagaggaaagcaaaaataaatgtggctggtgtctgactaatgtcaaaacctttggaatgtattaaatacagaaaatacttgtagagaacatactaattgccaggcactattttaaatgctttcaatataaacagctcttacaactctgtgaggtaggtactactgttaaacctgttttacaaatgtagaaaatgaagtatctgaaggttaagtacatagggttaacccctaaaagaatagtgaaagagtgtgaacttttaggctagtgttcaggctcagggaggaccaataaaaaataatcaatttaaaagaaagcaagaaaaatcagcaaaatccaggctctggtaatctacagaacaaatgacagagtttcttcaataaataaattgtaaaaacaaaatggaaaagaaaccttttagaggagtactatccaacagaactttctatggtgatggaagtattctgtgtctgtacagtcccgcatgatagccactaggcacatgtggctcttgagcacatgaaatgtgatagtgcagctgaggtactgagtcagtctttaatttcatttaaataaccacatgtcgctagtggctaatgttacttaatcattctctagattagaagagacttaaaagtttaccaaacacaatgtatagagtttacgtagattcggattcaaacaaaacagaaagaaagggcccaggggaggagggaagaagggaaagaggaaagaaggaaagaaaaatttgtgaaatctttgagaaaatttaaacactggtagcattttcgatgctattaaaaaactattgggcagggcacagtgacatgcacttgtagtcccagctactctggaagctgaggcaggagaatcccttgagcctgaggagtttgagactgtagtgtgtgatgatggtgcctgtgaatagccactgcactccagcctaggcaacacagaaagaccctgtctcttaaaaaaaaaaaaaaagtattttttcttttttaggaataatgatagtactttgtttgtttgttttttaatgtctttatcttttggagatacatacagaaatatttatggaggaaatgacttggtctctgatatttgttgcaaaataatgagggatgaggaatgggtaagagtataaatgaaacaagattggccattgttgctaatttttgataacaagatgctgattctttttgtttgtttaacctgagagcatagattcaagtcctgcatatatattccgaagttgataatcgttgaagttgggtgatgggtacctagagatttgtaataccattctatatttttgtacacgttagaaaatttctataatgaaaaacctttataaaaagaaagaaaaagaaggggcaaaggaacattgaattggtagttcaaatagaaagcctgggctcatgcctgtaatcacaacactttgagaggccaaggcaggaagatcacttgagcccaggagtttgagatcagcctaggcaacatagtgagaccctgtctctaccaaaaaaaaaaaaaaaaaaaaaaaaaaaaaaaagccagtgtggtggttcacacacttgtagtcccagcaagtcaggaggctgaggcaggagaattgcttgagcccaggaagttgaggctgctgtgagcagtaatcacaccactgcactccagcctgggtgacgaagcaagaccctgtctgttaaaaaaaaaaaaaagattgtgtgtggtaagatagtagattaaaatccagatgtatcagtatttacattaaataccaatgaactaaatgcttccattaaaagacaaacattgtcagtctaaataataaagcaaattgcagtgatccatctatatgcttattacaagaagcacaaacatgagaactcagaaaagttgaaagtagagagaagtgggaaaaatattggacaaacactaatttttttaaaagagggataatttgtttaaaaaaaagattcaatttacaaagaagatataaccgtctaaagtcatgtgcactgaataatagactcaaaatatataaagcgacatttgagaaaattacataaatggacaaatcattttgggaaattttgacatacttctctcagtaaccgagagaacaaatagatgaaaatcagtaagaatatagaacatttggacaatttatctagcaaacttgaccaaatgggcatatatagactactgtacccaatgtctgcagaatatatgcattcttttcaagtacacacagaacacttataaaggttgattatatactggattattataaagtaagtctgaacatttttcagaagatgaaattctttttcagttaaaagaaagtttttattaacaagaaaagatttaagtcacatttatactttataataataaataggctaagatgctcaataacacaagactttctcttttgaacactttatttccatttagtactcttaaatacatttgcttgttgtgtgtttatattttaataggtaaaagttatgaattaccagctattttgctacctaactgcacgggaaaatgaaaatttatagaattttatcattagatcagagttttaaaaatcaaaggataaggatttgtttaaaatcttttaacattagggcattatacctttttcagaacaaatataatttacagaaattatacaaggcaattttttatcaaatatcaatattttaaaatgctttatttagctgaaatgttatttcagttgagaaaactatctccaattacaaaaaaatcatcaggaagcttattgggttttttgttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccaccacgcccggctaattttttgtatttttagtagagacggggtttcaccgttttagccgggatggtctcgatcttctgacctcgtgatccgcccgcctcggcctcccaaaatgctgggattacaggcgtgagccaccgcgcccggcctgcttattgggtttaatctgctttagaaatgtcctaagaagcctaaaattaaatattttaagtagaaaaaaataattttaaaatagtatgttatactattactgtggtttatatacatatattaaatggtctcttttataggaaacatgtctggaagtttatcacattaagcactgtaaaattaaaggcaagagctaatcaccttttagcaaaagtactctgtatgcaacagttgcaaatatgaaagctattatttagcagttgataattgcctgatacaaaatataaacaaagtacatttactggattgtttttagtttgcagctgccctcaaatatcccagataaggatgtctcataaatcaaagctgcagtacaattcacttagtggttagttaggccaatcctccccgccattatccttgttcttccccaccgcccctaacccctgcagtggcaccatattattaaaaacattaagtacctggggtttgtgcttcaggtcaagacatcatttgcataatttcaaatgacagacaacttttcatgtaaaaatgatgctttgtggtcacaattacttcaaaaagtaattgttttcaaataacctgacataccgtaccttagcaattacaaaaccatgattttgacacatggcatttgtaagatgtgaacagctgttcttctgcttaagtttagagtgctgcaaaacttgggtaatgactattttttcagttaacataaccagcccacggtacagcacactgtatcacaaagtacaaatccaaggaaggtaatacctttgctaagttgcggaattttggcaaatcagtacaggtctctttaatatgataaaactgtatttttgtgggagtcatgtataactttaggaataattttcactccaaaaatatttaagtgccagctgatactattaaaaacattataatggtttttaatggtgatttataacaaagcaaggataatggcggggaggattggcctaaccactaagtgaattgtactgcagctttaatttatgagaaatttatgagaagttattttatacaaactaatatgttttaaactacacaatatctcttcttaagtgagctcccctgttcaagctgttagagtatccagcagcagagcaatgcatgtctcgaggaggtggctccgctcagttgtggggttggtccaaagctggggagagttccagtgtgttgaaagctttaaaattctattttaaggagatttactgtcaataccaatttccaaggacttctttaaaaattgttaaattttcacataaatactggaactctcaaaattagacagttatttcaaacaacattcatttcagatgatcccttatatttagaagccctgcatctcgttggtttgatcaaaagtcatatagccttataccagcttattttttttttaattctgcttaaaatataggtttgttgggaggctgaggcaggagaattggttgtacccaggaggcggaggttgcagtgagccaagattgcgccattgtactccggcctgggcaacaagagcaaaacttgtctcaaaaaataaataaatacaggtttgttttaaataacaaaatataataaatagccagcttggagagacctggggcacccatccaatattgtctaccaactttcatgattgtttctttgcacatgctgctgctgccattggagtccctatgctttctcttgctgaggctgtcagctggaagatgaaattattaaagtatattatttgatcacaacgtagttaagttaggaatcagtaatttctttatagcaaaacttgcaggatacaactaaggctgtgcttagctatacagtatatattagaaaagaagaaatattaaaagattagcgatgtcagcatccatttcaagaagttagaaaaaaaacagcaaagtccaaagagaacaggtgttaataaattaagaaaccaaaataaaatacaataaattaatataaaatacagtaaattaagaaaccaaaatacaaaagggcaacagaatcagaagttgatttcttaaaaaagattagtaatggaaatagttatatataaattaaattgatataaatttatataaatatggttatataatgcaccattaatatagtaatacctaccaaaagtaaagttaccttttgtctcatcaacttcacttttaggaatctaccttgcacctccacaaatacaaaccaaaatatgcagagattatagtatatccgcagaatgagtactataaatttataaaagaatgtgttaatatgggatactttttttttttttttttttttttgagacggagtctcactctgttgctcatgctggagtgcagcggcgtgatctcggctcactgcaagctccacctcccaggttcacgccattctcctgcctcagcctcccgtgtagctgggactacaggcgcccgccactacgcctggctaatttttttgtacttttagtagagatggggtttcaccgtgttagccaggatggtctcaatctcctgacctcgtggtccgcccgcctcagcctcccaaagtgctgggattacaggcgtgagccactgcgcccagcctgggatacatttttaaatgcaaaaagcaaagtgcatggtaggtatgcactttttctgtataaaaaaggagggaaagtacaaatgtacatataaacaaaaaaaagtgtgtctatatgtatgcagacgtagacccatgcatatgagaaaatttgttatatactaaatatggcattgtagatcattggggaaagaataggcaattatattttgctaggtcaagtgattatatggaagaaaataaaattgggttgctacctcaccctacatagaagttaatttcaggaacattggaaatctgaagagccaaacttctagaaggaaatagaggagaataccttcatgacttctgggtagggaaatgtttcataagtaatacaaataagcacaaactgtaatgtaaagttacatattttacttcattaaaagtaaaacttgtaccctcatgccaaagaaaacccataaagaaatgaaaagataagccacagactgagaaaagtagtttgcaaggtatattattaacaagagattaaaatctattgttaatatcagcaaatcggcaaggaaataaaaataaccagtagatcctaacattcaagttatggcagaggaaatcccaatagccaataaatatgaaagatattcaaatttatacactaatcagggaaatgtacattaaaactgcaatgagaaaatgaaaaattaaaaaaaattaactgcagtggaatatcatttcataatcgtcagattagtcagttatatttcagtatccattaaaatagcaaatgcatacaccctttgatctactcttaggaaattgtcttacagatacttagacacttaggaaatgattcatgtacaagaacactcatcgctgcattacttacagtagcaaaataatggaaacatcctgaatgtccatcaatttctatcttatgtaagttatagaaattgttacagtgggacacagaggcctctctatatgtactgaaatggaattaattccaagatagaataaatgaaaaaagcaagagaataaatataaaatgttcccttttgtgttattgtgaaaaaagcaaggtgatgtatgcttgtacttttatgtgcataggctatctggagaaaacaaggggacagacagataatgggtaatctttacactggacaccttttttgttctgttaaaaaaatttttaaccaggtatatgtagtatgtatttaagaaagtagtaaataattattactgtcctagtgcagtggctcatgcctgtaatcccagcactttgggaggccaaggcaggaagattacttgagcccaggagttggaggctgtagtgagctttgattgtgccactgcactccagcctgggtaacagagtgataccctatctcaaaagtaatcattgttactgtactttaaagcataggatctggaattttactacctagatttaaatcccagtgtccatttttattggctctgtgaagttggacaggttacttacccttcctgtataccattttgatcatctataatatggcaaccttaatgtaatacctatacctagctcataaagttgatgtgatatttaaatccagttaaaccagtgagcacgttgtttagcaaatacagtatgtactcagtatgtgttattttagtagtttttaagtaccacagaggtataataatattggatagtggggttgcacatatcaggaagtgcgaacatcttttataaactttggctgctatacattattcaaaaacatatggtcttatagcagaacaaaacaaaacaaaattctcgtaaatgctgtccttctgaatttagcagctctatggatcaacaaagtgtgttgttgtcttctgatacgtgttatatttgttttctttttagaaatgtgaacataatttgagcaagccagaatttaacccaacgtcaatcaaattcaaaatccagctggtcgctgtgtaagtattttgggattggtgttttcagttactgttttgagttattttggtttattcttcttccccagtatgaagtgtgtttactcttggcctaaaaaaaaaaaaattacatcaaaataatcttgacattctgttcctgtttaggtttttaatttagttacatgccatgaagtttaagataaatagattcaggggtattgggatcagggacacagtgtcccagtatgatctggagcaacaaggtatgttgattatttggtggaaagtcactagtcatcattacaaattataaagtatctgagtttgggaataatccttcaaaaaaaatttaaaaataatgaagtatagctgattgaagagtatccctgtaacagtgttcattttacttacctgtgttataacacttcgttgactggaatgaaagtgattaagttagtgttaactctctgggacttgtgagtagaagagaattttgtgtataaaaactacctatcaggctatctgaatggtcctaattagagacaaatactgccacttaaaacttacccagtgttcatctaattaaatgtaaacttttcatatctcatcatacttttctaatacataaattttttaaattacctggcaaacaaaaatattttcacaaattaggaaagtattgtctagctttggagtaagagagcccttctttagcaagacaggaaacccagaagccattaaaagaaaagaaacacctttgaccttagcaaaaagaaatagtggttataaaagatgaaattaaagccaggtgcagtggctcacacttgtgatcccagcacttcggaagcctgagtcaggaggatcacttgagcccatgagttgaagaccagcctggacaacatagtaagaccccatctctacaaaaaatttttaaaattagccaggtgtagtggcatgcacctgtagtcctagctacttgggagtctgaggtgagaggaccccttgagcccaggaagtcaaggctgcagtaagctatgattgtcccacagcactccatcctagacagtggagcaggactctctctctaaggaaaaaaaaatttttttaagacaaaattagcaacaaagtcctgagacaaatagtaaagcaagaaagaatatttggcagtcatgacaaacaaaagtttaatatcccaggcatagagaattcccagaaattgaaaagataaaaatagagggaggcagtaaagtggaatgtggaacaagggatttgaacaggtagcttatgggaaaggaatttcaaatgaccagaagatacactgtatatggaaagaaactaagatttgataggaaaagttttaaaaggtaattagcatctagtgctcatgagaatgtgggtaaacacatacttgcacacattgttggtgggatcttgaattgctagtctttttggagagtggtctggaaatatcaaaacaaattacatagaccttttaacccaacagtactgtttcagggatatattctgtagaaacaaaatcaccaatatataaagatgcatttccaaaggtgtgttttagaatatattaatggcaaaaagctgcaaacagtttaaccaaaagttaatcagtgtcaaactgattaaccattaacaaggaaatagttggttaaattgagataacttgtactgtagaatattatgcagcaattaaaaataagtattaggaaacaaaaaggttgggaagtgcatgtctagtgagttaggaggagctaggagggccaggaagagggtctgtcacttactatttttgtctaaacatacttccctcgtctctgaaatgggaataatgtattcctcttgggattcttgaaaagaatcaaatgagtaattatgtttgcaaatgccttgtaactcaccataaaatatgttcattttcctaactactcttaatacatgattggttagagacctacagaaatggcacttgtgaagtctgggatgaactcctttcttaagaattatactcattacagaaaccctgaatggcagcctgtacttagcatcaatttcttaagcttgctttgagaaaaagtgatttttttctgacatcattttagaattgcctggctatcttaatacagatgctctgaggccaggtgtttggctcatgcctgtaatctcaacatttggggaggccaaggcaggaggatcgcttgagccttaggagttcaagcccagcctgggcaacacagtgagtcctcatctgtacaaaaaatcaaaaattagctgagcatggtggcacacacctgtactcccagctacttgggaggctgaggtgggaatgtcacttgagcctggggggtcgaggcttcagtgagtcatgattgtgccgttacactccagcctgggtgacagcaagaccctgtctcaaaaaaaaaaaaaaaaatacagagctctggtatcaaacctcagacctactgaattcaaattcttagaagtggggtctttaaatttatttttattgttgttgcttttgtgtgtgtgtgtgttttttttgagattcaggaagacaaaagtttcttaaattcctgttaagttactcaggtaatcctgctggtcaccatgaaaaatagctcgtttaaagtttaaatatctgattctaagatgtactttttcccccacttttaatgtttctgcaatagatttcgtattacgttaatgtatgcacaataatgaacatttatgtgagctttgttccaagcacttttcaaagcattcttgcatgtattcttcacaataacctcaagtgaaagataccattattttcctcattttagaattgggaaaaccaaggcacaaggagataaatatcttgccttagtcattacaaagcaatatcttgatatgtaaatgctaatctggggcctgggcagtttcaactagaaatatacgtaagatttcagaaagaactcataccagtttggtcttatgtcttttcttaagttcttactgtgatgatatggttcattaaaattattttttttctgatacattctaattaacatgaaatcctttatgtactgcactagctttaaaaaataataataattttaagagactccaatgaacattaatgcatttttttatttatgcacagcaattatattccagaagtgagaatcatgtcaattcccaaccttcgctacatgaaggttagtaccttgctcattaacaggaagaaaaaggattgatcaatgatgtgtgtacatgtgtatgtgggtggctgtgtgtgtatttggcacaggatccagtgagcaagggatagaaaagaagacagtttgggataataaagactaaatttgttgacactgagattcttgacaacagcatctgatgaaaagtagggagaaggagcagggtgcacattatgttaaggtgaaattataggtggggaaaagaaaggagagaatgttggatcccacaggcatcttttgttcttctccagcctagagattctcttcgatctcctgtttgttatgtttcaggtactaggattcagttagatttatataccacagcccttctcttccttggagtcctcatctactccccttccttccacacacacacccagtgaattgtagaatattctgcagcaaactctttaactcttctttcatgctgctcctgaaaacacaaatatttattacatgggccttcatttgaaagatttgttttgcttatctagagagggtaccaaacaaggacaaattatcacagttcaagaagtcttaaaaagtttttataaggtcgggcacggtggctcatacctgtaatcccagcactttgggaggccaagataagtagattgcttgggtgcaggaggtcaagaccagcctgggcaacatggggaaaccccatctctacaaaaaatacaaaaaatttgccaggtgtggtggcgcacacctgtggtcccagctactcaggaggctgagatgggaggatcacctgagcccaggaggttgaggctgcagtgagccatgatcatgccactgcactccagcctgggcaacagagtgagaccttgtctcgaaaataaataaataaataataaaaattttaaaaagtttttgtagtcttggtgtgccatttttgctctgttcatgcatctgactggcctgtggctcccatattttatttatgagggcctccttttcagtccttaagtggcagcctgggtgagacaagagttttaacttcacttagataatgaacattcctcagaatttctggatctagtaactggccctttcagtggaatctgtcccatttcctcagtgaaatagcaactccagagagtatttggtctaacatatagataatagaacagggatcagtaagcacatagagaatacagtgatgtagaggtataagtagggcgtcattgcccaggagtaatggcggggatggtaattttgcgaaatattcggtatagcagctaagaaagtggcgaatgtctgagagatgtgtttcctattcaccaggagagccaggtcctcctgactcttacaaatccagttgagaacctcacccatgtgactctcttcgagtgtgaggagggggaccctgatgatatcaacagcactgctaaggtaggagcattttgcctcagcctgactgacccgcactttccctggagtgtcctcatttgacctggcttaaaagactccacacactctcctttccacatctagtcagcaagttcttttgattccacctcctaaatttttttactttatcctgaaacacactgccctatttgaaggtctcatcgtttcttacctggacagtgacaataacttcctaaatgaccttgctatttttataccaccacctctgtttcaacccatttcttctctcttgccaccagggtgatacttctaaaatctaactctgtgcatgctggtcatttagcattgctcttgactgagatgaagtccagatttttggcatagcataagagctgcttaatgacattacttctctgttcttccagtgtggtcttccttcagatcctcaaatttagcattccctgaatcgtacatattagtggttgtgatccagacagatccaatgggttataaactttgacactggagaattgtgtatgctattcattttacttagcatgcctccttcctatcctgactcccctaacatacatgccccttcagtctctcagtctcatacattcattcttcaacacttgtgaaatatcatttccttttagaaatgatacgtttaaaatcatttagaagctggtatgcctcctctagattcctctaccttacaaagagtatacataacatagcactaactagtctgggcttggtggctcacgcctgtaatcctagcactttgggaggccaaggtgagtggatcatctaaggtcaggagttcaagaccagcctggccaacatggtgaaacccgtctctactaaaatacaaaaattagccgggcatgatggcagatgcctgtaatctcagctactggggaggctgagatgggagaatcacttgaacccgggagacagtgattgcagtgagctgagatcgcgccactgcactccagcctgggcggctgaggtgagactccatctcaaaaaacaaaataactaaatgttaaagtaggtgattttgactcagtgtgagttgaatggatgtaatatggcctctctttatattttgctacttctagtacttgaaattttagaacaagagcctttctctatagatcatctattactaattcataattcagcatgatatttataatagaaatggtttaaaaagatgcctatatctttagttcttattcaaataatattagagaatttctgtcctctttttttttttcttctgctttttaatgatttcacttactagcatcacctccaaagagagataacacttatttcacttatttggtccttgttgcttttttttttttgagacggaatctcactcggtcgccaggctggagtgcagtggcgcagtctcggctcactgcactctccgcctcccagtttcaagcgattcccctacctcagcctcccaagtagctgggattacaggcgcctgccaccacgcccggctaattttttgcagttttagtagagacggggtttcaccctgttggccaggatggtctcaatcgcttgaccttgtgatccaccttcctcgggctcccaaagtgctgagattacagatctgagccactgtgccctgacgttcctttttttattaacactaataagcagctccagttaagacagacagaaataagtacctgatgcataagcacagcatatctttataaagctctctttatacctcccctcccacatttgtatctataattagaaatttgatcaacactgttaactgttaacctctgatagagcaaagttgaggcctaattacaacataagtctgaagaatgctaattgttttccatgaccataatcacccagtatctcatgtaagtttatgtatcaggtaccaggaatcagctggtaccatgtcaaaaaacattgtgttggaaccagtgtttctcctttgtgttgttcttaatgatggactgtttcagatgtatcaaaaaaaaatgaggaataatatggcaagtacccatttctccccatccccttaagaaattaaacattagggctaggcgcggtggctcacgcctgtaatcccaacagtttgggaggccgaggcaagtggatcatgagggcaggagttcgaaaccagcttggccaatatggtgaaaccccgtctctactaaaactgcaaaaaattagccaggcatggtggtgggcacctgtagtcctagctactcatgaggctgagtcaggagaatcgcttgaacccaggaggcagaggttgcagtgagccgagatcatgccatttgcactctagcctgggcgacagagtgagactccatctcaaaaaaataaataataaaataaaacattaaagacacaattgaagcccccatgttctccccagttcctcattgcagaccccatgaagtaagtactaacttagctttctcttaaaacctttgttcttataaactccatagaagtagtatatgtttcctgaaacttgctgtgtgcttccatttgtctaaatcaatgtcgtactttgctatattctgtcacactggtcccttctcaggcaggcctctctgtgttgctctccaggtggtggtgcctcccaaagagctcgttttagctggcaaggatgcagcagcagagtacgatgagttggcagaacctcaagactttcaggacgatcctgagtgagtgatctttttgtgatccccatacaacaaatggctgataatagaatgcccacttatatccagttttcttgtctggattttttaaaataacttttttcttcctgtttctaaaaataattattgtagaaaattggggaaatatatgtaagaccatgaagaagaaaataaaattatcccaccaccagagataaacaccattagcattttggcatttgtccttccaaatatttctcacctcattgggatcattctataaatacagttttttagcctttttcacttgaatatattttcccatgttaataaagaaatttttaattatatgattttaatggttgtggacaggatacaatactctgtccctagagattgatcatcgggtttgttccccacccccacccccttggaggaattaatagattttactctctcatatctaataactgaaaagaaccaaaccttccagtaactggggactgtgaccatcagagaattcagtctgtagactgaatgttttcaatgattcgaacagaggatttaatataaataattgttcacttgtgtaacttaaaaagtgaaaaagaacactgaagtagcaattttatgctacttcatgggcataaaatttcaaagatagctatttgatgagccagctaccaccccttaggtggagggaacaaagggaaatagttagaattattaaaatttagaacttaaacaaagagctccatgtagctgaaactcaggcctccagtgagctgaaggggaacactgcttgcgtggtcctggcatctcgtgatggcaaaggaggggtggcatgattatacaagaattggaaaacttcaactgcttactgccacttcctcctgggtaaagaagcattgctgggccgggcatggtggcttacccctgtattctcaacactttgggaggctgaggcaggaggattgcttcacaggagtttgaaaccagcctaggaatagagttaagactccgtctctacaaaaaaattttaaaaatagccaggtgtagcagcgcatgcttgtagtcccagctactcaggataccagggtgggagaatcagttgagcccggtaggctgaggctgcagtcagctgtgattgtgactgtactccagcctgggcaacagagtgataccctgtctcaaaaaaaaaaagacatttttggagtgatggccacagggaacagggaccacaagcaaacaggaatctctaaaggaagagcaagacccttcctcctccagacttctagtctccctttagagcccgctgctgacagaacctgacaaagagccatccgatccagcagatacagtccaagcagaatcctgtgtcacaaagcaaaattgagagaggtgcgcttggagctgaaaaataatagcttagtaaactggcacagggaacattcacagtctttgttttgtttttagagaaggagtctctgtcgcccaggctggagtgcaatggcgtgatctcctgctcactgcaacctccacctcccgagttcaagcagttctcctgcctcagcctcctgaggagcttgtattacaggcaagcgccaccacgcctggccaatttttgtatttttagtagagatggggttttgccatgttgcccaggctggtcttgaactcctgacctaaagtgatccacccgacttggtctcccaaagtgctgggattacaggcgtgagccaccatgcctggcccatttacggttttttgacagaatgatcaaaagctttctcaacaagatattagagagaagagataacaaggtgggttagaaaaataaagtgaagccaggtgtggtggctgatgcctgtaatcccagcactttgggaggctgaggcaggcagatcacttgaggtcaggagtttgagaccagcctggccaacatggcgaaatcctgtctctactaaaaatacaaaaattagccaggcgtggtggcacgtgcctgtaatcccagcttcttgggaggctgagatgggagaatcacttgaaccctaggggcgggggttgcagtgaactcagatcacgccactacactccagcctgggcaacagagccagactccgtctcaaaaaaaaaaaaaaaagaaaagaaaagaaaaataaagtgaaggcaaaggtgagattagtttagtgataccaaacgtgggttaacttcagaaagcaccaggtcaagtgttgttttgttttgttgttcgatagcattccagaccctaaccccagaggattttttttagcaggtctagctagggaccagaaatccaaatttgttttggaaaagcttcccaggtatcagtggttgcctgggaaattaaggataaaaagaaagactgatgtttttctttttaccattttaaactgtttgaattattttttacatgactcatacaaatcaaaggtctggttagttactgtaatacaaaatgtgctgagttgtacagtacaaaatgtgttctctcaaatccttgctttatgtgggtcctcaaattaattaggtacagaaatttgttaagccaagatatacttctggaatgattgtctgagatatcagatttcagcctgattacatgatagagtaattaaaaactgaattaattatattttacattattagatttaatagaactttcagatttctggaaactaacactgtataaatatgtaaatatgtaatcccagtaacctttcttagagtaactgaatgtcatttgggtagtagacaaattctgtttatttcattgcccttttactttcagaaactaagttattaaagcacaaactgtatgcacaaatgaggggaaattgaaatgcaaacctcaatgaagagacatttttgtgctaaaattcctaattacataagttatttacaaaaacattcttgatttatggtgttccaaaatttcccttaaagcactgagttattaaaacttcccacagtatggccaggcatggtggctcatgcctataatcccagcactttgggaggccaaggcagaaggatcatttgagcttaggaggtcaaggctaccatgaactatgatcgtgccactgctctccagcctgggtaacagagcaaaaccttgtctctaaaaaataaaaataaggccgggtgcattggcttatgcttgtgatcccagcactttgggaggctgaggcgggtggatcacctgagatcaggagttcgagaccagtctgaccaatgtggtgaaaccccatctctactaaaattataaaaattagctgggcgtgatggtgtgcacctgtaatcccagctactcaggaggccgaggcaggagaatcgctggaacccaggaggcggaggttgcggtgagccaagattgcgccactgcactccagcctgggtgacagagcgagactccatctcaaaaaaataaataaataaataactttccacggtatgagtctatgttctatagaaatattgcatttgcacagaggtaaatgtaaagggatgtttgcagcaccattgtttataatagagaaaagttgtcagcaacctcagtatatgccaattatggtaaacacataattgaatactgtgcaaccattacatagattgtagatgatctgtatataccagcgtcaaaaggtgtttgtgataaacagagttaaaaaaaagcaagttatggaatagtgtgtaccatctgtgttggttagaaaagcagaaaagtataagctcatagaaaaatatatggccaacgtgttggcttatgcccgtaatcccagcacttttggaggccaaggcaagcagatcacctgagccctggtgttcgagaccagcctgggcaacgtggcgaaaccccatctccaccaaaaaatatacgtattaatatataaagctagccaggtgtggtggtgcatgcctgtagtcccagctactcgggaggctgagatgggagagttacttgagcccgtgaaacagaggttgcagtgacccaaggtggagccattgcactccagcctgggcgacagagcgagactgtgtctcaaaacaaaacaaaaaaatacttggtaggttaagaacaaagtgtttataggttttctgtgtgtgctgaaggaaagaataaggtgaaagacttttactgtaagtcttagtggtttggctgatttttttatctacctaatacttgcttttttttctttccatagcattatagccttcagaaaggccaacaaagtgggtattttcatcaaagttacaccacagcgtgaggagggtgaagtgaccgtgtgcttcaagatgaagcatgattttaaaaacctggcagcccccattcgccccattgaagaaagtgaccagggaacagaagtcatctggctcacccagcatgtggaacttagcttgggcccacttcttccttaaaaggttccactggagggcagatcccaaaggacagtatcaccgtaaacctgcgttaaaatgtggaagctgctgcttcattaggccttgtttataacgatgtacccatgcactacggaattctattgctaagaaagtgggagcataggcaaggcattgggaacacagggtagctgctgttgctcttgctctcacccctgttgacaccagtaagtctgtgtctccctcactgaaccctgcacgttgagtaacagcagcataattccatcctaggaaaggggatgggtgttccttggaatggcattgtatttaccacctgagaaactctgtactgtctcttgatctgatctcactaaggatcacaatgtcacagatgaaacttaaatgataacccaaaggtagacctgctgttaatgatccagcattggtcacaatgtaccaactgctttctgcattccgttaaatatcatctaacagtctaaaacatatcccttcattgccataatggctgccattttgccatagatttccatataactgaaaaactgaattgtcactttatctttagtatcatgatgattggaaaaacctgtgaagttgttaaggcactctcatttgccctctttttctaagtgaatacaggacacgtattagttgttcttaatttttttcccagtaaaatatggatcttttaagaagaatttgagaagcaaacaattacatgtcatgtcaagggggtagcagattccattcgttttcaatattgccacaatacccagggattaatgctgccacaggggggcaatctttatttgtcttacttcctaccccttccctgttctgcctctttaactcagttaagttgttctgtttgggacctggaaaagaacccaaagaaaacctgagtggacaggttcatttctggaatgcagaaaacattttaaaggctagatttttagaatattctcaactagcattctttccattgatttgaaggggaaattaactattataatctcttgaatccaaaactggatattaagaactttcccccttactaagtttaagacttttgtcatgtggtgagtcaaataagaccattttgattgtaaaccataaaatagttcagcaagtagcccacagttctggcctaacagcagacttgctgttttcacttggtatcctggagttgggttgctaaccttaatttctatgatgttttctaaaatgaaacttgataaagtagaccaccagctgcaccgtgttttctgtaaaagtattgttagtaagtggccaagagacttgaggaaaatacagattttttgtttaccttggtcttgttttaagtcttaaaaaattaaagataacattataatgtagaatacagatgggacatagtccttgtaagcttcccttgaaaatgttttaaatatttaggaagcttttaaaagacactaaattgtactctaaaagacactaaattgtactaattgtacaaaggtcaagccaattttatgaaacagtcctacagagtaatatatgtgatgcagtgtaagaaggaaaatactcatctctaacattatggtaataacatttagcctcttaggagttggagcagggggatgggtaattacagatttgcagactatagaaagagtttcatttttttgtgaccccacagagtctcaaatttttatttcactacctgctagagcctactgtgaaatcactgctccatatttgccagtggaggaaatgggcatagagtagagaatagcttcatatgtttacacgtttgcatagactacacacatgtcatgcgtttatggcaggtagctggtatttattccccaaagtaataatgttgaagtatgggtctcatcattcccatacacagaaacacaaaacactttgatcataaacttttttcttcagaagccaaactaacttgcagaataatagagccactggtttaatgtttcctcaagataggttttagtgtaagctagtattctgtgtgttcgtagaaatgattcaatacctgcagctggtgaattaggaattgtatttgttgccttttttatattagatgaggtgcaaaaattttaatgctagtcagtatgcaccaccacaggaaagttagatcccattagcacttgaaactacagctttggaaacttaggctaagttaatttggatttgttacttgattcacctactgaccttttcttttgtttgaagtgcttatcagcataatgagctaagtgtcatgcatatttgtgaagaaacaccctttttggtcccttttgggacagagaggtactccttgatctttatgaatgacaggttactgttttgccttattgcttaacttaatgtagtgaaataaagcagacaaagcttg

SEQ ID NO: 38270 - DNA, 37035 bp, Homo sapiens
acgtgtccgccggagtttctccaccagcaacatggccgccgcctgagaggagagccgggccgccgccgtctctgcagcccgcgggtaactgggccgttgccgccgtccgcgctcggcccccgcggagaggtgagtcccgtcttggcagtgcccgagctggggcttgagccggaccgcactcacgacgtgggcctgggctagattcccgagtaggccaaggaggcccgcgccgcgctgtgcctagcagctggaggcctctcgggactcgggcggggaggaggggcagccggctccaggccgaccccggactctgacttccttgacctgacacctgggagttggggaggccgcggccgacgctggcggcggtgactcagggtccagccgacctgccctatccgggcctgggaggcctcctacggaagaaacacctgtccgcgcgtcgggtgtagtggcggctcgcggcagggactgcgtggtgggcgtgagaaggggggcctgaccacccgcgagggagcagaaacccattggacagcgaggctcgggatcggcggcccgccccgatgggcagggagggcacctgcgcctgccggagcccccacttcgcagctgaaccggattagcctctgcccggcgaggccagggattcctcattcatttattcaggcaaccattcagtgtttaccgagccaactctgtgttccggatacagccctgaccattcggtccgaggaggtgtcagtaaacaaacaaggtcgttcctttgggttagctttagaattccttgggcttggaggcggaaagaagagatcttagcgatctccacagtttcctcatctgtgaaatagagataatagaaattcctacctcatagggttgtggtgacggctcagtagaaaccgggtgacgctcctgcttgcagcgtttgacttgtggcttagcgtcattacccgcttacgttggcagaaaacatgttgtcaagtaataacaaaccttcccagaggttacgtttattagcgtcctgtccttactccttccccgcaggggtctggaggtcggtacttagtttccctactttagggatgaaaatagggaggaataccaaacccagacaactcaggtgggtcacagatgccaagcagctgtggtgggatttgaacctgcacagttttgttctcgggtccaagctcttacccacttaaccatactgccgtttatcagaaaaccgtgcagtatagtggttaagaataagaataaggatctttgacatagcgagacccaagtttctgtcctcattccaccttggatgagttgcttatatctgaacctcagtctcgtcatttccaaattgaagatgataaatctctattgatagggctaatgagaagattaaatataaagtattctttgtactatattgagtgtcaacttcgtgccaggcactgttctaggtattgagagaaccagcactggattttttttttaaagtaatgctccccataacagctttgatgaagtaaagtatgattgtctgcatttcatagttgaggaaactgaagcactgagaagccttcatggagcttacgttctattgcagaagacaaacaacacctgagcaaatagaccaggtagttccagattaagatgagacccaccaaggaaagaaaacagagatgtggtagggcctgggaggaggctgggggaggcttttaaaatagggtggtcagggaacctatcctctcctgcaggcggtgatgatatttaataaaaaggagcaaccttggaaatccctgtgggagaatagatgatgtgcaaaggacctggggtggactggggcttgccttgttggaggcccagcaagtggctaccagcctggatggtgaggggaagacagagacaagattatgtagggccttaggtggctcatggaaaggagtttgggttttattttatgtgacagtggcagttgacaggtcttaggcagggaaataatatgatttactttttttttttttttttttttgagatggagtcttgttccgttgcccagactagagtgcagtggcaagatctcggctcactgcaacctctgccttctgggttcaagtgattcttctgcctcagcctcccgagtagctgggattacaggcgtgcatcaccacgcctggctaatttttgtattttaagtagagacggggtttcaccttattggccaggcttttctggaactcctgacctcaggtgatccgcctgcctcggcctcccaaagtgctgggattacaggtgtgagccaccgtgcctggctttgttttccccccagtagagatcgagtctcacactgtgacccaggatggagcgcagtggtgtgatcatagctcactgcagcctcaaactcctgggttcaaccaatcctgctgcctcagcttcccaagtagttgggactgcaggccatgccaggctaaaatttttttttaaagagagaccggggggcggggggcgcctcactatgttgctcaggctggtctcgaactcctggtctcaagcagtccttccacctaagcctcccaaagtgttgggattaccggcatgagccaccatgccagcctgatttacttctttccaaagactcactgttgctgggagacttggaggtaggtataaggagccgtagggagacttggatgagtgcttttcacattgcaggttaaaatttattagtgggaagtaaaatcaatttaagggaattgaagctagcattttttgttttgaatgaagtagaaaacatcacggcctgacatatagtagggacagttatagttacgtgaaaccttgtttcagttatgcaactgtatgtatgttctgggttatttatatgagatggatttcttactgtggtggatcttaggctgaaaactttgaaagccactgagttggatcacctcggcctggaggatgaagggaggtgacactctttgtatcaacccagatgtactatccagaggaaggagctccagctctctagctgacagggcacctcagcctccctgatccctggcagggcagaggccaacagggcatagcaatagccaagaaagaacaattgcgtcttgggaacctcccaggccccagcctctcagttgtccactgcccagctgcagagaaggcaggagcttgacatatctgtggcacttggcagccggtgcagatggggtgaggccttgggctctccgctctacactgccctctgtctgcacagcagacagtcgagatgcactgaaactgtccagatgcgactcctgattttcattccatcctccatctctgggactgttacgatagctgtttccctgaagtttctctttctacccgctccatgtcttcctctgcccgaaatccttctgtagcttcctattaaatagcattcccatggttcatttatttagacaacaaacatgtattgagtgcctgctgtgtactaggcacttggggtaccacaagggacaaaatagaccaaaatctctgccttcacatagcttacagcttagtggcaatagagatgggcacagatgcagagctgtaaactgtcacatggtgatagacacctgctatggagaaaaccagagcagagaagggaattgaggggtgggggaggcagtttgcaatgtgatttggagagggaaggtcttagccacaaggtgacatttgagcaaaaaccggaaagaggtgaaggggggaccatgaggttatcgggggggtagagcagctacaaagccccagaagtgggtttggagcagagaggagggtaggaggcttgtgggagatgaggtctggcaggtcaaggggcaggagattgtttagggtttacatgggatgataaagactttggcttttgtctaggtgtggtggctcatgcctgtaatcccagcactttgggaggccaacacaggtgaatcacttgaggccaggagttcgagaccagcctggccaatatggcaaagccccgtctctactgaaaatacaaaaattagctgagcggatggtgcatgccaattattgcagctacttgggaggctgaggcaggagaatcacttgaacctaagaagcagaggttgcagtgagtcaaaatcacggcagagcacttcaacctgggtgacagagcaagacatgtcttaaaaataaataaatattagatagttcaaatgttaagtagatcagacaaaaatcatgctggtctcagccgggcgcagtggctcacgcctgtaatcccagcactttgggaaaccaaggcgggcagatcacctgaggtcaggaattcaagactaacctggccaacatggcaagtccctgtctctactaaaaatagaaaaattagccgggcctggtggtgcatgcctgtaatcccagctacttgggaggctaaggcaagaatcgcttgaacccgggaggcagaggttgcagtgagccgatcgtaccaccgcactccagcctgggtgacagagcaagactccgtctcaagaaaaaaaaaaaaaaaaattcatgctagtctcacccaagagcagaggtttgggaactgctgaggcctgggggtgcctgagtaccatcctacctatgaccacccctcttctctttgggtatgtgaaggggcagaccagctgaaatactcaacctgccccgtggagacctacagccttccctcttcctggaatttctcctcccctctgttgtcatgacttgcccaaagctctctcttcttccaggcgcacctaacgtgcctcctccccagcagaaaggcctttcccgcctctcaactcccctacctgtacctgtcacctgaggtcagacagcctggatttgaagtccagttcatcatcctgcttgctatgtgactttgggtcaaaatgcacacagtatctctgagttccagtctgttcattataaaacagtgacaatcaccacacctcatagggtcattgtgttgaatacaggacagaagagtgtgtgaagaggtcatttttagaccaaaaacacagaagagtcatctcactcaggattcgagttaaagtcagcttgaaaatcaaatatcagagagctttggactgtctgtcttcctgttcaacttctggctcctctttaaagcgtccccagggccctcagttctccagtgttttaatcatggctgggaccagccaacctctatccttctgtctggcagtgaattctctgtgagcagagaagaaaccattaaagccagtcatttgcctttccccgcaggtgcagcccacacttgttggcttggtctacccgcttgcacccgctgcttgagtgtttctttttttctttatttcttctggctgatggggtatagggttggtcatccattgttgacttcaatgtagatgtagaaagaaggtcagttggttggttgtgggctccccctcccagtgcagggcctgttgcagaataggcacaaggaaatgttggttgaacgactgatggtcccagtctctcgccctcctttgcagatcgagctgaaggactgcgcggctggctctcctctagtatggccaatgaagaggatgacccagttgtacaggaggtaactgctgctctctgtcccctgccgccggggctacaggcagtggaattgggtcctttccatgtgtcctcaggccagtctgggacctgttgatgttctgggacccctaacccttgctgttccctctgcctggtcccctctgctgtcccccagacccctgcgtggctgacctctcccttccttcaggtctctgatctggcatcacctcatcagggaggccttccctgactgcccttccacacccagctcccctcctgcaccctcccgtgcctctctctgcccttaccttggcggtaactcatacttggcctagcccccgtcatcccctagatatcagttgattgctttctttcccgtccactgctgtgccgcaaagccgagtatagtgcctggcacccaggtacccggcgactatttggtgaatgaatgaatgaataaatgggctcagcagtccctccttcccaggcttacgcagatgtagtcattcagcagctgttcactggaccactgtgtgctgggggctgtgacacatcagtgagcagggcagggtccccttccctgggaagctaatgggctgtgggcaagactgatgaggcaggagtctccgggtacaggcagtgggaggcagatttcccttttttttttttttttttggagacagagtcttgctctgttgcccaggctggagttcagtggtgccatctcggctcactgcaaccttcacctcccaggttcaagcgattctcctgcctcagcctcctgagtagctgggatcacaggtgcccatcaccacgcccgactaattttttttttttttttttttttgaggcggagtctcactctgtctcccaggctggagtgcagtagtgttatcttggctcaccgcagtctctgcctctgggttcaaacgattcttgtgcctcagcctcctgagtagctgggattacgggcgcccgccactacacctggctaatttttgtatttttagtagagatgggatttcaccatgatagccaggctggtctcgatctcctgacctcaagtgatcacccaccttgggcctcccaaagtgcagagattacaggcatgagccaccatggccggcacaggtttcccttcttagagaaagctgttgatagtcaaactcacctttcagaatccttttaacccaggacttagacctttggaaggcaaaaggcaaaaagtaactgcatctgccttcagcctccttatatgcggagcctgacctccagtgggaagggcaggggcaaggagaaggtcctcggagatgaatagaggtggtttttccttgcttgggggatgttgctaagttattagatgtgagttatttagatgcatttaagctgcatctacactgcagtagcaggagttacaacaggggggttggtgatgggatagaagagtccaagggactccgaggacagaggcagtgccctctgcagccagggggcctggaatgcttcctgcccaagttgtgcctcagccaagtccttggaggagcgagcagtcaaggctcaggggaggcatgtgtgaagggctctgtaggtatagggaaaagcatgtgcaaaggcccaggggtaggagagcatgtggtttataggaggagttaggaagcaggaaggtaaactgctgcgtggcggggtgggggtggttagtgttgggaagaaaggaagtggagccatcagtcacaaagggccttgcagaccccttaagaaggggtgacaggctggtccaggaggggcaggtggagggcccagccaggaggcacaggcctaggtgagccctcgcctgcctgcctctcagaagagcatttgcccaggctgtaggacgtttcccgatcagtgcagccccagggaagatgtgtgcttactgggggattgtgaacttgggtgggggtaccaggtgaactcttgccctggttcccctgggagctttcaggagggattcctgaatatacccagtgtgcagccttggatccgcttgcttttagcatgagctgagctatttcctccttccccaaactgcttccctgagccactgcccttaactgaagctggaagcgctggcatagcccggggaggtcagcactgtgtccagtctcccggttaagtcgtcttcccttcttcccagatcgatgtgtacttggccaagagtctggcggaaaagctgtatctatttcaggtaattatgggacttgaaggtaaagaggggagaagcaggtgtgggtgggtggtgtggactcaggaacacgggcaggaaacgatgggaaacctcagctagggttctcggtgtggagagtgtcatggggtctctttgctttcgtgggtgggttaatattggtctcatttcaaagatgggaaaactgaaggaacacaggagaggcagaagtgtgcagcagttaaagctggggctctggggtcagaccggattgagatccaactccatcacaccatagctgcgagaccgtgggcaagtttcttaatccttctgtgcctcactttcctcacttgcaaagtggtgatggtgataatgcctgcctcataggtccccaggaggacaggctgagtccacagtgaagtgtttaggatgccgcctggcagagagttggtgccagtgatgatggccgctgttgtcatggaggctccaaggggcagctccatggcagcgtctgtgagccctcagtcctgccagctgcgagggccccgggttgctacctctgccccctccccttgctgctgggccagcagcttgtcattgtggccaacatgtattgagcattgaccgtatgcagactgttgaaagcatttacctcagttacctctttaaccccacaataaccctatggtggtgattattacattttataaccgatatattgagatagaatttacacaccacacagtttccccatttcagtgtgtaatgcaatggattttagtctactcatggggctgtgcaaccagcgccacagtctgttttgggacagttttgtccccctttaaaggaaccccttgcctattagcgatcagtctgtgccccccattcccacctccaaccccaggcaaccattccccttattttctgtttatggttttgcctattccggacttttcacatagctggaatcatgcagtatgtggcctgctgtgattggctgctctcactttgcatgatgttttcagggctcatccacatggtagctatagcctgcatcaatatttgagcttttcttttttttgtttgtttgttttgagacacagtcttgctctgttgcccaggctggagtgcagtggcttgattgcggctcaccacaacctctgcctcccaggctcaagtgattctgcctcagcatcctgagtagttgggactacaggcacgcgccacaagcccggctaatttttgtatttttagtagagatggggtttcactatgttggccagcctggtctcgaactcctgaccttgtgatctgcctgcctcggcctcccatagtgctgggattacaggtgtgagccaccgctcccagccaatatttgatcttttactgatgaataatgttccattgtatgggagaccacagtttgtttatccattcatcagctgatgggtatttgggttatttctactttttggctattataaataatgccactgtggacattcacatagaagtttttatgatgaacgtgaattctcatttcttctaggtatatgcctggtagcagaattgctgggtctgcgtttagctttttgaggcactgctgggctgctctgccccatgttgccttcccacagttagagtcagtgttcatatcccatgatgcacatgagaacgtgaggcacagggaggccttcacgggcacggaggcctggggcatgccacagcagcaatgttgtaagcctgtgctgggagggcctggcctccactccctggggttcacccttatgggccgtgggaatggggcctgtcctgtgtgcctgctcaccctgtttccttgactggctgcaaagtgatggtggaggtgccagtgacccccgtgtgtccagagttccaaaccctgagccaccatcggctctgtttgcctcctccgtgctcacagcggccttgggaggtgaggatgcttagcctcagggaggcgaggtgcctgcctgagtccacagttagcaaggggaaggatgaggactggaagccaggcctgtgatttcagaacctgcgcccttcagccttcccacccccagtcaggtgatctcagaactgcccccagccccagcccaggaagcagggaggagtcacggctttgctgtgtgagtgagcttttaggaaatgaccgtctccttgcgctagaatgtagctgatctgaaagggcctattttccgcactgccatacctccaccaggctcattctacaggctgtcatgagaccaggcagagcttttgaggaggggtccagactttgactccttcacctgagagagagagggacagtgtactgtgaggacagatgtggacaggagcccctgcgtgttgagcgcattgctgtgtgagccattcacataaagataagagcgggccatggctgcctggctcccttttccagcatcttgtgaggaagctcacacaaccagataaggagagcgaatggattcacgaattcccacctgcccgtcgtctggcctcagcagtgagcagcacgtgccggtgttgctttcactctttgcttcctcatggactccttttggtcgtccttctctccccggatggcctgtccactggtagttaggccctggacccccatcctcacctcccatggccgtgctctgtgggttcctggagcagcagcgtgccggtttgggttcctgtgtgtagacacgtccctcggaagtcagagacatcctgcagtggccctttggaaggaggccgtggggagctgatgagaatagggctgcgggtggagactggcaggggtgcctcatggtagggctgggcagcttgtacccttgtggtagggtaaggccagtctctgcttggggtgggcttggagatagctgttgattcttggccagggcccagctctgggcatggctgggcagagtggacttaatggctcccttcccctccccagtaccctgtgcgtccagcctcgatgacctacgatgacattccgcacctctcagccaagatcaagcccaagcagcagaaggtggggctgccccctgagggcagttggggccgaaagagagggtgatgagggtgggagctggtggaggcgagaagctcagagaaggagtcattggagaagtaggagaaccagcaactcccaggcccttgaaagctgaagaaggaaagtgtccagaaagacagggatgggcagctccagagaggccagggacgcatgaggctgatgaatgagagaatggggccagatgtgagcttaggttcccaggataagacgagggcgggcgggtgaacatggagtaggtttgatgggaagagaatctagcgcctatccatggagggtctgcagctctagcccctccagccacatggaagtgccatcccagtattgccagttctgctggcttttcaagagaagtgggaaataaggatttttatgagaaatctcttgatttttaaatgttggcacctaatttaggtctttgggagtgaagtagaggacaaacaagattacaggactctccacttccttctgacatttttgttggaatttgggtttgtgacccttggtgtggactgaagtccaggggcccttggggacatgtgtcagtctcgcttccgggcagggtcctggttaggaggtggccatggtggggttggggtgtcccttgaggagccatgccttggggtcctcatagctggtgggggtgcttggtgcctccaggtagagcttgagatggccatcgacaccctgaaccccaactattgccgcagcaaaggggagcagattgcgctgaacgtggacggggcctgcgccgacgagaccagcacgtattcctcgtgagtttccggccccaagcctgtccggtttccctgcgttcacacaggagcctccaaaagaccttaaagacattgaccccctttgccccgtcactgggctccccaccagtgtcccagcctttggagggctgggcctgtctcagactctgccctcctgaactagctggtcccagagctcctacccactcctcgtctcttggtctacaaacaaggccatgggttttctcatccccaggctgccctcctgagacccgcgtaggctgccctgcggccttggtccctggctgtggcacttcagaaagtgtctagggggtggggtgcgctgtggccacaggccctggctcggagctgccttcccctgtgacgttgcttctccctgtgctccaggaagctgatggacaagcagaccttctgctcttcccagaccaccagtaacacatcccgttatgccgctgcactctacaggcaaggtacccggggctgggtgtcccgcggtggggacatggcattggggggggctgggcagggagagtacctccccagcctggtgtccatctcccacctgccctgaaagctagacacctgtgggggccgggcaggtgtggaaataacagaaatgacacattgtcaggggactggaagtggccacctttgtggactgctggctggacactgcctgaccagatggggtggggctccaagttcatttgtcctcccgggacacagatacatacaagtagctaacataagtttagggacagaattttgtctttaaatatgaagcttatgacagagcaattccattcctaggcagcatctatccaaaagaaatgaaaacatgtgtccacacaaaaccatacacagttgttcacagtagcatcttcatgatagccaaaaagtggaaacaacccagatgcccatccgctggattcatggagaaacagaatgtggtccattcacgcaatgggatgttatttgaccatggaaaagaatgaagcagtgatgctaccacgcagatgagccttgagaacattgtgctaagtgaaagaagccacatgcttcttcactcgcagctacgcgctgtgtgattacgtctcagtcagcgaccgaccacatactcaacggtggtcccataacattataatggagctgaagaattggcttacctagtgatgtcttaatgagcctgaccctgtgtaagcctaggctaactcgtatgtttgtgtcttaggtttttgcttgttcgtttgttttgttttgttttgagacagagtctcgctctgttgcctaggctggagtgcagtggcacagtctcggctcactgcaacctctgcctcctgggttcaagcgattctcctgcctcagcctcccgagtagctgggattacagacatgcaccaccacacctggctaatttttgtatctttagtagagatgggattctgccacgttggccaggctgatatcaaactcctgacctcaggtgacctgcccacctcggcctcccaaagtgctgggattacaggtgtgagccaccatgcccggcctgtgtcttagtttttagtagaaagtttaaaaagtttaaaaaaaaaaaaaaaaaggtaaaaagcatatagccgggtgtgttgcctcctacctgtaatcccagtgctttgggaggccgaggcaggcccaggagttccagaccagcctgggcaacatagtgaaatcccttccctacaaaaaatacaaacattagctgggcatggtggcacatcccttagtcccagctactgaggaagctgaggtgggaggattgcttgagcctgggaggcggaggttgcagtaagctgagattccgccattgcactccagcctgggcaatagagcaagactctgtcttgaaaaaaagcatatacaataaagatatatttttcataaatttatttattgatttattttttggagagggagtctcactctgttgcccaagttggagtgcagtggctcaatcttggctcactgaaacctctgccttccggtttcaagcagttctcctgtctcagactcccgagtagctgggactacaggtgcacacaccaccatgcccagctaatttttgtatttttagtagagacagggtttttgccatgttggccaggctggtctcgaactcctgacctcaggtgatccaccagccttggcctcccagagtgctgggattataggcatgagccactgtgcccagccttttttttttttttttttttttaataaatttagtgtagcctaagtgtgcagtctgtatgaagtctacagtagcgtgtagtaatgtcataggccttcacattcactcaccactcactcatccagagcagcttgtcctataagctggttttagtcttttatactatacttttactgtaccttttttatgtttagggttttttgggtgtgtttttttgttgttgtttgttttggggttttttttttggagaccgggtctcactctgtcacccaggctggagtacagtggtgatcatagctcactgcagcctctatctcctgagctcaagcaattgccttccctcagtctcctgagtagctaggactacaggccatgccaccacatctggctaattttttaaaaaattttttgttgaggtggggtcttgctatgttgcccaggctggtctcgaactcctgggctcaagcgatcctcttgtctctgcctcccagagttctgggattacagatatgagccactgcacccagcctaggtatatttagatacacaaataccattctgttacaactgcctacagtattcaggggagtaacatgctgtacagtgtgtagcctgggagcaataggccataccatagagccgaggcgtgtagtaggctctgctatctgggtttctgtgagtgcactctgcgatgtttgcacaacgatgaaatcacctaaggatgaatttctcagaacgtatccctattgttaagtgatgtgtggctgtatgtgaaatgtccagaataggcaaatgtacagaggcagaaagtagattagtggctaccagggactagtgggagagtggagtggggactgcctggttctttttgtggtgatgagaatgttctaaaattggttgtgctggctgcacagctttgtgaatacgttaaaatacattgaattatggccgggagtggtggctcatgcctgtaatcccagcacttttggaggccgaagtgggcagatcacctgaggtcaggagttcgagaccagcctggccaacatgataaaatctcatctcttccaaaaagtagaaaaaattagccaggcgtggtggtgagtgcctgtaatcccagttatgcaggaggctgaggcaggagaatcgcttgaactcaggaggcggaggttgcagtaagccgagatcgcaccactgaatatcctgggcaacagagtgagactccatctcaaaacaaaaatacattgattagtatgccttaaatgagtggactatatggtacgtgagtcttgtcccaaagctggtaaaaagtacaaggcgcggccgggcgcagtggctcatacctgtaatcccaggactttgggaggccaagacgggcagatcacaaggtcaggagatcaagactatcctggccaacatggtgaaacaccatctctactgaaatacaaaaaaatttagctgggcttggtggcacacacctgtagtcccagctacttgggaggctgaggcaggggaatcacttgaaccggggaggtggaggttgcactgagccgagatcatggcactgcactctgcactctggcctgggtgacagagcgacactccatctcaaaaaaaaaaaaaaaaaaaaaaaacagtaaagtgcttaagtatttagtctcaaaagcaatgaacgaaactaatctgaacacttaggaaacaaaatgggataggatcaaaagtagtgtcatataactcgcgcgttctgtttagaacccatgtctcaagcatgtaattcttgaaagccacatcccttgcagcgggagggaaagtcatgatctttatcagaggccatgtggacactccacccagttctagcagggcctcttctccagccacagtggcactagtggacttcctagtggaacgggtgggattttggcgggaaaagatggaggataagaaggagaggaaatccaggtgtgtggggcgggacagtaaggctgagctggccgaggcctggagggtaaacagcagggcgaatttgatgaggattagctgcctagtgttgcaaagcgagcagctggggagaggggcgtggaaccagactgggaggtgggactgaaggaagtggcttcgaacagaagagtccaggttcctgtcctagtctgggctgtgtgcttgctgtgtccagcaggccaggtggaggtggggatggtccctggcctggtggtcccaagactctaggattgggggctgcagcgggaatgggaggcggtttgatggtgggcctaggccttcacgggacttggtgactctcttgagccaaactgggtgggtttctagagttgagtccaagcccttcttcctccgccaggtgagctccacctgacacctttacatggcatcctgcagctgcggcccagcttctcctacctggataaggctgacgccaagcaccgggagagggaggcggccaacgagggtgagcccgggatccccagccctgctgcctgcctgccttcatcctggtgggatggcttggtcctgggaagagggatgggatgataggatgtttagcaggatccctggcctctacctactagatgccagaagcacccaccccacagtcgtgacaatcaaaaaggtcacattgcccagtatccccagggtaaaggggcaaaactgtccccgattgagaaccactggcttaggcagctccctctgcgaggagaactcccagcaccccggcctgaggcttccctggcgggtggggttgagagaagggaggtggaggctccccaggactgcagtcagtggcttgtctctcttgcagcaggggactcttcacaggatgaggcggaagacgatgttaagcagatcacggtgagccctggcccctggaggaggagggtgctgcctgggcggcagcaggaccagagaccaaggggtagcgggtcttcacagaatgcaggtggagcagacagggcccatgcttttgagccttcttgctgggctacctggagggaacaacctgagttgttccagctatacacaagatggaagccctggctggatccaggagatgtgtgcctggggcttggctagagtcacctgggagcaggaagctggggccaggagccctgaggacccgcagaccagctctgccatgaacctgtatcttaacagagccaaagtcaattaactgtgattctatcctctttatggggcacggatgaatagttttcgttttaatagttattcctgaattttaaagatttttcaaagaatcttaaccttccatttatggtttgtaaagttttccctatttaagcatatttagattaaaatgagtagtaccaaaagaaaaatgctacacgtagaatgatgatacacaagtatggctagagagtggtgagtgtttggaagcccttgaggaccggggaacacgggcgtaatggacatggaggtggcgcagggagctcatcctgttctctccgtagcttattaggaccttagaaactcccttccgctctggggaacttagaaaaggcatcctgggcctgtctgctttaaggactctgctggctctggcgcctgggactctaatccccctcaagcctctgggctgggcaggcacgagcaagtataagccgttccctggcgtgtgcaggcagctctgggagggacacggttggaacggaatttaaacgacctgtgctaggaaaggaagggagagtggaaaacccctatacggagttctctggtcttctggcaggggctgagacggcagtccagcaagggtcacaggcctgacggtatgacctcttccccttcccaccgcaggtgcggttctcccggccggagtcagagcaggcccgccagcgccgtgtgcagtcctatgagttcctgcagaagaagcacgcagaggagccctgggtccacctgcattactatggcctgagggtgagcggggcttcgtggggtcctgggggaaacacctcggtgcccggaagggtcatggtgtggcctccgtgtctcaccttgaacttaagtcaaattcatgagtcatagccacagatagaggatcgagtcctgtgggcagtttacacttcactccagccgagccacttagcgtgggccccaggagagcaagaggaaaagatgcgagtccttggttccctgggtggggtttggcccctgggcatgggcatcttgctgggcttgcagtggggctagtgcctggtaacatattttcgctgcagcccaggccctaaacgcaggccagatgcattctccggttctgtcctagagggtcggtcatgtgttgccaccccagagttcccagcaccacctgcccaggggattttcttactgtgcttggttttcatctggtacgctgactttatttacttttatttttatttatttattatttatttatttattgagacagtctcattctgtcacccaggctggagtgcagtggctcgatctcagctcactgcaacctccgcctcccgggttcaagtgattcttctgcctcaacctcccaggtagctgggactacaggcacctgctaatttttttgtttttgtttttttagtagagatggggttttgccatgttggccaggctggtctcgaactcctgatttccaagtgatctgcccacctcaggctccctaagtgctgggattacaggcgtgagccacgaccacctggccctggtgcattgattttagaacctaacccttgaaactgtgtactgagtgagggatgcttccaaagacaccatgggccagggctcccaatattttctggggtggggaacaactcctgatttctctggaaccttcttggaagagatttgtgttaacagacccttagactcggggtcaaacttctagacactgctgtttcctgctgtgtgaccttgggcatgttagctaacctctctgagcctcagttttcttaattataaaatgagagtagtaataatagtacctaccttgccaagttattttgagggtgagatgggttagtatatttacagtcagtggaacagagtccaccacatcctagatgcccagtgaatgttagccatcattttgtcattgctggtggtgtacctgtgttacagacaaggcatcgaggcttgggggctggggctgggcaggtcataaggccaggaagatgagtggctgaggccacgtcagaggccttgggtgccgtgctcaggaggttggatgtggtcctgtggctggccatggagtggaagacgggaggccttgggggagggggcccaggccagggccatcagctgaggctcctctcacaccctgccctcctccaacaggacagtcgctctgagcatgagcgtcagtacctgctgtgccccggctcaagcggggtggagaacacggagctcgtcaagtcacccaggtgggatgggctgggccagcatgcaaactggatgcctgcccagggtccccaggggtccttggtgtggatcctcccagaggactgtggcccctcctgtagcatgagggtggagcccattgtcccctggagaaggccaggagggtgggcctggaaagagatggtccacttttctgcaggggctcagggctgctgggggagggcgggggtgggctgtctgcaccctctccccagaccctcacttgggtggctggtgaggagggtccagcctggatcagccctgagcctctgcccctgccatgtccctgcagtgagtacctgatgatgctgatgccacccagccaggaggaggagaagtgagtagaggcggcaggacaccctctccctttccgggctggctgcctctaacccgtcccctctgcttttcccagagacaagcctgtggcccccagcaacgtcctgtcgatggcccagctgcgcacgctgcccctggccgatcagatcaagatcctgatgaagaatggtgggtgcctaccccctgcccacccgggggccccagtcccagtggctcctgaggaatggactctgtgggacagtgaggaccaggggacaaggccagaggcccctgctgcccacagcctgcccagctttgcagctgcatccttgtctggaaagataacgcaggacggcagtgcggccagctcccgcaggcagcccgggttcccgtgaatgtaggacagtagtgtgtctggcccccacaggcgggctcgggttcctgtgccatgctcaccacttgtctgccatgctcttgggcaggtcatgaacctttctgaggctttgtttgtttttctgtgaaaagagactaatgatagttcctgggggccaatgtgaggaatcagagagaggaggcttctaaagtacagggccttgcaggcgaacacggactaggggctttttgttgttgttgttgttgttgttgttgtttttttttttaaggtttttttaaaggttttaaaggttttttttaaaggttttgctgtgtaactcctgggcccaagtgatcctcctgcctcagccttccgagtggctgggcctacaagcagacgccattcactgcaccggctcaactagggtcattttcatgacaatgtcttcactggcattgcttctgggtactcttgccagacctggcaccataaggactggtctccttttctcagaggactctgagtgccagaacctttagggtacccgtggctggtgaacaacagacctgatccttgagttcagaatggagccgcagaacctgggctcgtcctttgagatgccaccatgagctcttaggagtctaaggagagaggggagctccatgatatgctcgggattttaggcttccttcctgcagaggacttcgaactttttttttttttgagacagtcttgctctgtcacccaggctggagtgcagtggcacaatctcggctcactgcaacctccgcctcccgggttcaagcaattctcatgcctcagcctctggagtagctgggactacaggtgcccgccatcacgcccagctaatttttgtatttttagtagagatggggtttcgccttgttggccaggctagtctcaaattcctggcctcaagtgatctgcctccctcggcctcccaaagtgctgtgattacaggtgtgagccaaagcgcccagccaaattttggactttccctgggccctgcccagggctcacttgggcgggagcagagcacagtgattgagggtaccaagtggagccaagtggcttgggttcacttcctggctctgctacttcctagccaagagatcatgggtgagctttgaagcctttccaggtctgagtagtaatagacccttcctcctgaggcacccctcaagtcttccttaaggggcacttcatataatcctcagatttcatgaggtgcccagtgcctggcatgtagtgagcagcctgagagtgtcagctgttggctatgatgggtgtcattactgttagttatcacattctggggttattacatgaacttgaagctatgcggactctcggtggaggggagggaagggcccggcccctcttccttgtctgatgtctcctgcgtcctcctcagtgaaggtcatgccttttgccaacttgatgagcctcctgggcccctccatcgattccgtggctgttctgcggggcatccagaaggtggcgatgttggtccaagggaactgggtggtgaagaggtaagttgctttttttattttttatttttatttatttttttccttgaggcagagcttcactcttgttgcccaggctggtgtgtagtggcgcaatctcggctcactgtaacttctccctcccaggtccaagcaactctcctgcctcagcctcctgagtagctgggattataggtgcccgccaccatgcccagctaatctttgtgtttttagtagacacgggtttcaccatgttggccaggctggtctcgaatcctgacctcaagtgatccacccacctcgacctcccaatgtgttaggattataggcgtgagccaccgggcccggcctacgctgtattctcttaatgggagcatttggtccttttaaatttaatgcagttactagtgctttgggtttaaatctacagtgctttctatttgtcctgcctacattgcatttaaactgttttttgtttttttgtttttttttttgagacagagtctcgctctgtcccacaggctggagtgcagtggtgcgatctcggctcactgcaagctctgcctgccgggttcacgccattctcctgcctcagcctcccgagtagctgggactacaaggcacccgccaccacgcccagctaattttttgtatttttagtagagatggggtttcactgtgttagccaagatggtctccatctcctgacctcgtgatctgcccgcctcggcttcccaaagtgctgggattacaggtgtgagccactgtgcctggccgcatttaaacattttttaaattgacacataatgtacatatttatgggggcagtgtgaaatctaaatacatgtatacaatgtaatgatcaaatcagggcaattaacatatctatcccctcaaacatttctcatttttgtgttgggcacattcaaacttcacttttctagctatttaaaattatacaataaattgttcttaattatagtcaccctgtagtaccctttgtcctgcctacattggatttttatatcattcttaccatctgctggattcatttctgtttctattttttcctgctaacttggaagttacactgtttgggctcatatattgattaccctacagttttcagcttacattcatgacttaacacattttaatgttaattgctgctttttaccccattccaatctattcagagatcttagaatattttatatctatcctcatacttacacactgctagattggtatatatatatttttttacctttttaatttgccaatcttctctagtgttccaattttagtatatgtactgccgaagagagcacaggattggtgtatttttattttttttttgagatagtctctctctcttgcccaggctggggtgcagtggcacagtctcagctcactgcaacctctgtctcccgggtttaagcgattctcctgcctcagcctcccaagtaactgggattataggcgcttgccaccacgcccggctaatttttgtatttttagaagaggcagggttttgctgtgttggccagctggtcttgaactcctgacctcaggtgatgcacccatctcggcctcccaaagtgctgggattacaggcgtgagctaccgtgcccggcctggtgtattttaattctctgtatgttttcagccccataagacattactgtatccagtcaatcaatattctttactcgcatgtttataatttagtcatcatttctttctgcatctctaagtttctatctgggatcatttcgttctgcctaaagaatgctatagtatttcctttaatgtgggtctgttggtgatgcatttccttggtttttgtgtgtctggaaatgtctatttcacctttgttctagaattctagattggtggttattttcctttccacgcgttgatatgattttgttgtgttccgacttcattgtttctgttggcagttttgttcttattcctttgaaggcagcctgcctttgttttcctctggctgcttttaggagtttctctgtttttggttttctacgggttcgtttagatgtgtctttaagtgtgaattttttacatactctgctggggatcacaggtcttgagcgtggggcttgatgcctttcagtggtttctcttcggcgaatcctcccctagaccatgtgctgcctccacgagaccatcagtttcaagggattagggatgtctgttttgactcctgctttatgttcccagtacccggaataatgcctggatattaccagtgcagacccttggtaaataatgtggctacgttttacttgaattatattgattctgaatgatgtagcattaattgcattaataactcactttttaagtaatgtagtttaaggtgagcaatgtgacaaaatgtgaaatgttgaacattttaagaaaatacaatgccttgaaagctcctcatagttgtagagtatattcgtgttactgccacctggtggcgcccttgcactgctccacaggtgcccagcgcagtttgtcagcaccttgcggctgttgtcctttgttacacgttttcatcatggaaggcttttgcaatggcgcatcgcgtattacataggaccacgtgtgtatatttacaccataagtgaatgaaagccaagaggggtcctcccgtcacacacctgaggacactggcccagagaggcatgggacttgccaaaagtcttgcagcaaggcagccgcagagccctgttaaaacctaagcctcatggctcagccctgggctctgcacccagcactgcatgtgtcccctggaggtgctgccccttttagtttcgccctgtcctggggactggaaggtagggacttggggactgtgggcatttcacctgccccggcacttctgtaagccctactctgctgctgcccatgctgccatgtcaggggcccctgggtgagggtcctgtgtgtgcctgtgaggagacaatgcaaaatccatgcctccattcagtcactatggctagactgctcgttctgtgccatggaccgggctctcattcagacactgcccctggggatggcggctgttacatttgagctccctgaatgcagagatcatggcatggaccaggtttgtttggtcagcacacacttaataggtaccttcgctgtggtggcagcgatgagccacatcggcagagtccgtgtccccacagagcgtggccttgcaggatgagtgacagttggttgccaggtggacctgagcagggggaggaggagggcttggcagcagagggagggacagtcagagcacaggtgccgcagcaggggctgagccggggttgcagggcctgtggctggagctgggtcagggctacactctggagattctcgtgccctgctgtccaaggccccggcctttcctctgaagttccctgaaccttgagtgctgagcctgttctctccgagggctaacatgcctcccctgcctctgacctcggttcatgcccacctgcccctttcagcaggtggccaagggcttgcagatggcttcatccctggttctcttggtgtcacgtgcagggaccagttgtcttccagagtcctgggctccttgaggtcccgggctgttcctcaccttgtctgtctctgagcccgtgacctctccctgaatgtgcaggggtcttaggatgaggctggtgtgcatggcgggttgaggggtaataagaggaagaactggggggatgtgtggggtagaggggtgcttctttcccatgtctgtgttcacagatgtggctcctaaggggaggtcttggggctcaggcctgtacccagcccacggtggaaagaagcatggactggggcttggccgggaggggtagcggtagagggggctcagggcagggactgacctgccatcctcacctgcattggcagtgacatcctataccccaaggactcgtccagccctcacagcggcgtgcctgctgaggtgctctgcaggggccgagacttcgttgtaagtaccttgggttctctggactcacggtgggggcgtgggaagaggggggcagcggtgcagggcttctgaagaccggggcccggcagaggctccaggtggaggcgggtgtgtgaggaggccctggcctctgcctttctcctccttcctctcagaagcctggagtctcgggctggaaagaaccttccagttcctctagcgcagtcggggggtgggtcaagaagcacgtttcattcggcctgagtggtggtttagaaatattgccttggttgtcagattttataaattgaaattttgatgtaaaaaaaatcttgatgctagacagatgtctagctgtcaagggtaattggactccctgacacccctggggccacttccccacaaggcgctggcggtctccagttcaccacagtcccaggtgcctttgcctcccttgtgcctgtccctggagtttgggactcctgagctggtgtctcccttcttcccatcaccccacccatggcctccctcccaaggcctggaactccatgcagctgggagccacagtcttcctaggcttggtgctggctgaaacgtgctgcccaggagctgtcccacaccccttggcacgctggtgtgccgtcccagtcacaaggcagcccttaagctgaaggaagcatctgcctcttctcttcctgaaggagcctccccaactcctctgggcagtcggtgtccaggtgcccgagcagcatctttgctcctaggggtcagcatgtaacaatcaccactcccaggcttgcctccccagatacagtgccgtttgcccccagctgcccctgcccgccccgctccagtgtgtagacactgtcagaactggcggcttggtgggggtgtggtccagtctatgttagcgtaggtgatagtcatccattccctgtgtctctcagccagccacccttctctctcccagtcaccccacaaatctaatcagagtgcaggggagctgttgaggcagagtgggggctgcagggggctgagagcttctggaaggatgggcggcctccaaccagccattagcagccaccactgtgaagtgccgcctatgcagacagcgtgtgtctgtgggagcccctcccagcccgagtcctcatcgtatcctcggagctgggcagggcatccccagggagcgctgtggtctaggtggggtgggatggtcccatggtccccttggaagagatgggcctggagctcctttatggaggagaaaaggagggaggtgcagagctgaagggactgcctgaggccacactgttgggaagaatcaaggccaggagcctaggactgtcccaggctccagctcccaggcctgccaggtgagttcccgggacagtcctgggagcagtccgtggccgcccctggaatgtgctgcttcttctccctcagatgtggaagttcacgcagagccgctgggtggttaggaaagaggtggcaaccgtgaccaaagtaagtggcgtttttgtggtctgaggcccaggctgctgctggaggggagggggctggctgtgcctcacgctgggccccctcccctccagctctgcgccgaggatgtgaaggacttcctggagcacatggccgtggtgaggatcaacaaaggctgggagttcattctgccttatgatggggagttcatcaagaagcacccggatgtggtccagcggcagcacatgctgtggacgggtatccaggccaagtaagcaccctgggccagggaggggcagcccggtgatcccagcaaccctgcatcctggggagcactgtcagggtggatccgagcaatctctagaaaccccacatctggggagagcgcagttgggctggatctgggtgtgaagggcaggtgggggtccgcaggccccacgctcctcacccacactgataggcattgctggctgatcccaccatcctttcagcacaggacacacagccagtacctgctcatcagggtggccgtgctctgagggctcagggaagagggatgtgatggagagagggagcactcaggagcaagagctggggcctggggaccagaggggtgttggcagaagactgatggggtctgggtggtcctggggctgtgcactctgccagaagagggactcagtagggctggctgagctccaagcctgcgctgtcagtaaccagcgtgtcctggggcctaaggggtggttgtttctcttgtgaagcagatggtaggggacgtggtttaaagttaatggggttactcttcttttcagactggaaaaagtctataatcttgtaaaggaaaccatgccaaagaagccggatgcacaatcaggtgtgtgaggggctttgggctgggaggccccggctcctacactgtggctccggaagggctgctgtgctagagcttgtcaggcccggacctggagagggtggagggctctcaccgttcacccttcaccctccttcctttcctgccacccacagaccgcagctggtcgcttgcccagcagcagagcctcagggacggaggcttgcggattccagggctgagtctgggttccaggtctctgaggctcactcaccctcttgggtcaacaagcgggcccggaagagctgctggggggaggaactcagcagcacccttccccgcatgactctcggcacgctgggacggttctctcttccactgatggggtggctgattttcgagaaaggttggggatgagaccaggacgggaccacttgctgcagccccgcggtcccctgctgggcttttggcttcagatccctgtgccctcctgagcagtgctgcctccctccccgcagggcctgccgggctggtctgtggggaccagcggatccaagtagccaaaaccaaggcccagcagaaccacgcgttgctggagcgggagctgcagcggcggaaggagcagctgcgggtgcctgcggtcccgcccggtgtgcggatcaaggaggagcccgtgagcgaggagggcgaggaggacgaggagcaggaggcggaggaggagcccatggacacttcccccagcggcctccacagcaagctggccaacgggctgcctctcgggcgggctgcgggcacagacagcttcaacgggcacccgccccagggctgcgccagcacccctgtggctcgggaactgaaggccttcgtggaggccacctttcagagacagtttgtgctcacgctgagcgaactcaagcgcctcttcaatctgcacttggccagcctgccccccggccacacactcttcagcggcatctcggaccgcatgctacaggacacggtgctggccgccggttgcaagcagatactggtgcctgtaagtagagccctgcctgccaggggcatggggggtggggggtggggagaaccagctgttgggaggccacgtggggacacgggaggccatgcttggtgagcatctgctctcacgtgggcctaggtgtgacatgggcaagtcagcctctctgaggctctattctcatgaaatgggatcatgttgggttttatgtcacaggactgtggtaggggctaaatacggtgtctgaaggcccggcctattgcctggcctgcagcagggcctagtgaaacagggcccctgcctggtttctcaccctgtcccccaccaagaacacctgtttcctactagctttgccattgtttggaatgatttaacttctaagatcgtttgatcttctttgcaatctgcagatgaagaaactgaggctccaaggaatgaaatgtacgtttaaaggtcactacctaggaggtagtagagctggaatttggacctcagtatagtggcctggagttttgaatcctttctgctcagctaagatgagctgcttccccacagctgcgccacgccccagcttgggcctgggtcctggcggcctccctgtgcatcagaagcaagctgaccagctcagcgctgtgctctcagcacttccagtgccaggccttgagtgtggtattgcaagcctcctgccccttccccctgggctgcttttctgtcactgggaggggccctgacgggggagcagagtgcttgctggggaccgtttccctgcgctgaggatagagagcgccaggtgctgcctgaggcacgcctttcccgtgctccttttccacaaggctctgcccagacctggcagcaaaatggggtgaggtggggctgtggtggtctctaagaaagcattgatgttttcattgccaaggtcaggagcgggcctgcagccttgggtgatgatctgaggccaaggcccatccctgtgtatgaggaatagaaactaggacaggaggccttgtggagcctaggctgtctcaggggatcggccctgctggcaggcagccccctgtgggaggtactggcagagttcggagctcctgcccacccagcacatgggtctgggtctccacaagctcacctttcttcatgagctgggccaggacaggcaggacacctgcctgacattagttgttttgggccgctggagtggacagaggtgaggggtgggacatggccaccctcagacaccctcacccctccttccggaccccctctgtccatgttgctttggggtggggccagcgtctccaggagacaccatggccctaactgtaatgctctccttgccatcctgacaaggagactgtattgtagtcacatccaagacgtaagagacctccgatcccagccacctctgtgttgtacatgagggagctgaggtccagggcaagtgaatagatcgagaacttgacttgaactcctggttctgctgcttattagctgtgtgaccatggacagtgagcaaacctctctgagcttacttttccccatgtactacctccccagtttctaatgctcaaatgcaaatgtgtattggaggcctcacagggcttttactggtagtaaccattattgctacttgtgtgatggaaccaggactggaaactaccatcccagatgccccctcccctgtccccttctctccaggacccaggcctgtgtcacacttgtcctggtctacctttggaccaagtggcctggattgcttgggagtcaggcagtgcctctaacccacactgacatggtacatgtgggaagcagttgaaaagaacccccagggtaccccaagagttatggggaagggggcgcccctccatcagggttggcatcttcaggagggaggactctgggtgttaaagcacagttgagttggtgccaggctgatgggaaacagacgcagcttccccactgtacggaggatatctgcagactcgaagccgggcatttcactgggcccatcacactccccctctcgctgaagccctgtcaggccctggggggtgtgctggcctcctccccatggtgaggtgagaggcacaggtttgtggctgcccaaggccctcagagatggtgagtagcagaagctgggattggaacccatgttcctgcatctgggctggggcagacagggagggatgaggcaagcaaatggatccatggggtagagatggacaagcaactcacccctgggccttggtcagtttcccccccagactgctgcttccccggatgagcagaaggtgtttgccctctgggagtctggagacatgagtgatcaggtgaggtgaactttgctgccatcttcccgaagagccaggggggtttcctgcagcgttggaggccttgggggacatgtgcacccaaagtgcagccacacatttcagattttctggcacactcggttttaaatatcctgctccaactctgtacgctaacaaaataagctgtatgtgccaatagtttgaacctaaaccagtggttcccagatgccagtctgtgagccagctccatcagaatcatcttttaaaaaatacaggctgggcgtagtggctcacgcctgtaatcccagcactttgggaggccaaggtgggtggatcacctgaggttgggagtttgacaccagcctgaccaatatggtgaaaccccatctctactaaaaatgcccatagtcgtgggaggctgagacagaattgcttgaacctgggagagagaggttgcagtgaaccgagattgcaccactgcactccagactgggcgacagagcaagactgtgtctcagaaagaaaaaaaaaaaaaacatagattcagttctgttcagtaggtatgcggtactgtcctaggtatctgaatttctgtaaagcttcctgagcaactctgatccagccaggcttatagagcactggtgaagcacatttctcaggcggcctctggcagcaggaatcaaaaggattccttgtcagatgtcaggtcctggacttttaggttaaagaaattggtcattttgcctctagtcatactgtgatggggagggtcacaggtgtccagtgcccagaaatgtgagtggaagcagcagcgccttgcgtgtgtgtggtgtagtcatggaccctgcatcccagcttttcttaggccgtgaacgtacctaatttgatggtcgaaacgccagtcggtctgaccgtgtctaggccctgctcctaaggtgtggggagaagggagtcagcagaaatcccactgagctctctgtccccagctgcctcttaggggagccaactggcaggctgaggatctaaggggctggggccttttcctgagcaagcttgagtgcttttgtccagaatagagggtatctgaaatactttgataacaaaaaggcaaaaaaacaaaagtcataaatgcagatttttaaacatcaaatcagactagaagttttaataggaaagctcttgcactgctggacctgactgccacccctcagaggtgaccacttttattactacttttttaatagaaacagggtctcactatgttggccaggctagtcttgaactcctggcctcaagcagttctcctgcctcagcctcccaaagtgctaggatcataggcatttacatcaccaaaagataccactaaaatagctgcccccatttaaaaaaaaaaatcagcctgtcattagcaatgggcttcccattgtggtggatgagatttagctctcaactattttaggagactgtagagatagatatgttacgccagttttttttttttttttgagatagatagcgtcttgctcttgctcttgctctgtcatctaggcctggagtgcagtggtgccatctcagctcacgcctcttgcgttcaagcgattcttgtgcctcagccacccgggtagctgggattacgggcttgtgctgcctcacccagctaatttttgtatttttagtagagatcgcggtggtaggggtcggggggtggtcccaccatgttggccaggctggtctcgaactcctggcctcaaatgatctgcctgccttggccttccaaagtgctgggattacaagcgtgagccaccacaccaggcctttacctctttttaattggctatcattgtttatagcattgtcacagaatgaactgaaaatctatccattgtagagccaaacatcagtaatatactatgattgcatttccttgttcactgcttcctgttttcacttgtgtaattttctgaacacatgtgtaccgagggtgatactttgcttaattaagcctggttcccgggaagcctctccctctgcttctccagtgagactcgctcttccccatgtctgttgctgaattctggaatctctgcttcttccttgctttagcttctgaagagacagaggagttgtctgcattctttcatgtcttaaaatggattacaatacagtattactgtttgtctgggactagaattttaagaggcaaaggatacttcatgtagcagtcagctgtttacatgaaccatagcaaaaaaaaaggagaatcaaatccatctcctcttaatgtttgcagaaagatgcaaacaaaaccagctaagtatggaacaatgtgtgaggttatcaaagtttctatttttacgtgatcaaatgatttgcctctcaaaattctagtcctagacaaatagtgatacatgaagcatccttttttttttttttttttttttttttttttttttgagacagagtctccctctgtcagccaggctggagtgcaatggcacgatctcggctcactgcaacctccgcctcagcctcctgagtagctgggattataggcgtgtgccaccacgcgtggctgatttttgtatttttagtagagacggagtttcaccacgttggacaggctggtctcgaactcctgacctcaggtaatccgcctgcctcggtctccccaagtgctgggattgcaggcgtgagcctctgcgcccggcatgaagcatctttaagagagtttccattgtttaagttttcagagttgttgaaattccataacattctccttcttggtcttttaaatttggcctgtattctttcctttatgccaaactgcagaatttttcattattctgtatatcagtcagtgccatttcagctgtgccctggtgcgggtcattattgtactagacaattgagttcttataaaatcctgtgagttgttacttttttttgtttttttcagaattcttatgacagatattagacatactgaatccaatcttttccatttttattttggggtgtaacgtattttacggcatcctgtttcatggatgcagtggcatgtttgtgcattaagacttcacaccaattttgacaccctcttctcatctccgtgcagcttagattgtcgcttcacctgcttgctaagtccgatgcacgcctgcattttaccatgcagaaatatgttcaagccactcatcctctcatgtctcttcaccagttcttttgttatgctggcatatacctttgtttttatttatattcaagtttccagacatagcattaatgcctttacttttgtgtttttatttctgtacactgtcttgctgggtctctagagatgacttggctcatctttaaccagaggtgctgcgtgagggtttttatcagagactgcaacacaaagtcaggtgcatggcttgggtgtcttgtttggggatgtttctctttttagatcactgtttcccatcataacgtgtttttgctactaaagcatcgacaggttttgcttgaaattttttccaaaaattaccgggtacgccgaaacatgatccagtctcggttgactcaagagtgtggagaagatctcagtaaacaggaggtggataaagtactaaaggtacatccattttgtgcataacaaacaatatcaaaggctctggaaggggctgacagtgtgtagaagggactctagtgtctttgtgtatatgaaatcaggcttccttgggaccactccccagtcagtcttgtcttgagcaactgttaatgattgattgattggcattggttggggaagggggtatgtgccagaggactgaccccttcaaacaatatagtcacagtggtgtccaagggaaagaatacagccatggatgctttgtttctctttctggttgggccaggccagtaatgcccctttcatccctcttctctgcttgtcactagagacagaaactaaaaaccatggcttcaggctgctaagagcctaaaacaatagaacaacaaaaaaatatggtaggttggatgagcttggcagtgggtaggcgtcttctaaaatgatagggcctagttgagaatcctcactctactctcccttgaattttgaactatcttctgattgttgccatagccacacacatgactttcagtagaatccattcttaaatttagtttaaaaaggaatatgatctgtttactatatgaaagcacctaatgtacaacctataatgcttttctgaagtgactgtagtacaaataccaaccatatttgcagcaacactgagagacagaaaactgatgacaatgtcttgttttgattaaacatccagagccatataagtaatactgttttttaagcacccttgttctgggcatgtcagtatctgtatttcgtagacccccttttttttttttttttttttttttgagatggagttttgctcttgttgcccaggctagagtgcagtagcacaatctcggctcaccgcaacctctacctcccagtttcaagcaattctcctgcctcagcctcctaagtagctgggattacaggtgtgagccaccatgcctggcccaccctcacttttaaaatgcccctgaggaatggccaggcgcggtggctcacacctgtaatcccagcgctttgggaggctgaggtgggtgggtcacttgaggtcaggagtttgagaccagcctgaccaacatggagaaaccccatctctactaaaaatacaaaattagccaggcgtagtggtacatgcctgtaatcccagctacttgggaggctgaggcaggagaatcgcttgaacctgggaggcagaggctgcagtgagccaagatcatgccgttgcactccagcctgggtaacaagagcaaaactctgtttcaaaaaaaaaaaaaaacactacccctgaggaaagggtggctggtagtagccatggtggtatggttaggcagtttttgatttcccatttgtattctattcactaatcataaatcgagtgttgacattgtggacagaatgtaattagctccttttcctgcaaaaatctgtgcttaccctgtttctctctcataggactgctgtgtaagctatggtggcatgtggtaccttaaagggacagtacagtcttgacaatagtagcaaactactaacccagcaaatctaagcccaaggaagaagggcggaaccagaagtagggcctcgacttgcttcagacgacacagagcaagaggaactgaccatctcatgacctgtggcattgcacggtgcagtggacagaagggattatcctcagccagtcgcagggtcagcttaagttagttagatcactcccagaagagaccagctgggaccttctttgcagtacaatttgaaattcctgatgtattttgcttattatttggtttcattctcataataaagagagtgtatactgacatgggcaggatgataaaaatcatggtttaatattttcttttgtaaacttaatgccaacaaggtctaagttatgtttacaacatgaagaaaacctcaaagttcttaatttttaaaatgcctagaagacaatatttagtcttggattatctatctgctaagacctccaccaatttcattaaaccaaattgaattattctattcttgggattctgtggccacttcacctttgacaacaacctactttatgtagcagtctcaactgtttacatgaaccatagcaaaaaaatcagaatcaaatccatctccttttaatgtttgcagaaagatgcaaacaaaaccaggtaagtatggaacaatgtgtaagtgaggttatcacactttgatgtaaaaatttctattttgtgtatttttaaaataaatgcaaacactaaactagc

SEQ ID NO: 38271 - DNA, 19904 bp, Homo sapiens
acccccgagcccccgcagccctagagccgcccaagggatggcgatggcgtacttggcttggagactggcgcggcgttcgtgtccgaggtaagcttggagtcccggccgttcggcccatggtcgcccgcaggataccgctgtccaggcgaaggtcgccgccgttggaagaccctccttccctattgtctaggtggcaacaggattttgctttgctggttttccggtgaggtagtgctaaaaagtgacgacctcacgcgcgccctcctgcaccgctgggcccggagtggtcaggatgggcgcgtcgggaggtcagggctatggttccctgtcagcagtccccaaggtctccgcctgcctccgcgcacgctcccatcctcctggggccggactccgggcgggtgagccgccccagctgagcacccgggcctgcacttcccagccgggctgcttctggggtgcaaagcgtcgcttgctaaaagcgaggtaaacgcaagccgttatcactcgtgtggacttaacactctgcttcttggagaacacgtatgctataaagtgaaatggccgggtacagagtaacggctaagaagcacgctgcacctccctggggtcccgggaacccgcacgaatctgtgcatagggaacaaaaccgaaacacggtggtggccttgaagtggtagaattatgagtgattttcccgactttatgtattttcttaaatggtcgtgtttttgctatttgtttttaaaactcacgctttatttaaaaataaatttgttccacattttgtggaaacttgtacatttcggctttctgtggatattttaaatttttctttcgttttctacgtggaatttgccatataagatgcagtttttccctttacagaaaatcattttaatgtaaaacttactctaggctgatcttactgaatcagttactaatagtccaaagtttgaacctagagttcattgcaccattttcgagttacataattgtgtttgtgtgttaggtttgggctttgtaacctgtattattttaatcatcttttttgccattaactctattattcagtgtcatcgtcgtgaactccatttttagcttgtggcctgagtcctgtgcattcaagtttgccaccccacccccgctcactatgtgtgcttaaaaacgtgctgatcacccccgcggtggttgctgtttctgctctgttcctggctggctggttaaacatacccatagaaaggggcacgcctgctgagcccccttcactgactcccttccactgcaggtagattccctcccatctgctgagaaggctgtggctctatctggaatgccagcaactgctcgtgtgttcttttgaatatttcttgtatgttcacatccattctcccctccttccacctgtgtgtatgttggaacaccagcttcgccagcaaagaggcaagaattgacctgatatagcttatggcttatcagtgagtgcagaggctgtttcaggactttgggacacttcactaaattctgtgcactttagccttttggtttcctgctgtccactgtcttgcatgcacttcacttcttgcctttggcaaaatttacatggtcattcctgttctggctgcttttatctttagttgcttacagatacctccctggatggttacttttccttttatttaaagttactactgttagcttctgtattgacttattatcttggaatccttacagccaattatttgcagccagtttgctgaggcaagtataaagaaaatatctatagacaaacatggcattttgttatgtataggctgggaacaattagaaatcaggctgcagaaatgtgagggttgggaacaaatagaaatcagtctgcctaattgtagttctctgcaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggtaaatgcctacggtcgaacgttatttaaagaattttgggcaaatgacttcttaaataaatacactgtgtgtttactaaaatgtggccttaacattttggtttgtcttgctccctcttctctgaagagtgtgtgtgtgtatatatatatatgccagttttttatattagaccttgaaatactattaaggcacaaagtgcctcagtgtcacacgagtaaaagagacttacgagatataatattcacatttgtagaccttacttagctcttgattagaataaatcaactgaaaaaggtatttttaagacaattggggaagttttgagtaaggacagagtgttagaagatacctagaaatcatcgttaatggtgtcaaggttatataagaaaatgttgatatttttaagaaaagtgtactaaggatataggggtgaaatagcatggatagttgaagttctctaagcacaaaaagaaaaggatagatgaggccaggcatggtggctcacgcctgtaatcccagcactttgggaggctgaggcgggcagatcccttaaggtcaggagtttgagaccagcctggccaacatggtgaaacctcatctctactaaaaactcaaaaatgagctggactggtggcgcacacctgtaatcccagctacttgggaagctgaggcaggagaatcgtttgaacctgtgaggtgcaggttgcaatgagccaagattgcgccactgcactccagcctgagtgacagagcgagactctgtccaaaaacgaaagaaaataaagagagagagagatgaagcaagtaaggcagtttgataattgttgaacctggatgatgggtattgggaattcattatagtattctactttggtatgtttggaaatttttataacaaaatttaaaaactaaagctcttaagtttcaatgccaaagacttccctggcatgtctgcctctctgggctcctgtgttatctatttttctgtcctatgatgggtatgagcttctctttcatatgggtgtgtatagtaaaaaatttaaccttgccccagaagaggtgtggctttgccctcagcttctgggaagtgaatctctaatgactggtaggagtctttatttgcctggattgtcttaacgatgtgatttagggtgggggcttcaggttatacagtcatgcacaggtgatggagccctgttaaaaactctggacaccgagactggatgagctgagcatctctggttggcaggactccctgtgtactgtcacatcaattctggtagaggtgccctatgctgactccatggggaaaggacaatggaaactccacatttgctactgccccagactccatcctgtgtgtgtcctcccttggatgattctaatctctatcctttcccttaataaactattaattgtgcgtttaacagcttgcagtgagttctgggtgtctttctagcaaattgttgcacttgagggtggtcctgggtgccctccagccttgcaattggtgttagcattgaggacagtcaggagacaaaggcaagcccttatcctgtggactgtgttccctctaacttctaggttggccaactcttgccagatgacactatctctgtctaaagaaattcataacctcctttactgcctttttcttttttcttttttcttttgtttttattttgtttttttgagacagagttttgctctgtcacgcagggtagagtgcagcggcaccatctcagctcactgcaacctctgcctcccaggttcaggcaatccttctgcctcagcctcccaagcagctggaattacaggaacctgccaccatgcctggctaatttttgtatttttagtagagatggggttttaccatattggtcaggctggtctcgaactcctgacctcaggtgatccacccacctcagcctcccaaagtgctgagattacaggtgtgagccaccacacctggcttgtttttcaaagactctttcttctttcctctctaactgtattataaaattttaaaaattttaactggaattttaaattgctatttctgaaaagtagctgagtgggatattttattcatctcaaaacacccactccacctagcctcaaaaataaaatttaattcctttttgctttttacttacatgttcttcagttaggtttcctaagaaccagtagctctgatagccccaccctagcccctcagctacagttttgttacccaggtaccaaaagtccaccactgaattagtggtgtttttttttgtaccttcagatgggcttttggaatatgctgtgggttttcaagtatttgttgactagttccttgtaaagattgtttgcttgaatattttgattgtttgtggaaaatgtgattaccaatataaaactaatgaaccattagatttttttagaaaatacttccccaaaacctttatcctgcattattttcatagacaggcagttataatttatttccagtcttttttctgtttgtgcatttttggcaacaacatcaaagagactggaggggaaaattcagatcaatttacataccctgtgaaaggatttgggggaggcattcatgtacttacagattttatggatcttaaatatttaggggtctagtttacatggacatttgaacatattgcccctctccttttcacaggccactgaaggaccttgtaacatgcccaaaccaggtgtatttgacttgatcaacaaggccaaatgggacgcatggaatgcccttggcagcctgcccaaggtgagtttactagttactgtgcttttatttgctgtacttctaaagaagtttgtgcttctcattaagccattgtaaatggagtcttcaagatcttgatgtgcttctattctttcttcattgcaaggtgttagttattagtatagtaactttctcaaagtgcttattcattgaccatgggctgaggttgtttgtcatcgtccgttcaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccataaacactgaggtaatgttacctgcccacggagtttgtcctgttttactttcttcttctatgtgtttcacacaaaagctgtagagtttcagcatcattcctattttaagatatctcttgtttgatttgtgcaggaaggttggtaattgtggctacttcatacaacagagttgagcattcattgtttagagtttgtgaatttcaggtaggttctgatatacccagaaggcactgtgattttcctaataatggaagcagaaataaatgaatataaatgaaacatgttgctatgagagaatttgcatagaagccatctaaggttggtgtagactgctcccagaagtatcttcatgtcacttagacatgaaagtaagtctttctgcttgcacgggggcttcattttttataagtatagggagaaaggagagaaggacttcatcttaaacaaattatcacccagctccgctttaaagtagctgcttcactcggtaacgttagtctttgaatctctcactgaactagaatgataataaaataactaccttagccccttcttcttgaaaaaaattatagggaattaattggatgcttggtgctcaactgggactaaaatttcagaggactatgaccattgggtcaataacctccattgtggcagaaagagcatactcactttaaaatcatcttcagaatttcatgaagtaggatatgtgtcattcaactaataaagcatttaatgctcaaactttatttccactttcccctgactcatttctctacaactataataataatagctactctgtacagagtgtctaatgagtgccagcactctccacacagaagtttatttaattctcacagggagcctactgttatcattacttaacaataaaataattagattaagaagtaacttactcaagttcacataacaaataagcagcaaaacctaaattgaaaccctgatagccagtcgtggtggctcacccctgtaatcccagcactttgggaggccaaggtgggcagatcacttgaggtcaggagttcaagaccagcctggccaacatggtgaaactccatctctactaaagatacaaaaaattagctgggcatggtggtgcgcacctatagtcccagctactcaggaggctggggcaggagaatcttttgaaccggggaggtggaggttgagccaagatcatgctattgcactctagcctgggcctcgcaatgagactccatctcaaaaaagaaggaaggaaggaagggaggaagggagggagggagggagaaaccctgataatccatctcttaatcctggtctcaccagttggaaggaaggaaccctgataatccatctcctaatcctggtctcaccagtcgccctgctgtgtggtgttatcataactataataatgatagaatgagttccttatcacttccctcaggagaaatgcttaaacgcttattcatgtacagtcatcccttggtatccgatggggattggttccaggacctccgtgtggacaacaaaatccgcggaacctgaagtcccccataaaaaggcataatatttgcatataacctctatatacactcccatatactttaaatcatctctagagttattataatactgaatacaatgtaaatgctatattaaattgttgttatactgtattgtttagggactaatgataagagaaaaagcctgtacatgttcagtatagatacagaattcttttccaggtatttttgatctgtgattggttgtccatggatgtggaacccgtggatacggagggcaggctgttttatgtaaagtccatgtgtcttttccagtatatttgtatctataagtatcagccctcttcctcatttctttcccacactgaaatctcatctaaggttgaaattgcacctgttttaaatgcattaaaagctatatagctgcttgtccaagattttcagaaatgttgctgatttaaaattttgagccaccttccttgaataccattacagtgtcttgaaaattccagccttttggcagtcactaacacttcccagactgccaggggcttccttgaggtcacaacagagacgttgctttgtagaaagttttctctgaccacctcccactctgcccacactagataagcctcagcacctcctctgagttccctgctactttgtactttccaaccccctcctcatttgaacatgttaattccaaattgaacatgttaagtcctctgttaattccaaaagctcaaggactatttctttcttggtcccttttggaaaaaaagtggtttatagcctgcagctcctgccatagcaccaggtacataatatgcaccaggtaactgtgaaaggaataaaaattccttcagttatgttggtccacctttttggttataaaatacaaccaaaataaatgttaggcactttgctgagagcaagcttgcagcctgacatttgttgagtccattgattgatgattcctgtgttcagagttcttttcttttccttgtcttcccattacacagatgtatcatgaaattatgcgtgcacttaaagctgccagcaaggatgactcaatcatcactgttttaacaggtaagacattttctcaggcatcctaattaaatttctattttgaggggcctcttaatagataggaaattgagttaaaaagctctaagacctggaggccgaggcaggtggctcccgaggtcaggagtttgagatgagcctgattaacatggtgaaaccccatctctgctaaaaatataaaaattagccgggcatggtggcacacacctgtaatcccagctactcaggaggctgaggcaggagaatcacttgaacctggaaggcaaagtttgcagtgacccgaggtcgcgccactgcactccagcttgggtaacagagtgagactctgtctcaaaaaaaaaaaaaaaaaaaaaaaaaaaaggctctaagatcttttccagtactgtcatactctgatttataaatatacaaaaaatgtttaaaaaaacacagatacccactccttcgcaattacccaacatcaattaagacacatatgtccaccaaaagacttttacaggagcagacatggtaacctgatttataacggccaaaaccagaaaacaaatgttcaaaaacacatggatgaataaacaaattgttgactatttgtacaatggaatactcagctataaaatggaataaatgatatacacaagaatgtggatgcatctttaaaacacagttcagcaaaataaagacaggagtgtacatactgtatgagtccatttgtagaaagttctacagtagacaaaagttcttctctgtggaaattgaagtcagaaagtgattgccttggagcaggtggggtgggatagctaggaaggagcctacgggaaacttttggggtgatggagatgttctgtatcttgttttggatggtgatcttgtgggtatttaaaattattaaaactcatctaaatgaacatttaaaaactggttgttttattgtatataaattgtactttaattaaacacacacactcagaaacatactttcagtggctcttagaataaagaaaaaacttcctcatgggatctacaaagcactgtcaggtctattctgccagtcctcatcctgcaccgacttccccctggctttccctgagtcagctacagtggctcttacttcatctacagtggggataacctctccaaagagcctttgcacaggctgttcctttgtgtaaactgttcttcccagccctctttttctagcccacctggcctctccttcagatctcaattcagttgtcgcttccttaggaaagttctttcctgaactccctgattagaccaaccctcctggtacataccctcatttcatgacgcaccactcctctatttcaacagtagcattagctacatttatcggtgtgtttttatagatcagtgtccagcgtactcactagtttgtaagttagggcaggaaccattgctcgttctccaatgtatttcccttgcctaaccatagagtttggcatgcagtagatactcaagaattataggatgattgaatgagggatctgttgattttcttacttataggaaatggtgactattacagtagtgggaatgatctgactaacttcactgatattccccctggtggagtagaggagaaagctaaaaataatgccgttttactgaggtaagagttactgacctttgtctgatcccagagggcccgttcttagtcatcaaagtggtatttagttgagcaaaagtgcaatatctgcttctctgtgtcagtgcagttaattgtgactttggacaagcatatttctctaaactgcctccatccataggtgggcattcattctttctctttgacctctgttacctgttcatcctgctggtctcatgagatttgactggaaaacataaaagtgagctatagttgtaaacaaaattatcttgcactgaggcagaggaatttagcaaattctcatccagccagaggaatgggagatttccatgaacgctgaaggtaggagactcggaggagtcttgtaaacacaggaggaggtcatgaaggcttttctctttattcctgccaaatctgtaattcccacttgttgtgatattgcagcatgtgctcagtcacccaacctaatctctaagactgcggctggtttacagccctgaactcactgtccagaatacaagattcaaaccagggttgacccataggtctcactggttggtcttccatccactgccattcagacggatgccctggatgaatctggtgcggaagaccagggaagtggcaggacaaggaggcactgctggtggtggctgtggaaacacccagcctgacagaaggctttatctcagagtcagactgtcttgcccatgctttagtcatgctgctttggcacatttaatgattttgtgtttccatttctgtagggaatttgtgggctgttttatagattttcctaagcctctgattgcagtggtcaatggtccagctgtgggcatctccgtcaccctccttgggctattcgatgccgtgtatgcatctgacagggtaagtcagctcctagaaagcaagaggtcaggcaagcagcgcgagatgagagcctttgaatcctccttcagcgttgccagtcataagcaggttacatgttgtttgtggtagaattaactgaatttagatttttcccaaagcattaggctgatttgactgattttatttttccttcattattaacttgcattttgttgtgaacattgttccaactctgactgttccggattctaatcaaattccacaataggtatacagctttcatgttattctgaaagattcaggagacacttgaaaatttgttatgggagggaggaatagcatctttgcaggttgtgcaagggattagttgatcctttttactgagtaaatggatttagaattttagaaggagaaggacctgtgagcattatctactgtcactccctcctttgcagataagaaaactgaagctctgagaagttccttgcccagaacacaattcagccttgtgttcaccattgcattatacagattttagtttttatttttactacagtagtaatatatatgtcatagtggaaaataaaattttgaaagatatgaaaaagtaccaagaaaagctacaaggtaaaaatcactccttatcttgccacctagagataaccagtcctaacgtttgggttattaacttatcttgtttaaccagtccctgactgctggaaccctaggctgtttccaatttttatcattacaagcacctaataaccacctttagggtatcagattgtccagtgacttatgcttatgtgatggtaaactgtgctgatgattgcagccttctagggagcatatggtttttaccactgaagagatttctagttttgttcagaggtattttccccactgatagacaggaccatataatagcatccttaattcttcgaattttcttttgctggattccattgaaccagattggatgtattgacagacctaattcttatgaataattttcccacaaaattagcaaatgagattctaggtgccaggctgcccagcctttgtaggtagaggtttctgttcaaaggcagaaatcaatgtctttgttcacagtctgtgtattagatgactgattagtcattgacctgcttttaacagggactgggtcaatggttcctgacctaaaattggggatctcattctttaatacttggagggcaaatattgtatttgaatcttgttctgattctcccactgaattgaaaattactttcaatatacatcatccttatttttttttttttaagagatgggagtctcactctgtcacccaagctggaatgcagtggcacgatcttggctcactgcagccaccacctcccgggttcaagcgattctcccactcagcctcctgagtagtacaggtgcgtgccaccacatcgagctaatttttttgtatttttagtagagacagggtttcactgtgtcggccaggctggtctcgaactcctgacctcaagtgattcgcctgcgttggcctcctgaagtgctgggagtacaggtgtgagccactgagcctggcctgcatcaaccttttaaaaatgttgatgacttccatcttatgatataaattgtaataaatgttgaaatcagaaaacatatatacataatacatataaaacatatctattctatatatattataatatatgtatattgcatatatatattaaatgctaaaaaatttggccaaaagtaaaatttatttgtcaaatagtgtcttctgataaaagtttacccaaccaaacaaatcaagcatcatttaaaataaaggaaattgaggtgggcagatcacctgaggtcaggagttcaagaccagcctggccaacatggtgaaacaccatctctactaaaaatataaaaattagccgggcttggtggcgggtgtctgtaatcccagctacattggaggctgaggcaggagaattgcttgaacccaggaggtagaggttgcagtgagccgagatcgtaccactgcactccagcctaggtgacagagcgagactctgtctcaaaaaaatatataagtaaaaaataaataaaataaaggaaatatgctaaaggaaaaggctgtagaaaaaattgttttataagatttaccattattggcttcaagaataaatatcatattaaatgatgggttaatatttaacccatataaccaaaatattaatcagtacatttaatctattttatactgtgggcaatggttaataatgcctattagctctgtcagcaaatgatacatttcctgtatgagttaagaaaaaggtagaaatcataacaataataaatctttgagtggtcactgtttaggcactctattcacatgcattatgtatattataaatatacgcatacacacacacatattcacgtaatgtacagagtagcccgatgaaagaaggacttggccaggcacagtggctcacgcctctaatcctggcactttgggaggccagggcaagtggatcacctgaggtcgggagttcaagaccagcctggccaatgtggtgaaaccccttctctactaaaaatacaaaaattagccaggtgtggtggcaggcgcctgtagtcccagctacttggtaggctgaggcaagagtaaggctgggcaacagagtgagaccctgtctataaaaacaaacattctcctccaatgtggcaaaaataagttttacaatctaggctgggcatggtggctcatgcctgtaatcttagcactttgggaggccaaggcaggtggatcacttgaggtcaggaattcgagaccagcctggccaacatggtgaagccccgtctctactaaaaatacaaaaatgagctgggtgtggtggtgcacgcctataatcccaactgctcgggaggctgaggcaggagaatcgcttgaacccgggaggcggaggttgcagcgagttgagattgcgccactgcactcaaggctgggcaaccgagcaagactccgtctcaaaaaaaaaaaaaagcaaagaaggattggttcccattttacaaatgagaaaactgtggtacagagagggtaagaaactttcccaacgtccctaagtagtctgacgccagagcctaaacccttaactccacctgctgctctctttctgaaaatcagcattttaaatgctgcttactggcaactttgcatgtacctgtttgtgtccctttagctgttgttggcaggtttctcagtttcctgcttgtattccttaggctgtgtcttctgggtacatttttttgaataagttttcttttggataaaaaaagaagatacatgacattaacagaaacttttaaaaatattgtgattatttttatgtatatgctgcatatgttatagatttatatcttctaacagttatatagtaaaaacaacagcgtgtctgattataggaaatgaaatctaaatattcttttacatattatgaattttaaattaacattctttcataatttattcattaagaaacacaaaaatatgtcttaaatgtaaaaaaaaaaaaaactaaaaatgactatatactaaataaccaatattgaattaattccagtagttaaagccaaccaaaaaaaccactggggcaaaatcaagacaaatgacagattgaggaaacaatttttcaactcatgtaacaaaagctgatctctccacgatactttttaaagtttgtctataaagcgatagatccacaagctaaaataaaaatgggcaatggtgaggaatgaataggtcagacaaaatgaaatataaagggctattaaaaccatatgagagaaaccactgagaaaatgaaaagataagccatagaccaggagaaaagatttgcctgacgctctaataaaagacttgcaatctgaatgtgtatcttacaactatataataggaaggtaaacagcctaacttaaaaaaatagtggagaaaatatcttaacagttgcttcaccaaagaaaatatacgtatgtctaataagtacatggtaagagacttaataccattaatggttagggacatgtaaattaaaaccacagtgagaccccactacatacatactagcatggttaaaatgaaaaagacttaatagctaggtttagtgaggatgtggagcaattggaactttcatacattgctggtgggaatgtcaaatggtacaaccactctagaaaacagtctagcagcttctgagctaaatatacatttaccacacagaccagccataccacttaggtatttacctatgataatttaaaagagattcacccagtgacctgtacacaagtgttcctaactgcctttttgttaacattatctgaacatttttatttttaaattttttttcagtttcattgaggtatacttgacaaataagaattgtacagtcaggtgctgcataacaacattttagtcaatggcagactgcatgtaaaacgctggtctcctaagattataacaccatatcttactataccttttcttttttttttttcactctgtcatccaggctggagtacagtggcatgatctcggctcactgcagcctcctcctcccgggttcaagcaattcttgtgcctcagcctcccgagtagctgggactccaggtgcacaccaccacaccaggctaatttttgtatttttagtagagatggggtttcactacgttggccaggctggtctcgaactgctgacctcaggtgatttgcccacctctgcctcccaaagtgttgggattacaggcatgagccaccacacccggcctaccttttctatgtttgatatatttagatacacaaatgccatttgttataactgcctagagtattaagtatagtaacatgctgtccaagttggtagcctggaagcagtagggattaccacatagctaggtgtgcagtaggctgtggcatccaagtatatgtaagtatactccatgatattggcacaatgacaaaattgcctaattatgcatttctcagaacatatccccattgttaagcaacacacgactagatatatttaaggtgttcaacttgtttttcatagcagccttcttcatagtagcctttcatacgttgctagtggcagtgtcaaatggtacaaccatttgaatgctagaaacaacaccaatggcattaactggtgaatgataaacatattattgtgcatccatacaaaggaatactactcagaaatagcgaggaacaaactactaatacatacaacagcatggtgactctcagaagtcagactcaaaatgctacagaatgtaggattccacttatacagcattctataaaagtcaaaactgtagggacagaaaacagattagcagttgcttgggggtgggagggagggactgactacagaagggcccccggaacctttcagggtggctgaaatgttccgcatgtcagtagtggtggtggctatgtaactctctatttgttcaaactcatccaactatacacttttaaagggtgaattgtgtgtgcatattaaccacataatcttaatttttaaataaatattattaagtattgtgaagttataagcaaatcgtgatttttaaaaataacacatgaagccaggcatggtggctcacgcctgtgatcctagcactttgggaggccgaggcaggtggatcacctgaggtaagaagtttgaaaccaacctggccaacagggcgaaaccccgtctctacgaaaaatacaaaaattagccaggcatggcagcgcatgcctgtaatcgtagctgctgtggaggctgaggcaggagaatcgcttgaacccaaggggtggaggttgcagtgagccgagatcgcgccacttcactgcagcctgggcaaaagagcgaaaccctttgtctcaaaaaaaaaaaaaaaaatcacacatgaaaagatggttttcttttctctcctgcctctgcaggcaacatttcatacaccatttagtcacctaggccaaagtccggaaggatgctcctcttacacttttccgaagataatgagcccagccaaggtaacttttggaatgtttaaatataaaattttatgagtcatctcaagaaagaaggaagagtaatctcatatactctcccttctttcccttggtaatatggacaaaagagaagctaatgatttgcttttcaactctttaagagttttaccaatggaggaatcaggctatgggaagtatctgctatgcaggaaaattagaaattctctctgcagttcccagaactgggatcctcctcttcagctggctgcttagtgctagctgcactgcaagcagcacagcacctcagccttgcagctgtgtggcattagtcacttgaaggaccagggctgtgccagcctcccttggtcccctgagtttggaggccactcggttcctttatggatgaccagtatctcctaaggagagacatgatgacgtcttcactttcagagttacagtaagtaccaacagatgggaggttttgtgggggctcacggctgccagagccacccccaatcacagcagcccttccatcagcctgctcacgggtgtattctctcccaggctggttaagtggctgctcaggtctttcactgtgtttcctagttgcccacgccctgtggcatgactcgaaggggattgtgacaagaccagaagctgagctataggaaaaggcttagcaaatattgctgcaagatctcaaagtggggcagtgggaattgagcttgttttcattgcctattaggattttgttaaaaacttatatatgtatgtttttactctcattaggctatcacataccctgaattgaacttgggaagggggcagaactgactctacaagtcttagagcatttggctattagagcattccttggctgggtgcagtggctcacacctgtaatcccagcactttgggaggccaaggctggtggatcacttgagatcaggagttcaagaccagccgggccaacatagtgaaatgctgtctctactaaaaatacaaaaattagccggggcatggtggcgggcacctgtaatcccagctactcaagaggctgaggcaggagaatcatttgaacccaggaggtggaggttacagtgagccaagatcgtgcctctgcactccagcctgggcagcacagtgagactctgtctcaaaaaaaagaagagcattccttttctggaaaagaaattgcaaatggagagaggatatccacttaatgtcctcagttttttcggaagctaactataagtctttgctttcctttagtcaaatagaactaatttgagtaccaatgcaggtaaagaaaactctcagagccagatcactgggtagtttccagagaatggaattttgaaagtttctaaaggttgacccaatgaccgtaatttttctctccttttttcctctgtaaaataatagtttatagtgtatcaaatggaaaatcatagctgctgtgggttatagaatcaagcatctgcttcagatcatttctgccctggaccccctgatcttgcccctccaacaacgatacacagaagcagcagcccttatagaccttcccaggagcctgtctcagcacacagtttgcaaaccgttgcctattgaggtcatcagcttctcccttactgagaaataccagcaacctcaaaagaccatgagtacatctctctaagcctcctgaaagcagttaactgaagccttgttttattaagttagtatcttaaccttgcttcttgcttttcatttcaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgttagtattcatcttttacttctaagaaccttgaaaatgatttcctaagggaaaaatttatttgccttcagagaataagtcataaaaagcacaagacacatctttagttacctctaagcacatctaaatttggaattaaaaaataactgtagtaatgttggaaatgcagtactgatttttacaaaacttatcaaatagaccttccatttctgtgtggggacagagggcaattctgtatggggattacttgagcaggatgctaggcagtatttgctgagcacttttactttggaatccaggtgagaagcatggattagctactttgagagtcttattgtatagcacttttgtttttgtatgtggtagtgagtgactgattgcttttatattcttgctattcaaaatgtagtcctggagccagaagcttgagcagctacctgaggctttttggaaatgtattatcacaggcctgccccacacctactgaagcgatttatatgcacactgaattttgagaagcactgtcttatattacacatgcagcttaagatttaacagcattagggccgagaacagtggctcacacctgtagtctcagtactttgggaggccaagaagggcagatcacctgaggtcaggagttcaagaacagcctggccaacatggcaaaaccacatctctatttaaaaaatacaaaaattagccaggcgtggtggtgggcgcctgtaatcccagctactctggatgctgaggcagggagaattgcttgaacccgggaggcagaggttgcaatgagccaagattgcaccactgcactccagcctgggcgacagagtgagactatgtctcagaaaaaaaaaaaagatttaacaggatttattaaatgaacatgggagaaacaagaaccagaatcatagaataatctcactcctattagattaactctttttttctttttgagacagagtctcacttgtcacccaggctggagtgcaatggtgcgatctcagctcactgcaacctccgcctcccgggttcaagcaattctcttgactcagcctcctgagtagctgggatcacaggcatgtaccaccacaaccagctaatttttgtatttttagtagagatggggtttcaccatgttggccaggctggtcttgaactcctgacctcaactgatctgcccgcctcggcctccccaagtgctgggattacaggcatgagtccacgtccagcctaggtcaactcttaaccttattgttggttttgtttttccaggccttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaacaagcttaagaattc

SEQ ID NO: 38272 - DNA, 12678 bp, Homo sapiens
cccgagaccacgtggcctccgagcagctcagggcgcccttgaaagttcttggatctgcgggttatggccggtcccttgcagggcggtggggcccgggccctggacctactccggggcctgccgcgtgtgagcctggccaacttaaagccgaatcccggctccaagaaaccggtaaatgggtggtggcggtgcggggaagcgctggggacccgggcgatgaaagcggcccttctctccctgtcattaggagaactgccctttctaggagagtgttgggatgaaaataggattgcctcatgcctgttctcccttactgcccagaggggaatctttccacgtgcacccagttcttttttttttttttttttttttttccgagacggaggcttgctctgtcgcccagaagcaattctcctgcctcagcctcccgattagctgggattacaggcgcccgccatcacgcccggctaatttttgtatttttagtagagacgtggtttcaccgtgttggccaggctggttttgaactcctgagctcgcgatccgcctgcctcggcctcccaaagtgctgggattacaggcgtgagccaccgcccccggccgcacccagttcttaataaggttatgtttacaagtgtaaagataccaggcggagaagccgactcgctgaaactacaaagtctttgtgtcattcaaaattggatttaaaatgaaatgttttcccggtgtatctttatgttcattggaaagatctgaattgcagctgtcccttctgcagttgactaaatagagctagaaaagctgttagttgacaatgtactgtcattttaacagtcagttcattgctttcgtgaaatgacaggaaattaaggaaaagattttcttcaacagatcagttttcaaataaaattacaggtttatgaataacatttgcatatttacaattaatttcagaataaattcttgcctatcatttaaaatgttgtgaatatttaattctaggatttttttcggtttcaacctattataaaaaccttatccccatcctaacctttactttttgcttttgaaacacacttggactttggttacaagaattagctatgtctttagaggcaaagatgctaacagagtgtgtggagctttgagcaactaggacatgcttgacacaatagtgttagctagcactggtgggctggatgaatgaacagcataacaaaaagtgaagagctgaaatgcagtttttagaaatgcatctgaaattcataaaattcttttttttccttgcaggagagaagaccaagaggtcggagaagaggtagaaaatgtggcagaggccataaaggagaaaggcaaagaggaacccggccccgcttgggctttgagggaggccagactccattttacatccgaatcccaaaatacgggtttaacgaaggacataggtaaggttgctttgctttttaaagtacaggtccccaatttccattaaaaagcacctaaaaatagtttggtagaaattttggtggaaattgtaaattcactttgaagcaaacttttgctactgttcccctgaaccattttttggtaatgaaatcttgcctggattattaaaaggaaaagaggcccagacactgcacttagacctgcaaaatggagattctaatgccagctctaatggttattaaaagagtgagcaataatagacagtatacataaaaatctggcccactgtagtcacctaataaatgataactaccattattactttgagctccatagtaagttaaattttccacagatttatttgtgtaaataagtgaagtaaatgcttagagagggaaataatttttagtggaacaaaggtggtacaggtttgttttcattacccaaaatcaagcagtattacatgtttgtgttacactcaagagggttttgtttagttaaataaaattggtggaggaaaacacaagacaaagctttgagttgatttcgagaagttacaggaagatgagagttttccaactcttacattcttgttttacagtttcagacgccagtataagcctttgagtctcaatagactgcagtatcttattgatttgggtcgtgttgatcctagtcaacctattgacttaacccagcttgtcaatgggagaggtgtgaccatccagccacttaaaagggattatggtgtccagctggttgaggaggtaagtcttgattagatcttttggtgttatataggaggattttttttttagacagagtcttgccctgttgcctgagctggagtacagtggcgcaatctcggctcctgcaacctccacctcacaagttcaagtgattctcctgcctcagcctcctgaatagctgggattacaggcacccaccaccatgcccagctaattttatttgtttttagtagagacagggtttcactatgttggccaggctgatcttgaactcctgaccttaagtgatctgctcacctcggcctcccaaagtgctggaattacaggtgtgagccaccatgcctggcccgtaggagatatttttgatttccagataatcagtactctaccccctttatttttagcccatttgtgtttataactgttatgtagtggtgatagctgtggttttggaaagctgtcatactatcatggcagggctctgtcccttggtcctggaatgctgctcttctgcatatctgtaaagcttgccttcttttttttttgtttttgtttttgagatggagtctcgctctgttgcccaggctggagtgcagtggcacgatctcggctcactgcaacctctgcctcctgggttcaagaaattctcctgcctcagcctcctgagtagctgggactatagtcgtgcgccaccacacccggctaattttttatatttttagtagagatggagtttcgccatattggccaagctggtcttgaacacctgacctcgtgatccacccaccttggcctcccaaagtgctgggattacaggcgtgagccaccgcccacggcgcccccttcttttggttctctgcttgaatgtcaacatatcaggaagatcttttttttttttttttttttttttttttaaatagagatggagtctcactctgtctcccaggctggagtacaatggcgcgatctcagctcactgccaacctctgctgcccaggttcaagctattctcgtgcctcagcctcctgagtaggtgggactacaggtgcgtgccaccacgtctggctaattttttttatttttagtagaggtggggttttgctatgttggccaggctgttctcgaactcctgacctcaggtgatctgcccgcctcagcttcccaaagtgctgggattacagatgtgagccaccccgcctggccaggaaggtcttttttgagagtctttttaaaagagcacttgccctgcttcaggagtcacagtgtttcctttactctgcccaaagtatttttctttgaatatatatgagcacttgacatttattaccaagttatgcatttgttttcattgtcttcctcactagaatataagctcccttgagggcaggtgctttgattcattgctttactttcttctttattttttttgagacagtatctcactctgtggcccaggctggagtacagtggtgtcatctcagctcactgcaacctcttgtctcctgagttcaagtgattcttctgccttagcttcccaagtagctgggattacaggcacctgccaccaggcccagctaattttctgctttttttttgtttttggagatggagtctcactctgtcacccaggctggagtgcagtggcacgatctcggctcactgcgatctccacctcccgggttcaagcgattctcttgtcttagccttccaagtagctgggattacaggcatgtgccaccatgccaggctaattttgtatttttagtagagacagggtttcaccgtgttggttaggctggtcttgaactcctgacctcaggtgatccgcctgcctcggcctcccaaagtgctgggattacagacgtgagctacccgtcggccaaattttttgtacattgttaatcaactactgtttgccaataatacagttgtataagtaagttagtgtccactagagggaagcatatatttatgaaaaaacctttcagattcttttgaaaaagtgaactgtatggataaaaactttccaaataaagtaatttgaaaagagaataccaaatacaagattaagcctcagtattctaccctgagtgtatataaagaaatacacatgtaacttaacatatggaaatccatgaccttatcagcccttaaactgcacatcccaacatccttaggtgttgtctattagattaataaaaataaccctgaaaactttaccccagggcactggtcaagtaattgcaatgacacattatttatagctctgttaactgatttacttctgtgatttcagatttgtagtaaatagtgaataataagacagttttgatcctttagcacaaaattatcaatttggaaacatgttctcaaggaaaagcaaaatgaaagaaacctgatataaagatagtcctaaaaatgctatttatactactgaaaatactggaactgacaccaatgcccccaaatagggagatggttaagcaaactatggattgcttaaaaatcacaaatgatacagcaagaccctgttttattgaatcaaaggtactgttgattttaaacatataccagtattggatataaaaaaagtgtgaaaatgcatcttagaattgatggaatatttttgaaatacatgaaaaattaataatagaaggagctaaactgggagccactttctttcagcttcatgaaagctttctattgccatagagtggtaatgctgccatctttttgcttttatcagaatctgctttgaaattagagaaaaatatagcacatcctgactgtgaccaaaaatttaacgtttcagagttcagagctacattttccttttttttctgtcttttttattttttttgagatggagtctcgctctgttgcccaggctgcagtgcaatggcacaatctcgactcactgcaaccttcacctccaccttgggtttaagccattctcctgcctcagcctcccgagtagctgggattacaggcacatgccaccatgcccggctacattttgtattttttagtagagatggggttttaccatgttggccaggctggtttcaaactccagacatcaagtactccgccctccttggcctcccgaagtgctaggattgagtcaccgcacccggcctagaactacattttcttttctttttttttttttttttgagatggagtctcgctctgtcacccaggctggagtgcagtggcgcgatctcggctcactgcaagctccgcctcccgggttcacaccattctcctgcctcagcatcctgagtagctgggactacaggcacccgccaccatggccggctaatttatttatttttttgtatttttagtagagacagggtttcaccgtgttagccagggtggtcttgatcttctgacctcgtgatccacccgccttggcctcccaaaatgctgggattacaggcgtgagccactgcgcccggcctagaactacattttctagtgttgactattctaggaaaaattggaggttttttttttttcagcttagaggctataataaagtcaatagtgaatgcaaagtgaaatttctattgtctttttttccctagtgaggccaacttctccaaagctcagattttgtcagattttctgttcttccacctgctccagcctgcatattcccctgtttaacctcctgctggcctcttgcttacttagggataaggaagattagtttttaatctatgtttgacagcataatgttgtggttaagaatacagatactgtgactaaactccctggattagaatacttgctttgtgaccttgggcaatgcaacctctgtgcgttggtatttccatctatgaagtcggtatttccgtctatgaaagtcggtatttccgatctatgaaagttggtatttccatttatgaagtcggtatttccatctatgaagtcggtatttccatctatgaagtcgggatagcaataatcctatcataaggttgttatgaggattaagcagcctactattaatgaagtcaggaatgaatgcttagtaggtgtacataaaatggaaatgtagtcagtcttacttacacggattgaaaattagtaaaacaaggtagcctaaataaaatgttaaaaaaaaagtgataggacctcaaagcagagatatttaaaataggaattatagtcgtcccttaggattggttccatgaccgcctcctctcactacaatccagatgatcaagtctctaagatggcctagtatttgcatataacctgccacatcctcccatatactttaaatcatctctagattacttataacatgtaatattaggttggtgcacaagtaattgtggcttttgccattgaaagtaatgtaaatactatataaatagttgttatactgtatttaaaaaagaattgttttcttattgttgtattgattttttttttttttttgagatggagtcttgctctgtctcccagactggagtgcagtggtgtgatctcagctcactgcagcctctgcctcccgagttcaagtgattctcctgcctcagcctcgaaatagctgggattactggtgcctgccatcatgcccggctaatttttgtattttaagagacggggtttcaccatgttggccaggctggtctcaaactcctgacctcaggtgatcttcctgccttggcctcccaaagtgctgggattacaggcatgagccaccatgcctggccttattttatttttatttttatttgagacggagtttcactcttgtagcccaggctggagtgcaatggcgcgatctcagctcactgcaaccttcccctcccgggttcaagcgattctcccacctcagcctcctgagtagctgggactacaggcacgcggcaccacacccagctaattttttgtatttttagtagagatggggtttctccatgttgggcaggctggtcttgaactcctgacctcaggtgatccacctaccttggcctcccaaagggctgggattacaggcgtgaaccactgcgcccagccttattttttattattactttttttccgaaaattatccattcaagttggttgactcacagatgtggaacccacagatatggaggactaactgtattgttatgttataggcactttggagggaaaaacactgtctaaaaaggaagcttgacataattaatttacttttagccaagctgtttaccaacagactgttttgacatatttcagggtgctgacacctttacggcaaaagttaatattgaagtacagttggcttcagaactagctattgctgccattgaaaaaaatggtggtgttgttactacagccttctatgatccaagaagtctgggtaagtttgttccacggtcattttcttctttctctctttgtctcatgttggctactaattttaaattacttagtgaatggcaaatgttggtagtagtttggatgtagtattgatctacatctaccatatggattattatgatttaaagaatacagcctgttgctgacacatacaccaagggcaaaaaaggctctcagcccctcccctgaactgtagacctgcatctgcctgcctggccaattctctagaatgtctagcagggacctcaaatatagcatgtctgaaatgtctcttttctctctttttttttttaagacagagtcttgctctgttgcccaggctggagtgcagtggcgcaatctctgctcactgcaacttctgcctcccaggttcaagcgattctcctgtctcagtcaccggagtagctggggttacaggtgcctgccaccacacccagccaatttttgtattttggctagaggcgggtttcagcatgttgtcaaggctgtcttgaactcttgacctcaaatggtccacccttctcagcttcccaaagtgctgggattacaggtgtgagccaccacgcccaacccctcttttctcttttacctcagcctggctcttcttgtagtcttccctatgtaagtaaatgacaagtccatccaaaatttggagtcctgaactttttcttttatgccctcataaatcttttgagttgtttcttcaaactgtgtccacatttgaccacttctccagctactgccagtctgtcctagccactgtcctcttgcctggatgactgtgggccttcaggttgcctctctgttttgcttccatctgcagtggagtgacgtggcacaaggttccttttaaagcatggactgtcactcctttgcacaaaacctgcagtggtgtccgtgctgctcctgcaaggctggctgtgatctgcaccagctcttgtccctcctggtgttcccctgctccctccattcccttactggccaccgggtttggccttcctccatacaccgagccctgtgtactgtgtacttcagcctcggcctctgctgttcctcctgcctggagcttcccccacttggaatattcatggctttgggccccactgttccaggtctctgcttattaggagatctttctcacctgtactaaataaaagagcatatgtacacacatgcacatgcatggtgtgcacacgcacacacgcacagtcacatcctgtccccttgccctgcattgtgtttgcccttggcagctatcaccagctgacaaagtataagttcatttctctttctctgttcattctttctttcccatctctcaggatgatggagaccttttgctacctgctgtatctcctgcacatagagcgatgcctggtatctagaagaggctcacttaaattttgttgaataaattaattggatttttcaagttgcagagatgacaaccaaatgtaacttgttgactaaatgctctacaaaggattctttgatgcttttacattcaaatgggagttaaacatttcctggccaaattgcatgattagaagaaaattctttgaaaattaatatataaaagggaaaaagggaaggatttgtgtcatctgtatgtagagtttgaaacaaataactaccatttcctttttcccataattgaaagctttttaaaaatattcatcaaaggccgggcgcagtggctcattcctgtaatcccagcactttgggaagccgagatggacggatcacatgaggtcaggagttctagaccagcgtggccaacatggtgaaacctcatctgtactaaacatacaaaaattagcggggtgtggtggcaggcgcatgtaatcccaactactcgggagactaaggcaggagaatcccttgaacctgggagcagaggttgtagtgagctgagatcgctgagatcgcgccactgcactccaggctgggtggcaaagtgagactgtctcaaaaaaaaaacaaaaaaaatttgccaacatgatgattccgttttccctctagtttattatagatgagcatcttttcttattttggtccatcactcagtttttagggtaggctgcctcaaatatgaaaaccagcatttttaaaagagtcacagacattttggaaggactttggtgttagtgtgtttttcagtgattgttaccacagaatgtggtggtggagtttgttctctagccagatgccctctgccacactgagctggcatcttcagaggcaccctcagccttgatgctcttgtgcgtggctctctgcagcagctctgcaggttgtcccaggatctttttgtttaaaaaagtaataaaacaaatccaatcacaggcttatcacttattagcaattttgcctctgaataatttactttgttgtactttagttttccaagttatagaaaattttttgcaccatggtctcactctgtcacccaggctggaatgtagtggtgtgatcaaggctgactgcaacctccaactcctgggctcaagtgatcctcccatctcagcctcatgagtagctgggactacaggtgtgtgccaccatgcctggctaatttgatttttataaagataggggtcttactgtgttgcccatgctggtctcaaactcctggtttcaagtgatccttggtgtgagccaccatgccgggccagaaattttttttttttcttttcatttgagatggtcttgctctctcaggctagagtgcagttccactcactgcaatctgaaactcctgagctcaagaaatcctgccacctaggccccctgagtaactgggactacaggtgcatgtcaccatgctaacttttttttgttttatgttttgtagagatgaggtctcactatgttgctcaggctggtcttgaactcctgcgctcaagcaattctcctacctcccaaggtgctggcattaaaagcatgagccattgtgcctggtctacaaatttctttcttaaatatattttgaagatactttcttgatgattcaaggacatccactatttacttaccctctgttgtaggtgaagtaggtaggatggtttatccagagcatgacctggctttaggtggctctgctttataattcttggtctcgacccttagcagatagcttccagttctcatttctgtgagtggcctgcctggagtacctcctaatcaccatttctcatttgccctgtgtggagatactgctaggtgatgcaatatattagagctgtataaaacagctgtcagattcttgcattcagcaaacagccagaggctagtgtttgctagatactgttccagctgatggagagacgatagtgcaagagtcaaaagtcctttcctggccgggcgcagtggcctcacgcctgtaatcccagcactttgggaggccaagtgaagtggatcacctgagttcaggagttcaagaccagcctggccaacatggcaaaaccccatctctactaaaaatacaaaaattagctgagcatggtggtgcatgcctgtaatcccagctacttgggaggttgaggcaggagaatcacttgagtctgggaggcagaggttgcagtgagccgagatcatgccactgtactctagcctgggcgacagagcgagactttgtctcaaaaaaaaaaaaaaaaaagtcccttccttcacagagcttacgccctggtgggtgatagttaacatctgtctcattgtataccaaatactatacatgtgtgaatggattctgtggattacatcaggtaaactttgtaactgctctgtgacatatgtactattattttgaggttctcagtaatttccttagtactgttttgatttctgtaaccagctttggttaaggttgcattgctaacacgatgagtagagtgtcagttgtattcatacagttatctatttgtgtaattgctttctaagctatctaaaggccctgtggcatctgtgatatcttgtgcgtaggcctttttttcactatctcactttcagaacatgtgtctcgggtcctttaaaatgtttgaaaacagaactggggttatgcagcattccttggtttgtttcacataagatttctttgcctgctctttagttaagataactcattttagtaaaattggttttccagatacaggtatggttgctcatgcctgtaatcccagcactttgggaggcccaggtgggtggatcacctgaggtcaagagttccagaccagcctgaccaacatggtcaaaccccgtctctactaaaaatacaaaatgatccgggcgtggcggcatgtgcctctaatcccagctacttgggaggctgaggcaggagaattgcttgaacccatgaggcagaggttgcagtgagccgagatggtgccattgtactccagtctgggcaacaagagtgaaactgcgtctcaaaaaaaaaataataaaaattaataatcaagagaaactctgtaacatctctatggtacagagttacatctctatgttagagttacatctctaggtatgtctatgagctaatatttgcatctcactttttaaatttaaattttcttttagacattgtatgcaaacctgttccattctttcttcgtggacaacccattccaaaaagaatgcttccaccagaagaactggtaccatattacactgatgcaaagaaccgtgggtacctggcggatcctgccaaatttcctgaagcacgacttgaactcgccaggaagtatggttatatcttacctgatatcactaaagatgaactcttcaaaatgctctgtactaggaaggatccaaggcagattttctttggtcttgctccaggatgggtggtgaatatggccgataagaaaatcctaaaacctacagatgaaaatctccttaagtattatacctcatgaattcccgtccaaggaagcagagttgttaaagagtactggaataggggctgaaggatctatattcccttattgcattttccttatgtataattttccagatggtgatgttacttttcagtgtactcatatgtctcattttcatctaaaattaaatggcaggaaacaaggactgcatagag

SEQ ID NO: 38273 - DNA, 17969 bp, Homo sapiens
ggcgcctgcggcggcgacagcggcagctgcggcgcgaccaggccgggcacctccgagcgcaaggacagcgcgaggtccgcgcagcccagcgcagccatgtgagtgtcccgcgccgtttccggggctgcaggccgggcggggagcaggcgcggaggttctggtgcccccccgccggcgccgcccggtgggtccgggatctgcggctctgtcccgcctcaccccatctcccggaccccggccgcgccttgtctttcctcccctccccccgggcgtggagaacgcagcttctcccacaaaagccgccgcctccgggcctgcagagcctggcgctgctgccttcctcccacggcaaggccctggcggccggtgccccggggcgctgggatgggccaggccagagagcgggctcaaggcgccagcctgggccctggcacgcgcgctccctgggagcccttgctgccttcgccgcaggggaggctgggctggaaatggggagggggcgacgaagggtgcgggccggcctaggagctgagctaatcctcctagctctaggggccggcctaagcggctttgtggccggccccgaggtgaccgagcctgggctggagccgggctctccgcccaaacctggcgtagccgaagccggagaggatcgtccttgtcggggaacggagcttttccctggaaatggaggttggcgcaaggttcctgcaacagccgggcctgggctctctgcagaactggtttgggcaaggggctgctcaccagggctagaggtcggattcagtccagattcagcaccctttgtcctcctctccagggtgagccctgagtccggcctcccctacagaccctccccagccagttctaacgtgtgtccaggctggccgccccagcacctactgtgcgcagcctcgtgtaacaatacttgtgccctggctgcagtctgcggggccgcgccctgggcctgccgcattcggccaacgcacagcatctgaggagggttatgaccatctggcagatgcagaaacaggcccagagaggttagtagtattctcaaggtcacacagctggtttgggagaagcgaggattagatctgagtccttgcccctgcgacacccacctccgtggtattggagggaggagaggaatgataattgggggctgaggtacaaaatactccagcgggacaaggaggactggcatagctccttcttccaccgccctctccggcttgggtcctgtgactgcggcgggagagaggagcaaggtgagccgccccaggggtctgggtttgggtgcgggtgaggggaggactcaggactctgggctgggtcccgcttgagagaagcgggcggggagggcgcgggtgagtcacggcggcccctctgcgtcgccgctcggactcagccctggccaggcccggcccgggggaggccgcctggctcccagcgcgcggccagggaatgtaaccagctgaccagggagggggccggcaggaagtgaggccacccgacagcctccgcccggttccggggtggggggtccggggctgtgccgctccccctccctcctatacgcttgggcagctgcgagatgacgtcagccgccgggtttgggggcagttgccatggagacaaggacaggctcagaagggacccccttctcccttgcagccgccccttgcccaggttatttttagcctctgtttacctcggtcggggcggccccggggtggggcggggctagacccggggactcccagagaggcagctggcctggcacagtgctgagatgggcagcccaggtggtgggatattccgccgcacccgggtgtgccagtcttggtgtgtaggaagtatagcggggctgcaagatctggggccatgcggacaggtcagggctcctccactcacggccatcctgacctggctgtgctgcaagccccataacctttggaaccttggatctgggttatttcccatcctgggaacagactatagggctgacatgagcccagagagtcccctggttcttatcagccagtcccccaccagttgaggtggcccttctgccttagctcaaggggttcagctctttccctacctgctctcacccagcaagggcaatcttgcccgcccatctcccgaagcggtcactcagatggacattatgatggtcatttgtaccaacagttagacatcctagttcctatgggactcgggggatggtggcagcagagggccaaccagagagagaaaagtgatggaacagtcagcggtttccaagtccagaatcccaggggatccccaccctgcaccatcccagggagcagagccccacttgctgatggtatacgataccatcagccagtgggaagggagagggaggattgcatgtcgggtaggggagttggggtggacatagacttaaaatcctccccaccaacaaacagctcaggacctgctgttcctgtgtctaggcagcccagcttcccccactgttcccccccttcatctcccaggtgctacaggacccccagagcgctgtggtgagccaagcagatatgccccaggtctcacaaggttcagtctggtgggaagacaggccctaaaggagaactgacaactgggttatgtggtctcggggttcagagggaggaagtcaaaaagggggaaccaacccagggcctgcttcctggaggaagaagtcatagggtagacttgaggaaggagagggacttggggctgagtagtgggaagaaggaataggagcgatgggggctgccggtcagattctgaagaaccttgcaggtattgagagagggtctcagttgctggaacagagaaagcaggggactgggaggagaggagtggttgaaagaatgtgagggacaggacaaatcctgaagggcctacgtgggtcatgttagagagtctgggctttctccctgggacaagagtggctgtggctatttcacatcagtctgaatagagtgatattaaagatttagagtcctggggtcagacagcctgggtttgaatcatggtcttgacacttaccacctgtgtgactgttttgttttgttttttgagacagagtctcgctctgtcgcccaggctggagtgtagtggtgagatcttggctcactgcaagctccacctcccgggctcatgccattctcccacctcagcctactgagtagctgggactacaggcgccagccaccacgcccagctaattttttttttttttgtatatttagtagatatggggtttcaccgtgttagccaggatggtcttgatctcctgacctcatgatccgccctcctcagcctcccaaagtgctgggattacaggcgtgagccaccgcacccggccgtgtgactgttaaaaataatagcagttagtatttgttgtgtgttcacagttagatgttagctaggcatggtggtgcatgcctgtggttccagctacttaagaggctaaggcagtaagattgcttgagcccaggagttcaaggctgcagtgagctatgaacgcaccactgcactgaaactgatcgcttgagcccaggagttcaaggctgcagtgagctatgaacacaccactgcactgagacctgggtgacagcgtgagacctcgtcttaaaaaaaaaaaaattaggtatagtgagtccacctcaacgtccctaccccacatacaattctcccttccccaaacacttcctatagagggacatcctcatgagaggagatctcatttcatcctcccagcagccttgggaaatagctgttgttattattattattgtcctctttttacagatgggtgtctgaagcccaaaaggctgaataagtgtcttgcccaaggtcacacagcctcaggtttctcaggtgcgaagtggagctaataggacttaccccataaggctgttgccaggattaaatgagatgatgtttgctaagctcaatgcctggcatatagaatgctctcaataaaggacagtttttggcactgtcaagtggctacaattttaaggtcagtgttgttactgaataatgaatggatgattgcaggttagagtggagacaggaggtccctcaggaaggttctagctcatcagaagcccagctgtagggctcgaggggagagttggtgatggcttggacctgaattctggctataggggtagaggtgagggggcagattgcagagagatttaagagccagacctggcaggagggggtgacctggcaggagggggtgactggtcataggggctaactgagacatccaggacgacttctagtttctgtcttgaacaacggggtacatagatggtggagtgtcatggagaagttgagactagggagagtcaggtggaaagtggtgaatttggtttgggaacctcaaacccagcatgcactatgacagcgcacgctgcatctggggaggcagcaagcaggcagttggatacagaggcctggtgctcagaagagtggcttgggtggaggagagataaggaagctggcaacatttagatggcattgagctgcgggatctgtgcacagcccaagggcggggaggataaggcccattcggggatgggaggaaagaaggggcctctgtgggaaagtaagatatgcagccagagaggtagatagaaaaccagcgtattgtctcttgaaattcaggggaaggaagggcttaaagaagaggaggggaaccacgaagtccaaagctttgctgagatcaagcaggataaggataaaacatgggcactgggttcagcaacagggaggtcactggtgaccttgtccagtggtgggtacagaaactggaccagggtgggaagaggagcaggcgggtgtagtgagaaaatgcaggtagacatctcttcaagacacttggctttgaaaggagaggagaaagatggagtaagaaatggggtagctggacaaagacagaaggtccacaagcagtcttttttttttttttttttctgagatggagttttgctcttgtcgcccaggctggagtgcaatggtgcaatcttggctcactgcaacctccacctcccgggttcaagcgattctcctgcctcagtcttctgagcaattgggattacagtcatgcgccaccacgcccggctaatttttttttttttttttttttttttagtagagacggggtttcaccaagttggtcaggctggtctcgaactccttacttcaggtgatccacctgcctcggcctcccaaagtactaggattacaggcatgagctgctgcactgggctgagtcatttcttttttgtaattttttttttttaagaaagaatcttgctctatcacctaggctgtagtgcagcgcgacctcagctcactgcctcctgggttgagcaattctcatgcctcagcctcccgagtaggtgggactacaggccatgccaccacacctggctaatttttgtatttttaatagagtcagggtttcaccatgttggccaggctggtctcaaactcctagcctcagtgatccacctgcctcagcctcccaaagtgctaggattacaggcgtaagccaccgcaccggcccaacattttgtaattatttacaaccaattttacattgaaatataataggcacacaaaaagtgtgtatgtcctaagtgtacaactctgtacattttcataagagaacacactcatatagaatcaggaaatttaacccagagcaggaaataggacattaccagcaccctggaagacccttgtggcctcttcagtcacaacacctggagggagactcccaggctgacttctatcaccatagattagttttgcttgcttttgaacttattatcaaggtcatacatttgtcctctcttgggtttgctctcagatccacccatattgttgcatgtcactgtatatttttcattctttttgctatgtggtaattccattattcattgacaggcatctggacagtttctagggttttctttttttctttttttttttttttttttttttttgagacagactcccgctctgtcacccagcctggagtgcagtggcatgatagcagctctctgcagcctctgcgtcccaggttcaagcgatcctcctgcctcagccgcccaggtagctggcactacaggcgtgcacgaccaagcccagctaatttttgtatttttagcagagatggggtttcaccatgttggccaagctggtctcgaactcctgacctcaagtgatccacccacctctgcctcccaaagtgttgggattataggcatgaaccaccacacccagcccgtttttatttttcatgtgggagtgacttgagcttgtctgagacttgtggagaaagtctgaaacaccccaaaaggagaaagatgactagggtcacacttgaggatttgccaggtgggcagtgagggcctggccaaggttgaggattgctctgtgattccagccaggctgctgtgccaagacctctggcaactcctgccaacctgtgtgcaggtgtagagaagtccaggagttggattccccagggctggtttctgccagctgggagagaggtgcgcagtgctgaggatacttgcagcaggcaagtgatgggatggtggctgtggatccaggctggggaggaggctgtgcagggaaggtacagaagagaaggtaggagggagctagcagaaaaaaagaaagcagaggcggactgtgagctctgcacagggtggtgtctgtgaaattctgggctgtatctccagtgactggcacatgcttggcacaaggttgccactcagtgaataggtgaataaatgggtgagggctcaaggggccagaggtctcaggtaaaaggcaggtgaggtgggggtgatggaaagcctgagggttgcatcagtgtggttgtggtttaggaggggggcattccaaaggcaggtgataaggctggggatggctgaagggaccagagaggccagcgataggcaggcaatccatgggaatgcacaggtcaccagtgtagggtgcagggtacccaggcttcgccttcaaggaggaggggagaataacatatctcaaactgaggtccctggacctcttgcatctgaatctgtcggggggagggggaacttgtggaaatgcagacccctgggcccaacccagccttttggggagaaagtaagcacagtatgggagaactgagcctcaaggagcaagagtgtttatgggatgggggagcatccagcccctccaaggtcaagggagggatgggcatggtggcatctatccaggctagaggtggacatgggatattcaaagaagagataggctgggcgcggtggctcatgcctgtaatcccagcactttgggagaatgaggcaggctgatcacttgaggtcaggggttcaagaccagcctggccaacatggtgaaaccccgtctctattaaaaatacaaacattagccaggcatagtggcgggtgtttgtaataccagctatttgggagcctgaggcaggagaatcgcttgaatctgagaggcagaggttgcagtgagccaagatcgtgccactgcactacagcttgggagacacagaaaaaaaaagagaggtactggggatggggatcaggatgggaacgcagaacctgagaggcccatgtgagctgggggcaggaaggatggggcattagcctaggatgcagcttgactagggaggaggccctggctggcagccagacctgatcctttcccctgggtcctgggaagaggggagtgctcaggctgagcactccctctgtgggagtagggatggggtggtgcatggggctgtgggactctgcatccagttccttctctgcatctctcttggcgcagcagcacacactatggggtggatctagcctcacactttcagcctctcttctcagcctcagtcccctggtgatcagtgccctaactctccgccctccattggcacagcccctccaatcagcacccttagcccatctttccactcttcagccccctactatccaccttctcacacttagaaccccagctctcagccctctgtgtgttcagccttagcactgctcaacagccactcttttttgggggagacggagtctcgctctgtcgcccaggctggagtgcagtggcgccacctcccgggttcaagcgattctcctgtctcagcctcctgagtagctgggattacaggcgcgcgtcaccatgtccggctaatttttgtatttttagtagagacggggtttcaccttgttggtcaggctgatctcgaattcctgacctcgtgatccgcccgcctcggcctcccaaagtgctgagattacaggcgtgagccactgtgcccggcctcaatagcgactctttaagccccctactctaatgtctgatacttcctccacttagcgtctccattctatcccttcatattcatccccatgctcaaatccctttacgcacattgctgaccccagctgagcagacccctcgccccccgtcggtcccctccccgaggggaaccccagtcaccggtcccgccccatccaggcgggctgagtcaggcggcaggaactgggcggggggcggcgccgggaggagccgaagccgagccagagccgctgggagcgagcccggagcccagccgggcggctcgaagtggccagggccggaaggtccgcggggggcgagcgcgggtcgggggccgtcccggacccaccatgaacaccaagaagagaggtaggacccagctcggggctgcgaaagctcagggactggccccaggggaagcaggccgggtttgggggccaggagtgtgtgtttcgccgaagcggggtgggggtctgccgaggagctctccccgccgatgccggggtggaggcgcacgtccgtgactcagtttccaggtgggagcctcaggaaagaggagggggcggggcccttctcggcatcgcgcccagctctgggaatccccctgcctggagggcgccgggacgcccgggccggtgggggctgggggcagcaggtcacgctggcaggcggggggcgggcgacaaacccgcaccggctgggcctgtcgggcagctccgcagggctccgagcgtggccccgccccgccccgtgacctccttgggctcccggggtggggggccccgagctccgggtgccctggggggggaaatcgggggcagggctggggaggctgccccgcccccgggtaaacaggcgcttccgcacattcttcgcgcgcgccgcccctttcctgccccttcccagccggaggagggtccccgcgcgaccccccttcctgccccgcggcaggcggagcccgcacctcggcaggaagtgggggccgagccgaggccacgctgagtccgaggccgagtcgcctgcggctgtcctgtcattagtgcccgggtcggcgggactaggcggacccggccggagcccgctggggcagctgtgcctagcgacaggaaagacctgcgccagccctggatcccgctgcgtgggagagggcttcggggatccgactggtactggacacccccccgatcacccgcagggagccccgcgcggactcactctatgatgtccctgtcggtgcggccgcagcgccgtctgctcagcgcccgggtcaataggagccagtccttcgcaggcgtcctcggcagccacgagcgggggcccaggtacgcggccgcgcagggttggtggggtcaaagggcgtcagatggggctgggtctgggggtgcgtagtgagagtctgggggactcctgctctcctctttctgaggacagcctctccttcaggagtttcccggtcttcagcccgccggggcccccacggaagccccccgcgctctcccgagtgtccaggatgttttccgtggctcacccagccgccaaggtgccgcagcccgagcggctggacctggtgtacacggcgctgaagcggggcctgacgtgagcagctcctctgttcccagccctgtcccgggatccctccccaagcccgcatcctgctagcaggaaccttctccagccccatgccctctccctgctgtctgcaccctgggcagcatgaggctggagagccgagttcattcttgtggtcgcccctttcctcagggcctacttggaagtgcaccagcaggagcaagagaaactccaggggcagataagggagtccaagaggaattcccgcttggtgagtggcgggaggtacggatgccctttgcctctttggtgtggagggctgggcaagggcagccctgggtgatatctgggctattttctgaagtgatctggttcaggtgtgagtagaaaaggggatatcaggaaaggctgaggggcttttctatccccaaactttgctgtgcatactttctgcttgggactcagtacctgctccaggagcttccagtggggtaggtgggacccctacagacatggacagcaggagattctgctgcagtggtactgagcagtggtactgctgcatggtgcttcttgggaagaggttagggcttcctggaggagggaacacttctgccggggcttgatgggagttcccctgcagagggaaccttgcacaaggaagcagagagctctccccaggcggctgcaggaaaaggaatcccagggaagaggtggaaggaggggtcctggagggggctgaagggaccagatctgtgctaccagcatccaccaagggctagaccagcaggaaggggcgtcagttgctactgtgacaggagtgcttgtggactgtggtgtgagaaaggggagctgtgacgagtctgagtgcctctgctggagtcctcctcatccctcctaaatatttgccccttctccccacccctgcagggcttcctgtatgatctggacaaggtgagtatgcatggaatggtactggaaggggttggctcacagggagggtaaggaccctgggcctcaggcccctcctgacccacctctcccccagcaagtcaagtccattgaacgcttcctgcgacgactggagttccatgccagcaaggtacgagtgcagcatgtgtgcagagtggggtggggggttggatatcatagggagaagaggggtggtgccaggccctgggtgagcaaccttagaggtgagtaaccccagaggtgagtctcagtccccctactgtcaccccactcaccttcccagatcgatgagctgtatgaggcatactgtgtccagcggcgtctccgggatggtgcctacaacatggtccgtgcctacaccactgggtccccgggaagccgagaggcccgggacagcctggcagaggccactcgggggcatcgcgagtacacggaggtgagggatgggggcccatgaggcagaggcacagggtgtggcagggctagtggctggcccttgaccccctcctgtccctgcccctccctcccagagcatgtgtctgctggagagcgagctggaggcacagctgggcgagtttcatctccgaatgaaaggtactgagttgtgggggcaggtggggggctggagggagtatgctgaagaaccccaatatggctcaccgacttctccccttctcctccaactcagggctggctggcttcgccaggctgtgtgtaggcgatcagtatgaggtatgagaatgtgcagggaagggctgggtcggtagggtcccaacacctaggctgcctcatcctacctgttcccccagatctgcatgaaatatgggcgtcagcgctggaaactacggggccgaattgagggtagtggaaagcaggtgtgggacagtgaagaaaccatctttctccctctactcacggaatttctgtctattaaggtgatgtctctgcccaggacggcaggccaccatggccctgtgaaccccttgtgacccccattaccctgagtcccttactcctgtgatcccctcatagctccatagccctgtgaagatatgattccatgaccttcatgatctctgtggccctgagaggaacaatctttgtgactcttaggacatcatggcttcctgaccctgtgacctcctcatgatcttctgaccctgtgaatatttgacctcctaagctcccatgaggctgtgacctctatgacctcagtgaccctaccatgcagacctctgtgattcccatgctcccaggctgcttcaagcatccatggctccatgagcatgcatgtgtctgtctatctatctaggagttggcgggtctcactctgtcacccaggttggagtgcagcagtgcaatcatacctcactgcagtctcaaactcctgggctcaacccatcctcccacttcagcctcccaagtagctgggactacaggtgcaccaccatgcctggctaaaaattttttttttttttttttttgagacagagtcttgccatgttgcccaagctggtcttgaactcctggccttaagtgatcctcctgcctcagcctcccatgaccattttataagttctatgcaaattcagacctcagatttcccatgatctcatagcccctgcacccttgtgaccctaccatgcactcttggctacaggtgacagaactgaagggcctggccaaccatgtggttgtgggcagtgtctcctgtgagaccaaggacctgtttgccgccctgccccaggttgtggctgtggatatcaatgaccttggtaccatcaagctcagcctggaagtcacatggaggttggtggggctgagaggcttggaggagggccaggagggctgtggcacctgccaacagcctcttcccttcccagccccttcgacaaggatgaccagccctcagctgcttcttctgtcaacaaggcctccacagtcaccaagcgcttctccacctatagccagagcccaccggacacaccctcacttcgggaacaggctttctatgtgagtcatagcccaggtccaggcctcaccatcccccagaggctccctgggggtggttctgaaatgccctctcctctttctcagaacatgctgcgacggcaggaggagctggagaatgggacagcatggtccctgtcatctgaatcttcagacgactcatccagcccacagctctcaggcactgcccgccactcaccagcccctaggcccctggtgcagcagcccgagccccttcccatccaagttgccttccgcaggcctgagacccccagctctgggcccttggatgaggagggggccgtggccccagtcctggcaaatgggcatgcaccctacagtcggactctgagccacatcagtgaggctagtgtagatgctgccttggctgaggcttcagtggaggccgttggcccagaaagcctagcctggggacctagcccacctacacacccagctcccacccatggagagcaccccagtcctgttcctcctgccctggaccctggccactctgccacaagctctaccctcggtacaacaggctctgtccccacatctacagaccctgccccatctgcacacctagactcagttcataagtccacagactctggcccttcagaactgccaggccccactcacaccactacaggctctacctatagtgccattaccactacccacagtgctccaagccccctcactcacactactacaggctccacccacaagcccataatctctacccttactactacaggccctaccctcaatatcataggcccagtccagactaccacaagccccacccacactatgccaagccctacccataccacagcaagccccactcatacttccacaagccccacccatacccccacaagtcccacccacaaaaccagtatgtcacctcccaccactacaagtcctacccccagtggtatgggcctagtccagactgccacaagtcccacccatcctaccacaagccccacccatcccaccacaagccccatccttataaatgtaagcccttccacttctctagaacttgctaccctctccagcccctccaaacactcagaccccaccctcccaggcactgactcccttccctgtagtcccccagtctccaattcctacactcaggcagaccctatggcccccagaactccccacccaagtcctgcccattccagtaggaaacccctcacaagccctgccccagatccctcagagtctacggttcagagtctaagccccactccctcacccccaacccctgcaccccagcattcagacctttgcctggccatggctgtccagaccccagtcccaacggcagccggagggtctggggacaggagcctggaggaggcactgggggccctaatggctgccctggatgactaccgtggccagtttcctgagctgcagggcctggagcaggaggtgacccgcctagaaagtctgctcatggtgaggagggctgggctgggctagggcaaccagggagggcagccagggggcggcagccgctctgatgcccttcacaacctcagcagagacaaggtctgactcgcagccgggcctccagtctcagcatcactgtggagcatgccttggagagcttcagcttcctcaatgaagacgaagatgaagacaatgatgttcctggggacaggtgagggggctaggcaagatgggtgtgaggctaggtgagagggaaaaggtgaggcaggaccaggggaaggtggaacaggtgaattgggagaaagtcaaaggacaggacaggtgaggcagggccaggtggagcatgtgaggactgagttgctggcaggtgcacctgtgtccacccctcccatgtccttcatgcccatgtctccaaccctacgtgtgtccccagtgcttctgaccgccctcttcatctctgcaatgtctgcctcccctgccggtccccatcagcttgggtgcctccagcccctcctcttccccttggcctcaccttggacctgccctttaaggagctctctcagtgtctcgccgtgcaccctgggaccccagcactgccccactccttctcaaccccgactctcccagaggccctggcccctcaactgtcagtcctggagtggcctttgctggttcccagttgagagttgtgccaggtccctccttcctctgctgctgcccaggctacagccccatgccctgcaccctttgcagtccacttgtcataaaccatcccgcctgcagcctactcctacccatgccatccccagtggtcccagctggaggtagcatggcgcagactgactccagagatccctactaccacctgctggtcccagccccttcctccttctggaaatcctccatgaacttaccccactgtctgctgtcggtgcatcatcttcttcctttctggcatgggggaagcttaataaaaataaacgctggtgaccaggtggtgatgtgtgcctgtggggtggtggaccccatttttccctcaggcctccaagcagcccggaggctggggctgaggacagcatagactcacccagtgcccgccccctcagcacggggtgtccagctctggatgctgccttggtccggcacctgtaccactgcagtcgcctcctgctggtgaggctgatggtgttcccccacccttcctttgtaacccctaaccccagggagtcctgcccttccatcctggtcctctatacctcctctgagtgccacaccccagtgccccagggcccttggcatctggcccttgctgaatggagtatctcccaactctgcaaccccaacctcccccagtgcatgctgggacttgtccctgagcacgatcctcccgagccctaccctgaggcctgagctacttggccacccatgttctccagaaactgggcacatttgggcccctgcgctgccaggaggcatgggccctggagcggctgctgcgggaagcccgagtactggaggcagtatgcgagttcagcaggcggtgggagatcccggccagctctgcccaggaaggtaaaggccctgggggttcgggctctgccatctgccttgaagctcctacctcagcctactgccatctgcatgctctctactcacctgcctgcctgttgctgacggtttccctcaccccctcacagtggtgcagttctcggcctctcggcctggcttcctgaccttctgggaccagtgcacagagagactcagctgcttcctctgcccggtggagcgggtgcttctcaccttctgcaaccagtatggtgcccgcctctccctgcgccagccaggcttggctgaggctggtgagtgggctgcttcctccttccacccttgctcagattcccagtgacaggaagctcggggaagccaggtcagcccacacagataaacgaactgggcaccgaggagaccagcaaagacttgggccttagagcagaaggacccagatgggtggggtttgaacagggggcccctggacctgagcctgggataggagcatctctcccctctaaaagctgtgttcacccaaactctgaggcccatgctactgcctcctgcagtgtgtgtgaagttcctggaggatgccctggggcagaagctgcccagaaggccccagccagggcctggagagcagctcacagtcttccagttctggagttttgtggaaaccttggacagccccaccatggaggcctacgtgactgagaccgctgaggagggtgaggcggtggccctgatcacatagtggcctcttggggtctgaggacatgaggacaagccctccccaacctcgggggctcctcaccctgccaccttgcccacccacccaccatatccccttttttcagtgctactggtgcggaatctgaactcggatgatcaggctgttgtgctgaaggccctgagattggcgcccgaggggcgtctgcgaagggacgggctgcgggccctcagctccctgctcgtccatggcaacaacaaggtcatggctgctgtcagcacccagctccggagcctgtcactgggccctaccttccgggagagggtgagttggacagggctcccttgagggcgagggctggggtcctggactcccactgtctggctaagtctgtcctcccacccttccacaggccctcctgtgcttcctggaccagctggaggatgaggacgtgcagactcgagtggctggctgcctggccctaggctgcatcaaggtgacccctgccaaccctcccacccctctgtccgcttccggcacccccacccctgaaaccctcccatctgctcccctgagcccacctcaatgctccctcccctgacaggctcccgagggcattgagcccctggtgtacctctgccaaactgacacagaagctgtgagggaagctgcccggcaaagcctacagcagtgtggtgaggctgggggatggaagagatgggtggagttctgggacatcttggctgatgggagtaggagagatggcgccaggggtgggagagtgggatggggctagggccacccttgacctcatcctcactcattacaggagaagagggacagtctgcccatcgacggctggaggagtccctggacgccctgccccgcatctttgggcctggcagcatggccagcacagcattctaaactattcacccatgggttcctggtgcccctttccccccactttcagggctcaccaggcactggcagggagggtaagggctggctccagatacccctcccccacagattcctagcaatgaaaatctaatatattcttctgttgcccctggggttggagagtcagtgcctgcagtcaagtgcctcccagcctcggctcagcacatcccttgccacaaatcagtgtctggggcttggccaccctgccgctgcccagccacatcccttggttttgtattttatttacagagttttacagaaaataaaaaagcaaaatgtctttcct

SEQ ID NO: 38274 - DNA, 10694 bp, Homo sapiens
gcggcggccggaccgggcgggcggagccgggcccgcggggctgctgcggggcgatcgggccgggccgctgccgcgccatggtgagccgggcggggcaggccgcgcgctcgggccgggcgggggcgccggggcccgggggcgggaagggggaggccaggacgaggaggggcgcgcgcggcggcggggccgggccggggtctgcgggcgggggaggggcggcccggcgggcgcggctcgggggagggtccgttccaggggccgcgcccgcgggctggggttctttgtcagcggcgctgcggcgagatccggacaaaggaggcggcggggggcggaggccgctttgtggggatcgcggggcgctcgcccccgcccgtgcagcccccgcccgtcctcagctacgctcccgccttcccccggcatttcggggttcttcaaaattctgggagctccggggagggctccggggataggggtccaggtgacgtccggcgcccgtctcgcgggtagggaaactgaggccgggccgcagcgttcggcgcccggttccgtgggcagcggctgcgcggcgtgggcatgcctagctcccctggtccccgtcccacaccccgcctccgtcgggccgattcgagctacctccccagctgccgtcccctctccagctgtcgccccctgggccgagccccctcctccctggagcctcgctttgctcctccgtggagtgggggagacgccggcgccgccgggcagggtggaacgggagggtgcgcggagcgcgcctggcaccgcgcctgccacgccgcccgcgctcagcactcgggagccgccggggcgctgtcacccctaagtccccagcacccagcccaggtcgcccagcccgccccagcgagggccacactggggttcacctgtccgcggcccctcaggcacgcgggagaggaggtagggagaatgtggcattttagagtcagggtcgaaatgcgggattttggatgcaggttgcctgggtttgaatccctgcgcgtctacttttgagctgtgtgaccttgggcaatggacttaacttctctgagccaccaatttctgtatctgccaagagggaacagtaatagctcaactgccctgttgtcttgaggcagaaaggagacatctgcgtgagctgtttatctcagtgtctggcacatataattgccaccaactttctccggcatctacaagcaaagttgtttggccaaacaggccaaccctggggcagcctgtgaaaatgaccagcgggtgattcacagggtgggggcatgagcctctggcctggcccgaggaagaccccgactgaccttggggcagtcccggttcagagctctgcgggctcccgcttcctcttttgccactggggaacctaggggattctggagcgagtttcctcttctgaggatgggggtgtcatgggtgggggtggaggatgagataacactggccagagagctgggcacagccccatcagtgtcagtcccactggcatccggccgttcttggtcctggcttctggagggctggggccttgtgtgatgcgtccttgtgtcccactggctgctggaggcccagggcagaacggacgtcccgcctcgtcctggctgtgtccagcagtgccctcttctccctacaaccctgttttcccagtcagaacctggggcaggaaacgtttctggtttgtgacccggggttcgctgaagagtttgttggcacccttggcaggtggctttatggggggaggcagtactgaaagccccgtagggatggctggtcccctgtaagcagggcagccctcctggcgtctgtcaaggagcctcaggaggtggcggctgcaaggcgggggtgttttgctggtggtgagcccggcaatgctcatgatgtgcccggttgagttaggaggaggcagcgtgtccctggggaaggggtgtttgtggcactgggcctgggccaggctctgtgcccttctggccctgggggtgggcttggggatccctcgggctcagtgttctccctttgtccctgctgtagcacacaggaaggtgtggctggtgacatgcaaacctggtgacctcatgtcccttttgttttcacttttcttaccacttctcatcctccccacgacctggtagatgaggtcagggactcgtatccgctttgcgcattgagaaactgaggccaagaggagcagcttgcttggctgggcggaagcaggccgcaaaagtgagtgctggtctgggaggatggaggggactccagcctgctctactgcggtctgtgggccccccgggcctagagcacatggagtggcctctggagtgggatcaggctcagacaagccggggtcctgggagggagagcaggacaggaggatacccgtcccctctctggtagctggggcagggactgtccatttgaatggctctgacggggtggggttcacccccggctctgcccccatgctccttgggtcccagttacggatctctgtgggccttggcaaacccggcaggacagtgtcagtaacacctgcaagcttgggctgctggggaggagtggccaagggcggtgcaggcccccgctcacctggcatggctcaggcttgtcttgcagttgttattccttgggacatgtgtgggctctgccgggagacagagtgtgtcctgtgctgcagttgacctcctttggggttgtttgaggatgctggggcagggggttctggagagcctgggccttggatcttgcttttatagtgggtgggtgggatccgagagtcaggacccccttggcagaggatggcaagactgaaggcacatggagcaggagggtgtgtgtttgggggatccagatggccttgggcttcaaatgccaggcagaggggacactccagcctgcccagagatggaaggcccaggctgtgctctgggtcctggcccctctgcacttggaagaccccttggctctgctgggctcccctctgggctcccatcctgccttctggctttttgcttcacctccctgcgtgcgcctcagtttcctcacctgccagatggagatgctagggtgaacaaaggtggctgcagcctttctggatcagatgctggtgggaatgaatgtgagctgctgtcatgatggttgttgggtgggccaggattcccatgtgccagcctgggcatctccccaacccaagctgtggcccgtccctgtcccctgcatcctgtgggctttactggatcagggcgaggggttacccagcttgcaagacacagctttgctcagaggggctagaaaggaagaacagacaggtggggtccagccaggcacaggggcttgtggggacctgctgccctccgcgctttgagtttcccggggctctgcttggccacccccttccctccctgcctgccagcaagcatggagccagctgcccttccatgggctcaggcctgccctaatccactggcactcgccgttctgtccccacactaggcctgcagccttctcccatgcagtctgccggcttttttgagtctgttgggacagaacatggggacctgtgctcagggttctgggagtgccctgagtgtcagggacccccccacctatgatccccctgagaacagggtctcctctaactcatcactgtatctgcagggagggaacactcaacagaccattcactgagcacctactgtgtacccgtgcagggcaggggtacagctgtgggcgggacagacggtgccctccttggactgccttggagtccagtgcggggagtgagacagcagccaggggacagcccctgagcctagagaagggcaggtagcaaggagagcaaatgaagtagggcaaggctgtagtggtggggtgtgggaggaggggcgcctgggtccagggtggtctgggagggcagcctgcaagaggcgccttctgagaaagtcccgaataggaaggtgccagccgtggggcggtcagggcagaggtgggagcgtgggctcgcagcggagggtgtggggacgcctggggaggcagggagcttggattctctttggtgctggggaggattctgagtggggagaacgccatcacatttttgcaaagatcgtttctcaggaaacatttgctgagtgaatgaaggaacagatacgcactcgggagggccggaccacaggccaggcgtgactgtggctcagtcactgggctctgtgctcgcggcggggcagaaccccacatctggctctgcccatgcctcctggcctgggttcagggcagcagacggggttttggggtcaccactcctcttagagaatccctttgagctggggccgcctgtgcctcagtttcctcattagtcctggggccagtggttgaactggggcccttgaactcaggtgcctcctggcctgcccacctggctttgccccgcctatcccaggtcctggtgccattgtttgattttctacttcctgtccctgaaccacccccacccccaaacacacacacttccccttccgaattgatactgacttgtcttcctgtccagaaaccccaggggagggcaggcaccccagcaggccctgggaaccagaggtgcaggggagagggaggtgggaggtgggaggcacagggcaggttggtgttcttcttgcagggagagaacacagaggttgggacgagtgtagacaggctcacccagccatggtgggaaggctgtctgtggggtcagaggggtcccctgtccagtctggaggcgtgagagaacagctaagtggggttgtggaaccggatggtggcaggggagaggccagggtggtctgtacatgcaggggacagagcagggccaccgtggagctcatggcccgctggagggagaggtgggcgctaatcaggtggccatgctccagaagccagggttgcatgccaaggccactgctccggagggaaggagcccggccgggttgggaaagcttccctgccagagctggtattaaccgggtcagggtgtctttctccagccgggccatctgcgtggtgggggctgccctgtgcacgataggtgccagcaatatccatggtctccctacttgatgccaggagtgccacctgcccccagttgtgacaaccagaagtggctccagacatggccagatgtccccagggtggggacacagtggcccccagttgagaaccactgaacaagggtaagccgccagaacgttctgggcaggggcaactgcctgggccagggcctggtaggagggttcgttgcgggggtcagcgtggctggcgagcagggcatattggggatgtgtagtgttcggtcctgcaggtcattgtgaggacttggaaggcgtcctggctgcagtggcccctgagggtgggcagggagatccttagcgcctgcggcagcctgtctcctggagtcagggggaaggcagtggaatggagggagggcacctcctctgcccagggccctctgcagaagctgccggtttccccgggcctggtccctggacagacgctgggggcgttgacttagctgcctttgtccttcaggcaaacctggcttctggggaaactcctggttgggtaagaatcatttctccttaagggtgctgttcctcaaggacgcagcaggttcgaccctatttggagggaaaacctccttccagtgctgtctgcctgtgctgatgtcagtcttatccaaagggaacaaaaagccagacgtgtcgttctgagtgccgaccgcacgcccagtcctgtgtagaacgcgtctcgggcctgtcctcatcctcactgaccccgggtgcagccagcgtttgctctgtttgtggcgagcgaggcaggagagggaagaaagtgcagggtcttgggactccagagaacctgccagcctcagcactgcggggcagcagaggcaaagccctggcctcagcatgctctcactggctgtgccttgggtgtcacctagagggttgacagggtgcctggagctggggactcttagaccttatgtgcattccatagccacactgtcctccgccacttggcaggcccacccatgggtgaactccgtggctcggccaggtggaggtggtggtcccagccctccaacttctggcgtcattctttcaacatgtggagcacaggcttggcctggcctgggaggggcctcatccccgctcccacccaaatcagctggtgccccgactcctggcacttgccagggggaccctctctgccttcagagccttagccctcaccgtgccccctgccaggaacactattccccatcagcaccgcctccctgcctcccacctgcccacccaggttagcatcttggcacctggttgctgtgttcctgacaatggcaccctgtattgtgagtgaccggcatttggggtactaaccagttacagtctggcgcctgcattagatgctaagcaccatcagggagggagcctctgtctcaccctccctgcctccccgaagctttcccaagtgcctgtctccatctcccgggacactctaccctgttgcttccttggttggcctccgtccaaaccacacaagggactctaccgcccagcttccttctcagatggtgtgccgcgttccaggggtcttcccaggcccgatgcagtgcctggtgacaaaggctgttgtccagtacaccctctcacaggtgtccccaaaggacctgcctgttctgtatatgatgtctgtttgggagagggactgatgtcattgtcatttctttttcttttttttttctttttttttttttttttttgaagagactcttgctcctgtcgcccaggctggagggctagagcgcagtggtgagatctcggctcactgcaacctctgccccccagcttcaagcaattctcatgccttagcctcccaagtaactgggattacacgcatgtgccaccatgcccagctaattattgtattttagtagatacgaggtttcactatgttggccaggctggtctcaaactcctgggctcaagtgatctgccggcctcagccttccaaagtgctggaattacaggcatgagtcactgcacctggccatttatctgctttcaaacccccatctctggccattaggaggccccagttgccctcagtccctgagtggtcatgaacactgagttggggctgggcttcccgaaggcacaccttcagctgaagaaccagaaccatgtctggccctctggcatcctttgctgcagctgtcgctgtcgcagtgttcccggctctgccgccagcgagggtgactcacctgcctggtacagcagcactcggggtttcaaaggtcatgaacaggagctgggtgagcgtgggtgagcagacgccttcgaacgccggccagcatgctttttgtcagggtgagggtgggatgggcaggtctgagaacgattaaaaatagaccccgtggaagtgctaaccgcagctcgtcaacctgctttgtctttcaggactcccgtgtccagcctgagttccagcctcactgagtggccacccccaaagtgctgccagccgaggaagcccccagcactgaccatgtctattatggaccacagccccaccacgggcgtggtcacagtcatcgtcatcctcattgccatcgcggccctgggggccttgatcctgggctgctggtgctacctgcggctgcagcgcatcagccagtcagaggacgaggagagcatcgtgggggatggggagaccaaggaacccttcctgctggtgcagtattcggccaagggaccgtgcgtggagagaaaggccaagctgatgactcccaacggcccggaagtccacggctgagccaggatgcaaggctcctggtcctgtttgcagccggccaagaggcgctgggaggggcaaaaccatacggatgcgctgctgtctgagaggaagggctgacacttgctggcatggcctctgcgggcttcgtcatcgcatgcactgatgcccggggacctggctgtcctgggcttcccctcggcctccaggtgaggctgcccattgcaggcactgggcaggcctgaccttgctggggctcatggccctgtagcgcttttgttacttgaatgtctagctgagcctgtttttgatggagctactactgtaatgcgtgaactaacaaacctgtgaactgtaaataggcccctggaagcacgtgcttaagcccttttgctgatttttaaaaatatcatctagcgcacacgggactggtattctggctgtactaatgacaagctgagtcaagaccctggagggtcataggcttgtaaaggcccacgccacactcggcaggggtctctcatgtgtgtccatctgcgtgtatgtcaaggaagtgagatgccaatttggggtcttgaggctgaccagttggggtgcttgggtgatctctgcttcattagtcatgggtggaagaaaaaccacaccccccgcacccctccgttctttctgcatagactcacttgttaaatagcagttctgttgagagtggagttactgcagggaagctaccggacctgcctgggagccagtgaagggcgagtcagggcacgcgtcctggaggctgccagcgtccttgtagcagagcagtttcttgccgcttgggtcttcagcacgccaagccccccaccaaccctccaccccgagtgaaggcttcgctgaaattgctttggtcctcatagagcctgtggtggctacttttggtctgaaacccacttggcccaggaaagagaaaaggttgtatgttttgtgttggtgtttcctattttctgcactggaggggaggggactgttgaggttctgtcttttttcttcttttcctcttccctcttcacatcacttggcttcctttcctctctgatgaccgtccgcctatggggttctgacttcactttcctcagcgggtctccagtcccctgacccagctctaaaggcacttaggacccagggaacatttctcacgtgcacattcccctaagagccaccagactgcttcctgccagcctgtgcttgcggcagggagccggggcagggcagaggtgaacttgaagttcaggacttgactctcccacaggtggtgagctggtggctctctggtgagctagtgtctccacagcctgtctccaaggcctcccctatgtacatttcagtgagctcactttgatttttaatcccaccacaagcacatactaattttatttatgattcaaatgtgactcgtgcctgcccatccctgtaatagatggaaggtcagccccggcttaaccacagagcactggcccttcatggctgagctcagagctctggcctcctgctcagactaaaggcacctcctctggcctcacccaagcctcttctaaaaaccatgttgaatgaatccacgttctggaaccccgaggcgggagaagtagggagctgttcgtttaagcagcatacacctaaattgggggtttaaacattaagtaggagcttggggtggaagagggacagccggctgggccacctgagcagaaggtggtaatgaaacacctcagctgggctcttgggagaccttaggaagcaggagaggcaacacctctggctactgatggtgtggcaagttcagaagaggtggtggtggggtaggcgtgatgtcagcagaagccctgcaggctgggtgggcaggacacgtggtgggggccactgaaaccaggcctaggagggagaacaagttccaaaggtgccgactggaagaagggggtaaaagtttgctttggtgagtgagaaaaggctggggcgtgtgatccatcccctcacgtttcagaacttccaggctttctacctcgactctcaccacagccagcacatacacctaggctgtttttccttcctccacacctgagggacgcagcaacagctaggatctgcattttcaggttccgagcctgacccctggaactgaccagcgctcgattgtcagccttggcctggggttttgaccttgccagtgaagtttcggttttgaagtgattaaatgtcacttcctcatcagtttcacttctggaggttttcttatcctactccctggtgccagggacgtacctgggagtttgaatcaggcccatttgagcgtggcagccgtgttgggtgaaggtccggggctcggtgaggcactgggggggttttcgggaggaaaatgaaaatgcttctagaatgagtgaaccacatcatagctctcactgttttttcaatagctactttttttagcagacaccagagccacactcaaatggctaagtaggttatgacctctctggattatttttgaatgcccaactgttgcattcaagttttctgactaataagaaattaagcattcatccttcgtatcactgcagaagcaacagtgggggcacagggagggaactcttgacactgagccactaaaatatggactaattttttggacaaatcttcaaacggactgtgctactgtatttgtctcaaagctaccaagtttgtgcaataagtggaagggatgtcatccttcttcaataaatgctgaatgacattcaagctgattttctagaccactgagaaaatctttatttacaataaatttcaataaaatttgcataaatatattcccaatg

SEQ ID NO: 38275 - DNA, 10694 bp, Homo sapiens; identical to SEQ ID NO: 38274

SEQ ID NO: 38276 - DNA, 3809 bp, Homo sapiens
gcggatcatccgcttccggagtcgaggttttcgggcttgtaccgcttggcggtgcggcctggtgtcggcttgcaggttctttctgtgtttgttctctgccctgccaaggccgtagagctggtgcgtgcgggtagcggggctctccgaggagccgcacgccggcggcaccatggtccacctcagtgagtcatcgggccaccgcgagacgttccgggcggtcacggggctcgggagttcggggccgggtggggagagctctcccaggcgcgatggaggcaacccgaacctgaagcagccacactgccttacatttgatccttctctcagttttttccccacttaatcaccgctgaaaaatttccaccccattgaagcagctaaggctccgacaaggtcacagagcctagtgaatggcaagcccatgcggggtgggtttgggtatgaggaggaggtcattgctggctggactggccaagaggggtttcacaaagaagagtagcatctaaactggattgacaggaatggattggaagtgagacatttcagtgggaaaagggaattgtgccgtctgtgtcattttgtcctttttgtgctgttttttgtgtcctaaccagctgcttttctacagctactctcctctgcaaggcctaccgtgggggccacttaaccatccgccttgccctgggtggctgcaccaatcggccgttctaccgcattgtggctgctcacaacaagtgtcccagggatggccgtttcgtagagcagctgggctcctatgatccattgcccaacagtcatggagaaaaactcgttgccctcaacctagacaggatccgtcattggattggctgcggggcccacctctctaagcctatggaaaagcttctgggtaactcagctctggtcttaccttattgaggggattttaaactgaagtcagctccaggacagtaggtgtaagaatgattttcggctgggcacggtggctcacgcctgtaatctcagcgctttgggaggccgaggcgggcggatcacctgaggtcaagagtttgagaccagagtggccaacatggtgaaacgctgtctctactaaaaataaaaaaaaaaaattagttgggcgtggtgacacgcacctgtagtctcagctactggggaggctgaggcaggagaatcgcttgaacccaggaggcggaggttgcagtgagccaagatcgcgtcactgcactccagtctgggcaacagagggcgattccatctcaaagaaaaaaaaaaaagagttatttcattccctctaggctgttcaggactgaagtgggagctgaagttgtgatctaattggcattttgaatctggaggccccttttgtggactcctttgtaagactttgggtgactggtattttatgctaaaaataggaatagtatgttttgaatggccatctgtcagtttacgttttttaaagtaaggggaatattgttagggaagtagacatccactgtctccttgccggggagaagtagtacagagtttggcaagtgaggagcatggtttgcatccatgcactgggtcagatctcagacctcagttctgtgagacagagttcctagggaagcattggcttatactgtgttataataagtgaaaaatctgttacttttaggtcttgctggctttttccctctgcatcctatgatgatcacaaatgctgagagactgcgaaggaaacgggcacgtgaagtcctgttagcttctcagaaaacagatgcagaagctacagatacagaggctacagaaacataaatgagctgactttagtgagcatagcagtgggaacaaggtcaaggtccttttgaaacactgcagcgatcttaattttgttagatttggagttcaataaatggagtatcctgagttgcccttgctcttctggcctggcctgcacagggcccagggagagatttgttcttgtgtgacttagagctgggtgtgggtactaattagcttttttcgactttgtcttgggatagacagtggctatgggaggattggacttttgagttgggctctgggtctcttggacaactttacaatttactggcttccaagacttcctgcttcaaaacccccagccagactattcatggcccattcagatcttcatgttcatcccacaagtgcaagaacagttaacctttcttaattgatttttgtaattggaggtttatattgtcttgcctaatgcatattctctttttttttttttttttgagacggagtcttgttctgttgccaggctggagtgcggtggtgcaatctcagctcactgcaatctccacctcctgggttcaagaggttctcctgcctcagcctcctgagtagccggggagctacaagcatgcaccaccacacccagctaattttttttttttttttgagaggagtctcgctctgtcgcccaggcttgagtgcagtggcgcgatctcggctcactgcaagctctgtctcctgggttcatgccattctcctgcttcagcctcccgagtagtcccaggagtagctgggactacaggtgcccaccaccacacccagctaatttttttgtatttttagtagagatggggtttcaccatgttatccaggatggttttgatctcctgacctcgtgatccgcccgccttggcctcccaaaagtgctgggattataggcgtgagccaccgcccgggcaaatttttgtatttttagtagagatggggtttcaccgtgttggccaggatggtctcaatctgaccttgtgatctgcccacctcggcctcccaaagtgctaggattactggcgtgagccaccactcctagccttaatgcatattcttaaatatacaaaggtagatttgttatgaaaattgctttggggctctaataacctaccttttaagaatgagaaactgctgggcttaagggagttcagtatgaatcaagattgaaccattcaaatgtggctgtgatttctgcatatatcatagatgggatccttctgagaatactggaatagggaattaggacaccaagccaattcagctgtgaaccttattcttgtacttttctttcttgctggtaattttatggagcaggttaagaaggctgctctgtgttaggataaactgtataccaataatgttgacaacctgtaatgagtgttgcattttacttcttgtatcttttccttcctaccttgatgccagtaatctataagggatctttatagtttgaatgtatttgaataacttcagtatactttagttctacttttttatttgactcacaaccattcttaggtctcaagtattcccatgtgttttaaaagcctgaagtcagtgagatgaaattcaacatcaagaatttgaagtaacttgtaaggaaaaataatataaagataccattggggcagtggctcacacctgtaatctcagcactttgggaggctgaggtggaaggatcacttgaagccagagtttgagaccagcctgtgcaacacagcaagaccccgtctctacaaaaacttaaaaaattagctggctgtggtgttgctcacccatagttccagctactcgggaagctgaggcagtaagatcacttgagcccaggaggccgatgctgcagtgaactgtgattgttccactacagtccagcctgggtgacagagaaaagaaaaagaaaacattacataatttggctagagcataataatttgattttctggtttttgaaaatttgagttgcaataaaaggatatttcagtgtgcgatttcaa

SEQ ID NO: 38277 - DNA, 171599 bp, Homo sapiens
catgacagattataaataatcttaatagcagtattcacgtttgcattctcgcatccgtggcatggagtcctacacacaataggcgccctaagaaagcgtgtttgacttgatcgctggagcatctgccggcaccgcccaggacccgcccaggacccgccccgccccctgcggccccgccccccgcatgctgaatgccatataggcgagtgacgtcaggccgtttgttgtcattggcggctcccaagatggcgtccatcatggaagggccgctgagcaaatggactaacgtgatgaagggctggcagtaccgttggttcgtgctggactacaatgcaggactgctctcctactacacggtgagtccttggagggcacagctccaggcgcctcggggccgcgtttcctgggtggaggtgggggaccggggttttaggtggctgagttgaggttgctagtctgggggtgccgccgtacgcgagggttcccttgttggggagggttttacgtctcggatagccaatgagggtgagggagagaggggcgcagccaataaatagaaactagctgtctgatttatgggttgggggtgagccaagtttctttcttagggtccgctattaagcggtagtggggtccagcatggttgtgagcgggtaagggtgatcgtagtcatggcttaaaaggtccagtcttgcggttcatgctgtcttcatatgttgtcatggactttacactgtcccaccaaggccctgtagccggccgcaccccttagcttccctccagggattgaagagctctgcttcctcggaggagtggccagaggagccgggacaggtccaaaagtgaccagccctcgggcaacaccagggggtccgaaatccctccagtcggttcaggttgtgtgtctcattcaagggacgcacccctctatttagcgggaggcgagctcaaacgacgccttaacttttgagagccaaggatttcctacacgcgagactcttgtcagcgaagagagacaagtgatagtgcagtgtccccttacagttacattctgggttcagggcttcactgttgttaacatgagttggtggccgtggaaaagtagatgaattgctgtgaatcttacgtggttgtgtgtgtgtgtgtgtgtgtgtgtgtggttttttttttgagacggagtctcgccctgttgcccaggctggcgtgcaatggcatcatctcggctcactgcaacttctgcctctcgggttcaagcgattctcctgcctctggcctccctagtagctgggatcacaggcatgcgccaccacaccctgctaattcttgtatttttagtagagacggggtttcaccatgttggccaggctggtcttgaactcctgacctcaggtgatccacccgcctcggcctcccaaagtactgggattacagacgtgagccaccgcgtccggccttgaatcttatgttttgactatcccctccaccctcatcgcattcgatatggagagtaggtggtattagggagataacttacttagaaaggtactttctctgaatggtgtatagttgacgatagccgatatgagggaagaaaatacataagaggacaaaatagaatgcccagaaagctttagaaaataatagaagacagaaagaaaaacatgattatggaagaaggattaaggttgatgagagaaaggggacactgaatttatttgttcatttaaaaaatattattgagctgctatgtgcgttttcatgccagcaagaatagacagtaaaaaagacattcactgttcctcttctctggagcttatatactagcttggtgagtcctttaattcatttcactcctaataactctgcaaggtggttattcattatctccatttaatatccccagttacagttttgaaatctgaggctccaggcttttaaagcaatttgctcaacatcacatagcactaagtgatggaatcaggatgccaaattattgactttttctactaaacttcgctttcactacaggaaggagaaaagtgtaagttgtgagttactaaaggcaagcttgcaagagtaaaagtattactttcatcatccttcaactatcagctttctttctctacatagtttttaaagggaaaaagactaaaccttaatgagtcttaaacacattgttcaagattgtctttaggtgggcatgaaagagaggcaactgaatattatgtcctgaaaactctggaattatgaaacccatggcttagataaaggaaaagtaatattgggtttaagtagatgtgataatcagaaaatcccgtaaactctattcaagatagagtgatttcagtgagtgacactatgcagttaagttactttacaaatcccaaatttgtgtggatctgaatctaggaccatactggagaggcccccagctgaggttcttgggaatgcctagcccagaaagaatcttcctttttcctctttttcttcttttcatgtatcctttttctgctttgttgccctttcagtttttgaatacttggacaaatatctcttttcttgctggctaaatatagggtttaaaaaaatacttttttccccctcaatgcttatccttctttttgagactagattccctaaaatattatccttgccagaggaaggaagtatcatatttctcactaacagctgtttagaagattttttttcttttctagttccttgatattgaagtatttgcttacagagaaacaacagacaattgttgtaccatcttgtgaaaataaaatgatacccaatctcaaattagaggaggtctagtgaagaggggaaaaggatagatatttacttaaaagggaaggtaggagacacattggatattggcaatgaattctacacacatgacattatttcagtccattcggattctgaaggatttgaaggtacatattaatgatttgcatgtggctaataacttggagctacatcttccaggaagaatatctgaattagttgtgtagccttccaagcaaggcagtgaatagcataactttatttcttgtttccaaaatcacttggcctgtagtctgtctctgtggttgttaatatattctagggtggttctgaaaaccctgaactaaactagagtgaccttgctttagagttggctttactgagaattgttcttgaggtaatctcaggattgggttaggatcattgcgatagttgtgaactgaatagatttacacaagcctcaccttagttgaatttttattagatgaaatggccagggagaactaaggatataaatttaggaacactatgtgagcaaccaattgtttatgtggcttatgatcacaaaagaagatatggaaggaaggaaattgggggagttatagatctatgaggaattggaagtttagaaagaggagtttgtgccttttgttaatttatgaaaggttactgagtacctattgtgtgcctggcactttgttaggaagtggggttaaagtggcaaataagatggaaattgttcatcctctcatggtacctataatatgttgggggacataccagataagagctgtgatagaggaagcacagggggatacataggtgggctacttgactcagtcttgaagggttaggaaaggtttccttggagaagcaggtttgttttgacttgaatgatgaggagagattagccgtatgagcagagagggaaaagtgcttgagacaaagggaataaaagttttttggaggagagaagagtaagcagcttgtcagttctggaggttgggctgtgaggtaggtagtagtgagagatgaactggggagctaagcaggaggacagataatgaaaggctttcttggcaaaccatgttaaggaatttgaactttatccccagggcagtggagagctatttcagtgttgtaagcactttttattattattgaaaaatcttttattatagaaatttaaaaaaataaatctattttatttattcatttattttgataagactggttaattttgtatttttggtagagacggggtttcaccatgttgctgaggctggcctcgaacttcagggctcaagcattcacttgcctcggcctcccagaatgttaggattacaggcgtgagcccctgtgcccagcctattatagaaaatttttaacattcataaaactaaagaggacggtaaaatgaattcatttcatccagcttatacaagtatcaacatatggccagtcttgttttattagtactcccattaactccttcctcctctattgaattatttttagagcagatcccagattattatttcttgtgaatatttcagtatgtggccaggcatggtggctcacgcctgtaatcccagcaccttgggaggccgaggcggggagatcacctgaggtcaggaattcaagactagcctggccaacactatctctgctaaaaatacaaaaatttgccctgctgtggccagcgccagtaatcccagctacttgggaggccaagaattcagcctctcccttcaaggagaatcacttgaaccaggaagtggagtttgcagtgagccgagatggtcccactgcactccagcctgggcgacaaagcaagactccgtctcaaaaaaaaaaaaaaaagaaagttaaggtccctctattttcaaaagaatgttatcaaaacacttttattacagctaaatagtagtatttattaatatcaaatatccagtctgttcaatttcctagaatgtcgcaaacatttcttccttaccagttggtttgagtcagaattccaaacaagatctgcatataaaattatagagtctcttttaatctctagttctccctctctttttcttggccatttatttgtctaagacaccaggtcatttactctgtagaattttctgcattttggattttgttggaagcatcattttggtatgtttaaacaggttcctttgtcctctgtatttcctatataaattgataatttgagctgaaagcttaatcaaatttattttttttcttttgggcaagaatataggtggaacctatcaaatcaagaggcatatgatgttagcttgtctctctatgatgttaaaattgatcagtaggttcaggtgaaatgtgtgtttttttttttattttaaagaatatggttgcggagaagtaatcaggaggttgcttttgatgggatttagtgattggatgtgagtgaaaggggaagagtctgaagacatccaggttttcagcttgagctggttgaatgataaaaaggaagataggaagaacaggttgggggagagaagtggttgctttggggcatgttgaaattgacataaagatgtgttacagtctggagcttgggacaaaaatctgggctgcatatcctcttatcagtcagtaaaacataaaataaatctgggctgcagataaatattagtttttcatatatggagagttgagagagtgagtagaatagagatctttggataggactctggaaaataccactggatttagttatctattgcgttatgacagattactccaaaatgtagcaatttaaaacaacagtttgttacctcatagttttcgtgggtcagaactttgagttctggctcagggtctcttatgaagttgtagtcaatatattagccagtgctgcagtcatctgaaaggcttgactggagcaggaagatcagcttccacgatgactcacatggctgttgtcagaaagtggcagttccttgctggctgttggaaggtggcctcattcctcaccaggtagcctctccattgagctgcttaagtgtcatcatgacagagcagctggctgtgatccaagtgagagcaaagaggaagcctcaatcccttttatgacctagtcagagaccaccacttctgccttattctgttcattagagacaagccattaaattccactcatgctcctggggatgggaatttcagacatgaggagggaaattaggctttatcttttgaaaagaatttgtggacaaattttaaaccaccacaatcacaatttaagggattggcagaggaaaaaagcttgcacaggagagtgaaaagggatgccagagatgtaagagaaaaactagaagaatgtggcagtcatggatggcaaggtggaagtagtaaattggcttgaatactgctgaaaggattaaatagatgagatctaaagcatatccattggattgatgaacatcattgatgttcttaggcagagcagtttccatggagtggtaggtatggaatgcaggttggagtggcttgaagagtaaagaggaggcaggaaatatatgaagcgaatggaggttattcaagatgtttcattgtagaaagggcaaagaggacatggaatgtggaatggaggggaacagtttctaaaataggaatatgcttaaatggtgtagggatgggaagcaaggtcaatgttaaaaatgaggatacagtcaggacgcaaggagtatagtaaagatttaggacaatgacagtgggaactggaaaaaggaatagctaaggaatagctaaatatgatttgtttagtcattacccacaaatgtttaaccctctttcttgatttgtattgcttttggagagagggttagaaactgaattagtaagttacctgggctactcaagatattccttgtaaaaggagtcgttagagaaatcatatgttctttgctgttacacactgtctggaagagacttgtaatgactttgcattttaaaaccactgctagtcaaaacacatttaagtgttatttggcagtctttagcaatgtttagtagatgataaaaaaatctaccatctaattattagattttagatttttgaatagcttaaatgtatatatttctcttgcaaacatgtaaaagtagtctcagattctcctggaaaggtatcagcaccactcccatcaaacatttaaaagcaaatttattcttttctaagtaaaccattcttgaatatatcaaatatgatttttattgagcttatatatggtacttttttttttttgtcggagtctcgctctgtcacccaggttggagtgcagtggcacgatctccactcactaccacctccacctcctgggtagaagcaattctcctgtctcagccacccgagtagctgggattaaggcacccaccaccaggcctggctaatttttgtatttttagtagagacgaggtttcaccatgttgaccaggctgatcttgaactcctgacctcagatcatccacctgcctcagcctcccaaagtgctgagattacaggtgtgagccaccttgcctggctatatggtacattttagtagtccaaatctaatagagtagctttagaattataaaaggaacaaaagaaaaattgtatctaaatctaaatgggctgggtgcagtggctcatgcctgtaatcccccagcactttgggagtcgaggcaggtgggtcacttgaggtcaggagttcaagacaagcctgaccaacatggtaaaaccccgtctgtactaaaaatacaaaaattagccgggcatggtggtacacctctgtaatcccagctacttgggaggctgaggcaggagaatcgcttgaacccggaaggcaaaacccgtgagctgagatcacgccactgcactctagcctgggtgacagagtgagactctgtctcaaaaaataaataaataaataaataaaaataaaaataaatccaaacaccctgaaaagacataaagaaactctctaagatagtgagtagtatcagtgggaagaattatttggaaattttttatcttttactttccttgaatactttagacagtcttgatttttcccttttctaaaactcctgagcctagctcatatacttcttttgggcattaatcatcttacatctgctacaattaactaaatgtatctctagtacattctttatctgtacagcaagcttgtaaactccatgatggcagtactgaacatcataataatcttcaagcctgacaatgaggcatattattctccttgtgaatagaatatgaatggcccttctaattcgaattataggtgagtgaggcagaaggctgtttggaattcttgtttacacagccttgtaagttttacagaatatactaatagcaaatatgtatgtttccacagtttatgtaaaacctgattgggtttatattaacaacagaggttttttgtttagtcatccagagcctgtggaactgtgtgccatctttgcttcctgtgttgtagcagacaagcagtcaattcttgcttctgttgcaagcagttttcttgatggtgataatttgtagaaagatgtagagttgttcttaaatatgccactccaaaagtggcaattgtatgattagattttctttttttaaaatgtaatttaatttattttaaactaatctagaccatgccagttggaaggattagattttcaaataggtaatcccgatcaaaactagaacagtgtacaagtgatttagattaaggattgaatttcttttactgtttatagagaaatacagacaaagaaatggccaccccaatcaattgtttccttctcatttatttaattgtaaaggattatcttcttcttctttttttttttttaatggggtactgctctgtcatccaggctggagtgcagtggcatgattttggctcaccgcaacgtccagcaccaagactcaaaatcctcccacctcacctcagcctcctgagtagctgggaccataggcatgcgccaccacactggctaactttttgtatttttggtagagatggggtttcaccatgttggccaggctggtctcaaactcctgagcttaagcaatccaccctcctcggcctcccaaagtgctgtgattataattgtgagccactgcattcagcccaggattattttaaaaatggaatttacttgcagaagttaagtttacatgttacatgggatgatataaatggaattatattcaaggaaagtatttccaggtattcataattaatttttttctattcacatgacaatgttaaaattattgtaaaagttgattgtctatttcttggagttttgttccattgaggccccatgataagattgtctacttatttcttgtattttatcttagtattgttatggcacagctgggtgaaaatacactggataaaaatgtgatctgtcgttctggcagctatcttttgtctctcaatcctcttctttcctccatcactcataggagatgccatgcttaccagagacaatagtccatttggtgggaacactctcaactccttgttctcccacctattttgatatatctattttcctctttatacttgcttttacctttccctatcatagaagaggtaatcctgtgttctggattccatttgctcacaaacttttcggggatctcagtctatagattttctcctctatctgctttctctcctctctctatttaacttcttcctcactacagatttttcttatttaagaatattattattattattatgcagtataacaaacagttgtaatcattttatacagacatttttagatagcctgttgctttttattcttttttttcccccttacaaccagatctcactctgtcacccaggctggagtacagtgtgctatcacagctcactgcagcctcgacctcccaggcttaagcaatcctcctgcctcagtcttctgagtagttgggattgcaggcatgtgccaccacacgagctaatttttgttttgctttttttttttggtagagttagggtcccactgtgttgcccaggctagtcttgaactcctggactcaagtgatactcccgctttggccttccaaagtgctgggattacaagtgtgagccatgacacctggccatctttaattttgatgatgtccagtttatttgttcttctgctgctgcttatgcttttggtgtcgtatctgagaaatcattgcttaatctaaagtcacaaagtttcatatctatgtttacttctaagagttgtttattttagctataatgggtaggtctgatccatttttgttgttggtcatggtttttttgtttgtttattttgagacaaggtctttctctgttgtccatcctggagtgcagtggcacaatcatagcttatagcagcctcaaactcccaggccaagtgatcctaccacctcagcctcctgagtagctgggactacaggcttgtgccaccatgtgggctactttttttatttgtagaggatggggtcttgccatgttgctcacactgttctccagctcctgggctgaaatgatccttctgtctcagcctcccaaagtactgggattatatgtgtgagccactgcacctggctagtttttttttttaatatggaatgaggtaagggtccacctttattcttttgcatgtggatatccagttgtccgagcatcatctgttggaaagacttctttctccattgaattgttttggcattcttgttggcagttaactaaccataaatgtgaagatttgtatttagactgtcagttctattccattgacttatttgtctgtacttacgcctgtactatactgtctcaattactgtagctttgtagtaagttctgaaattgggaaatgtaaatcttctaactttctttgttctttttcaagatagttttggctattctggatcctttgaatttacatatgaattttaggatggactgactttttcattaatgtattaacatgttcatctctcctactttgaaaaatgtctctcctaattctgttttttttttgaaaatatcatcctaacctgtcttcctcaatatacatttgtgtattgaaatgcctgtctctgttagtccatcttgcatttactcgacagcactcttttttacctccacatttcactgaaaattccagcagaggtccccagtgatagctttgttgctaaacccaatgggtgcttttttcgctcttaatcttagcactgtctccatagcatttgatgacactggttactcttttacagctttaaaaattgttttactgttcttgaagagatgacattgtactcttaattatttttctaccactgtactaatgaaggcctactctcaatttttttttttttttggaaaggactattgcagtattactctaaatttttaaaagaagagtcaaactatagtgaaaggtctatacagtagaaggaagaaaagtcacacctgaaatcctacttatctgtgttttggagaatagctttcctaacaactctttatgcacaaatacacatctgtgtactttatataaatggaatcattttatacatgatattctacaacctaaaagcattttaagatttttctgtgtaagttattgtaccattttgtattgtatttcttcaagaggcaaatgaacaaaagataacattttttcttcatctttatttaataagatctcagtcatctggctttgggaagttaaaattcctacgctggcctggtgcagtggctcgtgcctgtaatttcaatacgttgggaggctgaggtgggagaattgcttgaacccgggaggtgaaggttgcagggagctgagattgcgccactgcaccccagcctgggcgacagagcaagactccatctcaaaaaaataaaaaagaaaagagaaaaagaaaaatatctaaattttttattatgactttactatgactttgtgatctgcttcaatttatctttctttttttctttttttttttttttttgagatggagccttgctctgttgcccaggctggagtgcagtggcgtgatctcggcccactgcagcctctgcctgctgggttccagcaattctcctgcctcaggctcctgggtagctgggattacaggtgcgtgccaccatgtccagctaatttttgtatttttagtacagacgtggtttcaccatgttggccaggctggtctcctgacctcaagtgatccaccctcctcggcctcccaaagtgctgggattacaggcctgagctaccatgcccggccttagcttaacactctctattcacttgagcttttcttctgttcctttgaagttcttcaaacttgttcttgcctcagggcctctgaatgttttctgtcttggacaggtctagcatggttgattacttcttatacaggttttcattcatatgtcactgctcagagaagcctttctataacaaaccatctaaagtaggcctctcaccctcagttgctatcataatcatctcgtttgatttttcatggcatatattgttattgctttattttgtttctcttgcttattgtctgtttctgtcttgtatgaatagaatgtaagttccattagaacagagactttatttatcttcatcattttatctccagcatctagagcagtgcctggcacttagtggcttttcagtaaatatagtcatgggtcgcttaacaatggggcaggagtgtggggagatatcttctgagaaatttgttaggtgattttatcattgtgtggatgtcataaagtgggcttacacaaacttagatcatatagtttactacatacctagtccatgtggtaggctgccaccctgtacagtgtgaaactgtatgggcaggccaaagggaaaacttcttggcctttggaggttcgctgaaatgcaactgacaaaaggcagattcataggagaaaaggcatacaaattcactaatgtggctcggtgcagtggctcatgcctgtaatcccagtgctttgagaggctgaggtgggtggatcacctgagatcaggagtttgagaccagcctggccaacgtggtgaaaccctgtctctactaaaaatacaaaaattagctgggtgtggtggtgtgcgcctgtagtcccagctacttgggaggctgaggcaggagaattgcttgaaactgggagttggagattgcagtgagtcaagactgtgccactgcactccagcctgggcgacagagccatattccatctcaaaaaaaaaaaattattaatgtgcatgggggagggggagttatggagtgattaccccaaccccctaatggagtacagtaatttatataccctttttcacaggggacggaggagatggggagtgtagacaattcttttaaagggtactaaatgattactggggggaatgaatgaatcaaggagacagaaaagtccatccaggtgtagttgcatttctcagtcttcttttctgtgatagataatgagatttcagaaaggggatagaagacaattgtggtttttttggtaagatgcttttttggtcagataaggaaatgccagagagtctctcccggcgctgggtcagggagaaacaagacaaggttagagggaccttgatcctaagttttatttctaaggcctttcaattttcaaaagcaccatgcccaagtgccatattttctgggttagtcgttttctgcactacaacattactgtactgaatactgtaggcaattgtaatataatggtaaatatttgtgtatctaaatgtatctaagcatagaaaagatacaataaaaataggtataaaagataaaaaatggtacacctgtatagggcacttaccatgaatgaagcttgcaggactggaagttgttctgatgagtcaaagagtgagtggtgagtgaatgtgaaggccggggacattaccatacactaccatagactttataaacactgtacatttaggtaacgctaaacttacaaaaaaaatttctttcttcaataaattaaccttagcttactgtagtgctttacttgataaacttttaatttttttaaaacacctttaatttttgttttaactttttgactccttcgtattgacacttgggtttaaaacacaagcacattgtacagctgtacaaaagtattttctttctttatatgcttattctataagctcttttctatttataagttttcttattttatgttttttattttaagctttttcttgttaaaaatacaactgcccaatgggttctttctgcccactgcgcaaagaaaatcagtttgtggagaccatggcattacagtaaagaaagtttgacacgaggctggcctcactctgaggttagggatttttcaaagatagtttggtgtgctggggcctacagtatggggagtgctgattggttgggttggagctgtcctcttgtgctgagttgcttctaggtgaggccacaggagcagctggcatgtccatgtgggagccatcagttgtcagacatgcaaaaaacttgaaaagatatctcaaaaaggccaatctggctgggcatggtggtgcatgcctgtaatctcagcgctttgggaagtagcagcaggaggatcattgagcccaggagtttgagaccatcctgggcaacatagtgagaccccatctctacaaaaaactaaaaaaattagccaagcatggtggagtgtacctgtggccccagctacttggaggctgaggcaggaagatcgcttgagcccaacaggtcgagggtacagtgagctatgatcatgccactgcattccagcctaggcaacagagcaagaccctgtctcaaaaagaaaaaaaaaagaccaaccttaggttcttcaatagtgatgttatctgcagaagtaattgtgacgtccagaataatggctgacaatcatttatgtctatgccttagcaggattcaggctcctctaatctcctagcctggtggtctctctcattagatttacaaaggcagttgagttttggggaaggattattatcatttaaactataaatgtctcccaaagttagcttggcttaagcctagaaataattgcagcttgaaagctaaaggcaagggggcattggctagatcaggtctccccaactgccataattttctcactgatagaatttttgcaaaggtggcttcaaaaagtaagatacaaaaacattagcagaggtctacataggctcagtatcatcagtatcactgtcttccacctgtacatcttgtcccactggaaggtctttagggcaataactcacatggagctgtcatctcctatgataacaatgctttcttctggaatccctactgaaggacctacctgaggctgttttacagttaacttttaaatatatctatatatacacgtatatataaatagaaggcatatactctaaaataacaataaaatacagtatagtaaatatataaggtaatgtacttattatcaagtattatgtactgtacataattgtatgtgctatattttatacgtctggcagcacagtaggtttgtttataacagcattgccacaaacatgagtacagcatcattaggcaataagaaattttcagctccattataatcttacaaacagttctgtgaagtaattggtattatttcctttgaacagtgaagacattgaaatttaagaggatcccatagtagtttctatgtgggtgatcaaggtctaacttcaaatagaatgttctttctgggatacactagattaatagtgattagaatgatgataaacctgttatcactagtttgctggcagatgataaataatttacatcattatcacaattaaataaactttctgcagaggcctttgtaaattacagtgatctattataatgctaggttaagcaaagactcttcctcttacctcaatggaaagcctgcgatggggggagaagtggcggggaccagatactaaagtctcagaatttgtgagtgatgggttttttatgtttacatggcataagtatagaaaggcagtggcaaattatcaaagaagatagggtctaccttggaattttatcacctgaaagaggagtaagtttaaatttctgacaggcaacatcctctgtgactagttaaaatgaaagtcattttaactcttctgccttcatttctttttggaaacccatgtattttgaagtaaagttagacttgattaaaaaaaaatgagagtttttaaattgccttttaaaaaatacttttctcttttttttgagaccgagtcttactctgtcctccaggctggatcttggctcactgcaacctccacctcctgggttcaagcaattctcctgcctcagcctcccaggtagctggaattacaggtgttcgccaccacgcctggctaatttttttatatttttagtagagacgtggtttcgccatgttggccaggctggtcttgaactcctgacctcaggcgatccacccgccttggcctcccaaagtgctgggattacaggtgtcagccatctcacctggccacttttatctttattataaaagtaaaataaggccaggtgaggtagctaacacctgtaaacctagcactttggaggccaagacgggaggattgcttgagcccaggtgttcaagaccagcctgggcaatgtagggagacccctgtctctacaaaaaaataaaaaataaaaattatccaggtgtggtgatgcatgcctgtggttccagctactgggtggggatgggggaatgggtgcgaggtagaaggatcaatgagcctgggaagtagaggctgcagtgagctgtgttcctgccagtccactccagcccgggcaacagagcaagaccctgtctcaaaaaataaagtaaataaaataaaataaaataaaataaaataaaatgaaaacagggtcttgcactctgtcacgggggctagagtgcaggggcatgatcatggttcactgcagccacaacctcctgggctcaagcagtcttcttacttaagccttcagagtacctgggaccacaggtgtgaaccaccacaccagctaattttaaaaaaaccattttgtagaaatggggcctcactatgttgcccaggttggtctcaaacttcagggctcaagtgatctttccacctcagcctcccaaagtgctgggattacaggtgtaagccgccttacctggcttggaaataattattaacagtttttcattgcaaacatttttcctgagccccaacctccagatttgaacaaggagcttttggagcatagccccattctaaattggagtctataggatgagacttggaattaggactaagcatctgaaatttcatgggtctagctgttgttcttgctaaccacatttttgtgtgttgcacaaatttttctatcttctatacatttttgtagtgttcttcttgttccctttttataatcttgttattctgggccctctattagtctttgctaaatagggaaaaaggtccttgggcaatttttggtagaggagtgaacttgaatgttaataatggattgtcatttcacagtttggtgggagaagtactgatggtggaggagcataaaacagagtttaacactccctcattatttcctttaatcaactctgtgaataaacacaagtcaatatttagtattttgggtggtatgtgaaaaacaaaacaaaaatagaaaatctgtgtcgaggttgtagggaagttgaaactttccctctgaaggtttgaatccaagtcggctgaaatgagttgacagtcgccagattaacaggagaaaaggtatacaaatttattcacgtgcataagcatgggagccatacaaaatatgagactcaaagaaaggccaactgaagttttataccatgcagaaaggaatagagggttaagggtatcctggggttgtggggaaggggttgctgcagtgtatgagagtgagaggaggaaacatggtgtattagtctgttctcacgccgctgacagagccatacctgagactgggtaatctataaagaaaaagaggtttaatggactctcagttccacatggctggggtggcctcacaatcgtggtagaaggcgaaaagcatgtcttacgctggggcaggcaaagagagaataagaaccaagggaagagggaaaccgctgaaaaccatcatatctcatgagactttttcactaccacaagaaacagtatgggggaaactggccctatgattcaattatctctcaccaggtccctcctacaacatgtgggaattacgggagctacaattcaagatgagatttgggtggagacacaggcaaacatatcccatggccagcaagggctgggccgtcttgttatgcaggagaaatctctcagtagatcattttacctgtgggaaaagtttctctgtcagacttcgaaaagtgtgtcaagagcagagtgtgatgggtcatacctatagtcccagccactggagaggctgagttaggaagatcccttgagcccagaagtttgagttcagcctgggcaacatagatagaccccatctgtattaaaaaaaaaaatgtcagaactttggtctccttttcctgtgaggtaatcttcctagattagataaggcagataaggaggtctcagaaaaaggtgtttgcacctcgctgttactccactaatgtagattacctctgcagatacaagtctcccctaccaaagtacagcttttcagagttattctcgtgtctgcagcccctctgagaatagctatctcaaaatatgccaaagaagtatattttggggtggtatattttgatttccttcaaggtgcagcatatattactaacatgctatcagtagtttgcagaacttgggctactatttagtttttaatatttaactttataagggatgcaaaaaccctaagtcatcatggctgtgcttaattgagctccgtgaaagtggttctctccactcacctgttgtcctgaaattctgacttgaagataaaattatccttttttaaaaacagtgaaaaacctgagactcgacaatgttataggccactagatcaaagtccatatgtccacaatcctctgcctgcaattttgaaatctctacagccctgaattaaaaagatttttccccctaaatttatgatacgctcatttggaagtaaagcctatcttgaactgatgtgtggctatttataatctttatcatgcttagtgtaaatatttgtttgttgtactatagatatattaatatgcttggttgtggaattaatatccttggctaccctagacctcactgcaggtgacacaatttatgtactgtatgtatgtatatgtgtgtgtgtgtgtgtgtgtgtgtatcctttctaaaatcaatccttccttccttcctctctctctcttgttttttttttttttttttttttttttgagacagggtcttgcttcgttatccaggctggagtttagtggcatgatcatagttcactgtagcctcaaactcctaggctcaagtaatccttccacctcagcctccccagtaactaggaatataggcatttgccacctctcctggatgccacttcattctttttttttttttccctttgagacaaagtctggccctattacccaggctggagtgcaatggcatgattcagctcactgcatcctctgactcctaggctgaaaccatcctcccacctcagcctcccaagtagctgggactacaggtgcacactgccacaccaggctcatttttgtattttttgtagagatggggtttcaccatgttgtccaggttggtcttgaacttgtgagcccaagtaatcctcctggctcggcctcccaaaatgctgggattgcaggtatgacccaccacacccaacccaaattgtcttacctttctaaaattgtgaaggctgggcacagtggctcatgcctgtcatcttagcattttgggaggccaaggtgagaggatcacttgaggccaggagttcaaggccagcctgggcaacagagtaacactccatctctactttaaaaataaataaataaataaataaataaaattgtcatttccaaaacacatctgatccaaaggtcttgggataagggatgtggacatgtatttgtaatctagtgacctaggaatttacatgctagagatggttcagaagtcagcattaccgccctctgaggcactgctgagaggctttacagggtgacatactcctctgaattcagaaagatcactgattttacacccagcctttgtggttgagaaaaacctttaaggaagacttaaattaaccaggtttatagtgactgtggtacaaatgtacctttggatccatacctaggttcaaatcctgtttctctcacttgctatctgtgagtctgtggacaagttactccaacctttctgtcactgattcctcagttataaaatgagtataacatgccaggcatgttggctcacgcctgtaatccaccactttgggaggctgaggtgggtggatcacatgaggtcaggagttcaagaacagcctgactaacatggtgaatcaccgtctctactaaaaatacaaaattagccgggcttggtggcgcatgcctttaatcccagctactcaggaggctgaggcaggagaatcagaggctacagtgagccgagatcacaccactgcactccagcctgggcaacaagagtgaaactctgtctcaaaaaaataaataaataaaactaaataaaatgggtatgataaaagaaccaatatcataagatcattgtgagaattaaataaaatagtatttaaagcactagcacagtgtctggcacataagtgctcagtaaatgataacaaaaagctaaagtttatggaggtgtttgacatagtaatattcactaaatgtacacagtggtcaccattatatgaatcagtattccaatttattaattcacaacaagaaatataacttaagaagactctacatttaggctatctaactgatacatttattctctgaatgcaaactctttgggatgccaaattataagcagcatcagaccaaagttatatgttataggtatttagtggcattagatattgacatcaagatgcagtatctccatgttagagacatacctattaccagaatgtaacaggtttaatctttgggtcaaaaaaacttctatccttgccttctgatattagttctggccttctttctctagttctaaaatacttagtataatgatctccaggctgttccatctcttaaagatgatcttgtatatatctctgttttgatatatgtctcttttctttaagggaaggcagccttgttcccaggatcttggagagacccccaaaatcaccattaccttgtttactgatatatttttgtatattgaatcaatagacattaaatctgatgctcaaaatgagaccatctgtaactgacagggaaaggagggaaggatgagatagttatctatgataacttgaaggatgagtgatggggaaaatttctccattattgtgagtctgtgactactcaagagtttttgttggtgtagctttctggaagcataatgacatttggggctattgagtgtcccaaggcagtaactggggaagggtctctagtacattaaatgctatcaggatggctttaggagtccgtgctctcttaaatagaaaggagactacattctgggtgtggtggctcacacctgtaatcccagtactgcttgaggccaggaatttgagaccagcctgagcaacatagtgagactctacctgtataaaaaaaattttttttaaagaaaagaaaggcggggcacggtggctcatacctgtaatcctatcactttgagaggctgaggcaggcagatcccttgagttcaggagttagtgaccagcctgggcaacatggtgaaaccctgtcactacaaaaaatacaaaaatattagctgggtgtggtggtgtgcccctgtagtgagctatgattgcaccactgcactccagcctaggtgacagagtaagactctgtctcataaaaataaaaataaaaatctgaacagatgcagtggctcacacctgtaatcttagcactttgggaggccaagtccagaggattgcttgaggtcaggagttcaagaccagactggccaacatagcaagaatgccttaaaaaaaaaactacaggagtgagtgagagttgctgctatcatttcctattttgtaactgttgtaattagtgtatcttcgtagaattttgtcaagtactatttattaatttacttttattgacgtataattttcttccagtaaaaaacacatattttaagtgtataattagttgagtctttgcatttatttacagccttgtcactaatatcccaatcaaaatatgaagcattgttatcttcctgcaaaattccctcctgtccctttcctgtctgtcccatgccctagaaccagcgtcttgtgattcctgtcttcatgggttagtttgcctgtcaagttttcctcctgtgtgccagtagtagatggtcgaaggtacaacactggctatgtgtgcaacctcatatgcacttggaaatgaactaacatgtctctcaatgtggaaacagtgtttacatttatgcgtaaaggagaggaactgttgtgacatttgtccacgttcattgtccccaggtcttctaccatcaacatgttaaatgttctttgcaaagtacagtgtagcaagggtagcatattgagttggggtggtggggacaaggatgagtcagaaactacctttgggagaagtgatgagacatgcacatacgttattatcatgtaagatagaaataataagtgccttaagaaaagtaatatggcatgctgtatattaataagttcagaaggagacctcacttttagctgtgagagattcatagcaagtcagtgagtttattgcttgatcttcaacacagtgtactttaagcaaagtaaaattaacattcaaataaatttaagtgtcctcatgtaacagattcggggaggcattcctagttgttttttttttttttttttttttttttgagatagggtctcgctctgtggtccaggctggagtgcagtggcgcaatcaggggtcattgcagccttgacctcctgggctcaggcaatcctcctgcctcagccctccagtagctgggactataggcacacaccaccatgtctggctaatttttatttttttttaattttagtaaagaggaagtctcactatgttgcccaggctggtctcaaattcctgagctcaagcaatcctcccacttcagcctcccaaagtgctgggattatggcatgagccaccatacttggccattctttgctttataaaaggattgtagaattaatgtaaatggcaaggaaatcttccttactgaattttaaatatgtttgcacaaaactttttcagacacatttactttgtaaactcatatttatatttccaattaaacaggtttttattgattgcagtatatactggcaccaagctagattttatgagttaatttttaaacttaataagatgtttttagtacttagtatgtgctaggaataaactgaactaatcttctaaaagcttgcagtcctgttggagatacaattaagtagttacaatcaagatataatcaagtagttacttttgtgcttttgatttagtgctttttattagatattattaatctctaattgttttattgtaataatttaaaatacagttgtaaaaatttgattgaagaggactgaaagtttacagaaccggggaaaaggtttcccctgtgttacttgggagtgttgaatagcttgaattgggactgaatgggcatattttgagtgaattatgtttgttggatgagtaagataactgggaaagtggtctgggaccattcattgagcagacatttatctattaataataccttccaggtcccaggcattaattaggttctgaaagatagggtgggaataatagtaatgtaaagataatttttttttttttttgaaacaggctctcactctgatgcccagactggagtgcagtgcattgtaacctctaactcctgggctaacaggatccttccaccgcagccccctgagtacctaggattacaggtgtgtgccaccacacctggctaattaaaaaaaatttttttttttagagatgggttctcactatgttgcccaggctggtctccaactcctggcctgaagtgatccccctgcctcagcctccaaaatgctgaaattacaggtgtgagccactgtgcgttgccatattaaagcagatttaagactgacatttagctaaatagttcttagtatgttcttaaaattactttttcctaaggatttaagaaatggaccaagcaggcagaccgctgtgtgatttgagattattatgagctattctcttgagaatgcaggtcatctcattgttggtcattaccttgctctgactggggcctcttttataagggaattaatcccattcatgagggctctgcccttgtgacctaatcacttcccaaaggcgcacctcctaataccatcatcttaggggttgggatttcaacatatgaactttgtggggatgtaaacattcagtccattacagtatgtattcctataaatacatgtttctcacattaagtaagccatagaaggatattttctagaatagtttgtgaaattaattttggcaagataagttctactttctgatagacttatgtgactctttcagaaatttcttaccctgggaaaataaaaattgtttctgattttattaatttactgatttccagaaggttctttattctatagccagcaaaaagctgcttttggttgcttaaccccatcctagattacttctagcagggccttacaaatgtgttgattatatcaccaactattttgataatgtaacagttggaggttaggatctgtttctcagcttcctgggagcaccgggtcaatgccgagataaatatctgtttagatctacagaataaattgattttcacactgacagtatatcgaagagaatctagatatcctaaggtgtttgctgcctagatctaggcacacagtattgattagaatgtttggaatcagcattccttagatgtttctttacagaaaaagtactgacttttaaaaaaggtaagtgtcaagtggttataaagatggtagctagcgtaaaggccaaatgtttttttttcctttgaggcaggtttaacagacttagtaacacactaaaatctgtgaagtttaatttgtctttgggcagccgattttaattttctgaccaacataatcagaataagaatagaagcttcaaattactggctgttgaggcatagtacataaaattgagggttacgttaatgaaaatttaaatggctagctgtacttacgtgtctccgtcctatcatttattcaatattttttgagtttcctctgtgtaataggtcaatattctcctagaatttaaggctaatagggatgatgaaattaagtaatttcagaattgtttaattacagatttataaagtacttggcaggctcttaattatttatctttgttaattttatcatgaatgcacacaaggtattctggatcagagacatttcataataataaatgtattggcctgcttttgccctagtccttacccctaggatgatgctataaaagccaggtcaattgtcctgcgtgagtagccagacactctgtaggtgggggacaaggaaaaattatttttctctcctatgaaggggaaataggcaactgtccccctcccctcatgaaatggtcacttaggaaaggtaataagcctaaatcctaactccaaccctttggcatatctggagttttatctctttttacatacaaatatctagggagatagctgtaccccttttcttagcaccttggaagcttggcctagggaactgctccaggctgtaacctttcaaacttctctgggaaatgagagagggttttattatccttccagaccagttgaaaacaaaagatctaatccttatggcatgcagaaatgttgccaggaccctagagctttttagaagaacattgagaaatccatggacattttatgtcttagtctgttttctgttgctataacagaataccacagactagataatttataaaggaaagaagtttattttggctcatggttttagcagctggaagagcatagtgtcttcttgctgcttcataacatggtggagggcatcacatggtgagagaggtagagcaagagaggtgagggaaattgcttttacgacaaagtcactccatcaataaagagcacactcctgtgatagtgacattaatccatcaaggaggacagagtcctcattaatctattcatgaggacggagggattaggtttctaacacatgaacttttgggggatacactcaagcccataggattttattttcccacagtattatgggaaaaaaagggttttattatatccttgttagaagtgaagggttggctatctgctctagaggttcaggtaaagcttccctcctcagggaactgagggtaagtaggaattagccagtaaaaagagtgagggtagatgagtaaaggcacttcaggcaatgagaacaatccatgtaaaagtccttaggcaagaaagtgattggctggttcagggaactgaaagatgagtgtgggtggggcccagggatgatggggtattttgaggtaggctggagccaggccaagcagggtctctagagagagcaaattgataaatgtgcattttattttaagtgcaatgtagagccatgaagtacttttttttgcttgcttgcttgttttgttttttaatcgaagaagtaacctgatcagattcatgttttgaaaagactcctggctcctgtgtggagaaaggattggaggagaggaagaagagatagagaagaattagaaggtgatacaggctgggtacggtggctcactcctgtagtctcagcactttgggaggctgaggtgggtagatcgcttgagcccaggcgtttgaggcagcttgggcaacaaggcgaaaccccttctctacaaggaaaaaaaaaattagctgggtgtggtggcacatgcctgtagtcccagctactctggaggctgaggtgggaggatcacttgagcctaggaggcagaggttacagtgagccaaaattgtgccactgcactccagcctgggcaacagagtgagaccttgtctaaaaaaaaaaaaaaaaaaaaaaaaaaaagcaggtgatacaatattgggatgtattgtagagggctggattggggtggttgatggtagagatgaggttaaatgaaaggttttgagagtttgtttttctttttcccttatgacctcatgaaagaagatttgagagcttttatgagacagaaatgaggggactttgattgattggatggaagagagacaggatcacgagttagttttatacatattgagttttgttttgttttgtttttgagacggagtcttgcgctgttgcccaggctggagtgtagtggcgcaatctcggctcactgcaacctctgtctcccaggttcaagcaattctagctgcctcagcctccctagtagctgggattacaggcgtgtgccaccacacccggctaatttttgtacttttagtagagacagggtttcaccatgttggccaggctggtcttgaactcccgacctcatgtgatctgtccgcctcagcctcccaaagtgctgggattatagaggtgagccaccgcgcccagcccatgttgagttttaaatgcctttgagaaagccaggtggagatgtgctgagggagagagtggagaaaatgtgaaatagcccttgccgagaatgggagagcaagtctactgatgaatcatttcctgctcttccctctgcctgggactttgcccgcagattcttcactttactcggtcctctaattcaaatctcagttcttgtatcaactccttgaagagctttttcaagctacttaagttaaaatagaacctcctttcccaacaataactttctgatcatcactgctctaatttaaatgtgtcccccagcattcatgtgttggaaacttaactgcaacactgcaacagtgttgggaagtgggggctaatggaaagtgtttaggcagtccccttgtaaacagatcaacgccatcacaaaaagggctcgctcacttgtactctttgcctttccaccctctgctctgcgataaatagggctctcaccagatgctggtgcttggatcttggaattcccagccccttaaaacttgagaaaataaatttctgttataaattatgcagtctctggtattctgttatagtagcacaagatgcactaagacaatcaccttcctttattttcttaacacttatcaccagctgaaactatcttcttaacttgattttcttaggcaaaatatctactcacatcctttgcccatttttaaattgggttgtctttttattgttgagttgtgcgagttctgtatatattctcgatactatacccctacccagatatatatgatttgcaaatattttctctcattctttggtttgtcttttcactttcttggtagtgttttttgtttgtttggttggttttttttttaagacagggtctcattctgttgcccaggctatggtgcagtggcatgattatagctcatcataacctcaaactcctgggctcaagggatcctcctgccttagtgtgatagtgttctttaaggacaaatgtttttaattttgatgatgcccagtttattaatatttcttttattgcttgtgcttttggtatcatgtaaccattgctgattccaaggtcacaaagatttatacctacgtttttacctaagaacttaatagttttaccctttaaatttaggtcttggatccattttgagttaacttttttttatggcatagggtaggtatccagcttcattcttttacatatggtttaatcatcatttgttggaaagactattccctattggatagtcttggcactcttgtaaaaaaaaatcacttgattatgtatgtatgggtttatttctatacttgcaattctattccattgatcctatgcatatcctaatgtcagtaccacactgtctattattactgtggttttgtgttgcattttggaattgagaagtgtgagtcctccaatgttgttctttttttgaagtttgttctggctattctgggtcccttgcaaaaccactgaattttagcatcagcttatcaatttctacaacagaaaaggggagttaggattttgataggtattatattgaatctgtaaatcaatttagggagtactgccatcttaacaacattaagtctttcaatctaagagcatgaggtatctttctatttatttaggtcttctttaatttccttgtgttgttttgtagttttcagtgtacaagtcttatgcttcttttattaaatttattaataagtattttaccttttgatgctattataaatggaattgttttcttagttatatctccaaattttttaaatctgaaagtatagaaatacaattaatttttgttattgaatttctgtttgaaactttggtgagctcatttattagctctaatagtttgtttttggtgtggattccttaggattttctttgttgttgttgttttttgtttttgagacggagttttgctccattgcccaggctggagtgcagtggcacaatctcggctcactacaacctcctgggttcaagcgattctctagcctcagcctcctgagtagctgggactacaggcgcccaccactcccagctaatttttgtatttttagtagacatggggtttcaccatgttggccaggctggtcttgaacttctgacctcaagtgatccacctgttgcagcctcccaaagtgctgggattacaggtgtgatccattgcacccagccccctaggattttctatatggaaggttatgtcttcttcaaacagaaatactttaaactcttcctttctaatctagatgcctttatttccttttcttgcctgatttctctggctagtacctccagtacagtgttgagcaggagtagcaagataagacatttttgtcttgttcttaggtataaagcttttaatctttcatcattacatatgcggttaccttgggcttttcatagatgccccttattaactcaaagaagttcccttctgtttctagtttgttgagtggtttttatcatgaaatggtgttagatttttttaaaagtacgttttctgtgtcttttgagatgatcatgtgatttttgttctttattttattaatatggtatattatattgattgtttcttatacgttgactcaaccttgtattcttgggataaatcccacttggtcatagtatataatcctttttatatcttgctggattttgttcgctagtattttgttgagaatttgtccatctatattagaaacagatactgttttttacgtacgattttttttctggttttggtattagaataatactagctttatagaaaaaattggaaagtgttcgctcttctatattttggaagagtttgtgaaggtatgtcgttaattctttaaacattttatagaactcaccatctgggcctgcgcttttctttgtgagaagttttttgattactaattcagtctttttacttattttacgtctattcagattttctattttttctttagtcagttttggcagtttatatctttcttggaatttattggtttcatctaatttgttgttccttgtatttccttagaatttttttgtttttgtaagattggtaataatgttttttttctttcattcctgattttagtactttgaatccccttttttttccttggtcagtctagctaatgatttatcaattttgttgattttttaaagaaccaacttttggctaggcacagtggctcgcacctgtagtcccagcactttgggaggctgaggcaggtggattgcttgagctcaggagtagcccgagaaccccttctgagtagaacatatcagttcgatattcccacttcatgggggtaatcctgttttgtcatccagctgaaaagacagtagcattcatttcagagtggtccttttttaaggtaccgggccttgtagctggaggcagagagagtgacagttactgggctgtagaccacatatctatttgtgccaatttgcttgaaaaaggacatttgttagcaggtttcagaacattggtaagataacactcagtaggaagattgctggcgttatgtcagctacctttctttcattaccagaagctactaggattcatcagaaataacctaatatttggtgaatggcattggcttagacagatttgcttcagaccaggaggtagctgaagatcactggcagctgggactttcctccttatctctgtgcttctcttgctgtgtaggcttgctttcttcgcatagaaggcacaggaccagtggcctctgtacctcacagcttcaagagcagataggagggagctcttccctttgccccggttgaaaaacttcctgggagatgactctgtcctgccctgtggggtagtgggtcctgtgattggtcagcttcctttatcagaaaaggctgtgtctggtgaaagcagtcacaccagcttccctatagccccgcattaaagctgagtggagagagggagggagagggccctgtgctattgtgaaagaggataatttgatgctattacagctcagataaggtctgggagaatgatttgccggacaggcatctccaactgtgcaactcagccacattttacatatgtaacactgggtaacttacttgatatccctagtgtcattttcatttttaatataggaataattcttaccatgcaaaggcttgtaaggtttactgtatataaagtgcctgttacataaggggcagcaatgagtgaggatctgctgcttctgctattgttattattaatgttgctattatccctttctccaagtcctcttatttaacggtgttatttttctaaaacacacctttaagaatgctattgccctctttgtaaacctttagtagctccccattaactattgaataaagttaaatttccttaactactccatgttttttttcagacccttcaggatctggtccctgtaatcttcttttcagcctcattttaaaaaatgtttaattttaatttttttgaaacagtcacactgtttcccaggatggagtgcagcagtgccatctctgctcactgcaacctccgcctcccaggttcaagggattctcctacttcagcctcccaagtagctgggattacaggtgtgcaccaccatgcccagctaatttttgtatttttagtagagatagggtttcaccacgttagccaggctggccttgaactcctggcctcactcaagtgatctgcccacctcagtctcccaaagtgttgggattacaagcgtgagccactgttcctggccttcagtcttatctgtaagttcctgtctgcaccctgtgctcttgtctgtacatctactctcctatgaataggaaagtaaagttttctacatctgtgccttcgctgatgttgtttccttgtcttggaatggcctttcccccactaccttccctttctttttatcagatttcttttttctttctttcttttttaaagccccaggttgaaacttgaaacctgatcatttcagttttgcttccttccctgatctttttccttgactgggaggagccttctggagtccacagcacttatttttgctctattacgattgtttacatgttagtcttttttttttttttttttttttacattttgcaagaatctaagccagttgttttgtagaatgtcacacattctggatttgcgtgattatttcctggttgtatttgttttaattattttcagttatctctcttagttttttcttttttgttgttgttgaaaaaagggttttgctctgtcacccaggctagagtgcaggggtgtggtcatggctcactgcagccttgacctccttggctcaagcagtcctcccacctctcagcctcctgagagctgggactataggtgtgtaccaccacacctagctaatattttgtattttttgtagagatagagtttcgccatgttgcccaggccgacctcaaactcctgggcccaagtgaccctcttgccttggactcccaaagtgctggattaggaaattaggaaacgactaggattataattggccctcttaatgttgtttaatttgtaaccctaatagttgtattaccactgggacctgtcttgccttttttctgtttactgtaattttatttaaaaaattgtgttatagtagaagaggatcaaggatgaatatattcttaccttgtttgggttaattttgcattctaacctcatcagggattttcaaatctaattattatttttgtgtatttcctttacacttgaagggaagataagtatagggtacagtaaaagggcgactaaatgcttaaggaatgttttcatcaactgttttctttcactgtgttattagtaaagaactcttttcaactctgcttggtattgagaaatttttttcctaaaatatatgattcctgatatttatagttagaacaaaaagaatactctgtttagtatctcggtaatcacttctgaacatgaattcttacggctcaagactttggatgtagggcatctatagtttcatgtgggataatcatctttaaaacataatcattcaatattggcttgttttgctgctttctcacacaggtggagtacaggaaaataccagttgttcaagtattaagtatttgttcaacttccattatttgagatgttactttgttgtattgcacatgactaatttactcttaggaatatttactgaatgtaaacatagcacttttgcataacataggctttgcttggctcagtttagtaagagacacagaaaggctaagttacatttcatcagtaaatgttttttgagcacctgatgtgtaccagacactgttctgaggcataagtcagatacaattcctaccccctaaggtatgtgtagtcttgtgggtgaagtaaaccagcaattataacacagggtgatgcatgccacaacaggggaacacacagaagactctgggagcccagggtggaaatctaaatcagacagagctaaggtgcttggaatgacaacgaggcagaacatttgggtcaagaaaattccaaactgagggacattggatgagaagtcacagaagcaaaaaatgttacccatttggggaattgcagaggtaaagctaaagcaatacttcttgaggtatggtcttctgtttgcctttgtcataattatctgggggcagctgggtgcggtgactcacgcctgtaatcacagcactttgggaggccgaggtgggtggatcacctgaggtcaggagttcgagaccagcctggccaacatggtgaaaccccgtctctatcaaaaacacaaaaattagccgagcatggtggcgggtgcctgtaatcccagctactctggaggctgaggcaggagaatcgcttgaacccaggaggcggaggttgcagtgagccaagattgagacattgcactccagcctgggcgacaaagcgggactccatctcaaaacaaaacaaaaaaaaataattatctgggagtgattcttaaacctccaggtgattcttagccttctaggtggttctctgactctctaaagtatgagaaacattcgtacttaagggaatgaagaaggaatgaaaataatgatgtaatatatgttacattaaaggtatgtgtaaagttctatgattaggttaatttatatagactgtatgacattttcatttaaaatctgtttattttcctatccataagtaatttctttttggaagagaaattggcagaagggatgggtattactgtaaatcttgtccttttatccccagatgattctaaaaacaatttaccagtctgttaatgttttattcattgaatgctttgtttttcttttagtccaaggacaaaatgatgagaggctctcgcagaggatgtgttagactcagagtgagtatttattcatttttatgaaaatcaattttgacagaagaaaattgtattctgatagaattatggaagtctaaatttagtttagcttccttacataattgttggggcaggtatctaagtctcagagagaaaatgtgatttctccaagtaactgttagtcagtatcagaaccaggactagaactcagttattttggcccatgattcaatgttgtatttatgacttaatgcatgttctgattttcttaaacctctactttacagacaagagacaagggctggaaattaagtgagttatggtgttggtggtatatcaacagtagaaaaaatggaaaaatcccaactgttagctgccgctgctttgtttttcctgttcagcactatttaatcatggtatatatagcagtgctgtccagtagaaatacaatgttagccacatctataatttaagattttctagtaagccacatttcaaaagtaaaaagaaacaggcaaaattaatattttatctaggtcagtatatctgaaatattgttattttaacatgtgattaataaaaaaaaattaagatattttacaatctttctttccatactaactattcaaaatccagtgtgttttttacacaaagggtacatctcaattaggactagctgtacttcagagaaggggatcaatagccacatgtgactagtggctgccttatggtgcagacctatagcttcatgctgctttcagtttccaccattgttcaaataggtaaaggcaagaaagaatgcatggctagggatgcagtttctagtatcccattgtatatgaagaaaagtggcctctatcataactaggttaatcagcttctaggaaccttttcttcaggaccctgttgacttctttcttccacctttttttctgcatccttacttttgaagatgtgaatatatttggtaaacatattattgcccttgttaacagtccttgatagaactgggaaataccgctgagaaagacaccaaattataatagaaaaatcctggcactgagataggagtaggtatgggagatttgcaggatggaaatgagacaggcttgtttcaatcagatggtatatatgtgatagcacaaagatttttaaaaattcaacttctagtttttgtttttttttttctaaaattttcctttggtttctcttttgtctgtttggtgtaattacttttctaagcacttgctgttgacctcagtcaccagtcagtctggtattaactgctcttttggcttgagataagttcagtagtgagactttagcagaactgtcttgacagagcactgcagttgaattccatttggatttaggccactgtctcattgttacagttaatccactggttttgtctgtctttatttttttgtttttgcttttaaatgtagcttaattaattattaacccttctaactaccaccttaagaaatagaattttgtcagctatacctgaagcctctccacgtgccccaattaaataaattacatcccttatatgtctcctaaagtaatcacttcttacatttggttataacttttttacccaaatgtgtatccctaagtcctatagttttcttacctatttgtttaacttgatgtcttttgtttacaatttgtctgttgaagaatctggaccggctgggtgctggagctcacgcctttaatcccaacactgggagaccgagcgaggcagaggatcatttgagcccagtagttcgagaccagcctgggaaacatagtgagatccccatctctacaaaaaatttaaaaaattagctggatgtggtgacacatgcctatagtcccagctacttgagagactgaggcaggaggatcacttgagcccaggaagtcaaggctgtagtgagccataattgtgccactgccttccagcctgggtgacagagtgagaccctgagaccctatctgaaaaaaaagaaaaaaaaaaaaggaatccagaccctttgacctataagaattttccatagtatagattttactgattgcacggtggtgcagttcactacattcctctgtccattgtttttgctgcaaattggcagctggatccagagactggatcagacttaggtttgatccctttggcaagactgtaggtggtggtgtgttcttttagcaggaagaacatagtgtctagtttttgccctttgttgatattagcagctattgatgttcagtacctacacccattaactcactgagggttgcaaaataatgacaggctatcattttgttttaatttttatcagaaataattttataaggagacatttcatctattatttggttacccagtggtgcagttaaaataggcaagatgactgcttgattatttcctattatttaccaaattttaaaggtaatgaattggcttcaaaaacaaccacttatatatgtgtttatatgtatatttccaaaagaattggaaacagggactgaaacagatgcttatatatccatgttcataggatatataacatggatatatagcattatttgcaatattcatagcattatttgcaatattcacagtagccaagaggtggaaaggatccaagtggccatccactgatgaatggataaaaaatgtggtatataaatacagtctattattattattattattattcagtcttataaaggaaggagattctgacacatgctgcaacatagatgaaccttgaggacactagactaagtgaaataagccagttacaaaaagacaaaaagggtatgattccacttatgtgggattcctagagtagccaaaatcagagacagaaagtagaatggtggtttccaggggttgggagtacgggagatggggacttagtgtttaatgagtatggagttttcagtttggaaagatgaaaaagctctggagatggatggtgatgatggtgatcatcacatcatgaacaatgtgaatgtcctttatgccactgaactatacacttagaaatggttgaaataataaatttcatgttagtatgttttaccatacacacaaaaacacccatatatttcacagttttataggtcagacatctctgttgggttttgtgcttaaggtctcgtatgactgaaatcaaggagttggctggactgggcccttatctggaggctctgaagaagagtcctcttccaggctcattcagggcatttgcagaattcaattccttgtgattgtagaactgaagccctgtttgttttttgttttttgttgttgttggctgtcagttgtgttctgctttcagcttctagaggctgcacgtattcttggtcacgtggcctagacccctccatcttcatgtcagcgatgtgcattgaatccttctggtgctctgaatctttctgacttcccattcggctatcagctgcagaaaatgctctgcttttaaaagacctcatgtgatgacatcggattaggtccaccaaataatctcccttttgccatgtaatgtaacataattactcctgcgatatcatattcatggttttcatccatactcaaaggggaggagattatacaggggcaagggtctgtgagagtcattcttaaaattctgcctactacacagcatgacagagaagaaccaaatatacctgtgtttgattcccatttttacccattcctttgttgagtggaaaagggaagctatcataagcttcctgagctttagtttcctcttctttaaggtggagataatactcttcttgcagaattttgtgacgattaggtcctggcacatagatggaacttaataattagaaacatgtatgtgtgtgtttgtccctctgtgtgcacacacgtgcattttactaggctttgtagtattttccaaaaattaaactgccgaggcttttagtcaagaaatatcttgagggtttgtttacaatacagttaccaagtccaccttctagataggctgctttagtgtagtgttctggaacctttatttttaaacagattatccaggtaattatgttgtgtaaccaagagggaccactggtgtagaaacaatcagagagacctggggctgaattttactcagctcttcccttactgactctgacattgggcacatttcttaacttttatgaggataccgtgatataactggtacggttgtaatgaggcttagcaattatgtatgtataggaaacagtaactgctatggatgacaacgatgatgatgatgatgaatatggtagtgatactgcatctagattccaaatgagcttaatgagctatcattgactgcactactgatcttgcccttgccccatccatcccatcctatatttgaatcacactatgtttcttccttttccctcactgtgcttcttcattcctcattgcttctgactttttctttttcttatatcatggaagttctgcaccccctatctgatgagctcatcgcttaagagacttttcaaatgttacctcatctgtgaagcctttctaatccgcatacttctaacaggtttaattctcccctatcctctacatttttttttccttcttcccccactcctgcttctcctccccctcctcgctctccccccaacttttgacaggatcttgctctttacccaggctggagtgcaatggtgcgattatagctcactacatccccaaattcctggcctcaagcaatcctcctgcctcaacctgctgagtagctaggactacaggtgtgcaccaccacacctggctaattaaaattttttttttttttagagacgaggtctcactgtgttgcccaggcagtcttgctaactcagtctcctaactcccgacctcaggcagtcctcctaacccagtctcccaaagcattggaaattacaggcaccagcgaccatgcctggcctatttttttacatttgtaatttagagccatgaaattacttgttacattgtattacatgttaatttttctgttgtctccacttggataataagttcctattcagtgtcacagttgcctggcacataataaatactcaaaaatgcttattgttaattttatgtatttatgaaaataatcagtaaatgttgggaaatttgcctttactatggtttgcatacaaaagaactgtgggagttatttatcttaaacataatgtgagccagtggtatgatgtattttctaaaaagaacaaagcaaaacacccacatgaacatagggtacataaaaggagaatggagaaagggaccatagaggaaacccagatcaggtgctgtgctggatgattttcatacacattcctatcataaccctgtcaggtaaatgctcatatttcattttgcagatgaggagactgagacacaaactactcttagtaacttatcaaggtcacataggaatggtgaatctgagattggacttgggtcttatttcaaagccctgttcaattcttaatgttactaggctcccattcctctggactagaagagtgaattcagatactgtaagtcattataaggtagtgtcaaaccagtggaggaaagcagaaaagtgaaaaaccttctttgtgttggttatgaagtgtgtgccactagacggtgccctttccttgatgaagaaataaaatgttgcttgagtcctgtggtctgatcctctcccatactagtcaaaaacaaaacattggcattttcagataatatctggaaaatggagacatgacaacattaaagaggcagtgtggcccgggcttggtggctcatgcctgtaatcccagcactttgggaggctgattcaggaggatcacttgagtccaggagtttgagaccagcctgggcaacataatgagacctcttctctacaaacaaacaaaaaaaatgaacaaaattggctgggtgtggtggcttacacctctatcccagctacttgggaggctgaggtgggaggatcacttgagtgcaggaggtcgaggctgcagtgagctgagatcatactactgcactccagcctgggtaacagagcaagaccctgtctcaaagaaaaaaaaaaaaaaagtagggtgtagtggcaaaaacaaatacagggcatgtatgtaatgaaattcagacttggattctgccacattctggcgttgtgacttgaggcaacttttcagctctgagccctatttcccatatctctggaatagacatcatgccatttactcatagtgttgtgagtaccagattagttaatacattttgaaaagtactcaaacacggtgtttggagcttaataggatctaaatgaatggtagttttttttttgtaattcataatttctattaatacagatgaatctcagattctgaagaattctaaagggccttaggaatcaccaaagaaaaatgaattatattaaacaaagttttaatggtaaatttattatacatctttgaaaactattaatctacatgtgatttagagtgaccctcttttactccatccagtgaaactaagtattccatttacctgttgtgctaggtatcagaattgaatgtgatttcctgagagatgcattatctattctcttttcttttagtctaccacaagagaggtcggtggtgcaccatgacagaatattaatattttcagtaatgacttctgttagtgccctatttcattgataccatcacttttttttttcacaatgcaataaggtgttatttttaggttaatgtataaccttaagaatgtcttcctttttcccttggatctgtatcctgtaagaacttttatcaattgtcttgttatttcacagtgaaaagtcactctattcattgtggcttttctcgttaattcagtagcctttttgtaagctctttctcttctctatgaatttaatattgaaaatatcctcccttgggcaagatgtaaacatctatttaatctctgtgattggtacatagatgtcattagtgctctattttatgaatgtttatactatttcataattacaaattaaaaattaaatgaaaaagaaagtgatggaagaatatattccaggcaagtgctaaccataagaaagctgggaaacagaattaatatcagacatagaatactaagaaaagaaattaaattgttatggaaaaagagaataccaaagacgcagtatcacatagataacattctttgacaacaatggaaaaaattagaaatcccttgatgaaacagtagccacccacctcacacacatacttctgaataattcattggtggaagtagaaatgataatagaaattgtgaaatatttaagtctgaacgataatgagaaaaccacatgttaaaactgcatctatggaagtctgatttataatcttaaatgaatatattacaagacagattgagaattaatgatctaaacattaaaattttaaaattaggtaaagaaaagaaatagcaaaggaaatagaaagaagaaaataacaaaaagaatacactaatgaaatgggaaataaacagtagagagcataaaccaactgaactgtgattctgtgaaaaaagtaataaaataaaccctggttagattgggaggaaaaaaacgaaggcacaaataaataatattaagaatgaaaaaaagaaaagtacgtaatagtagagatgaaaaattgtcaggaagctactacaaatacattttgccaataaatttgaaagcttatatgaaaatggataatttctcaaaaaagcataaatcaacaaaattaggctgtcaaagaacttgacaaggtgattctaaaagtcatttaaaatttgggaaaggggagagatatttttaaagaataaggagttggtggacttgccactccagatattaagtttttaactgaaactatggtaattaaaatggtatggtggtgttataagagacagaaatagattagcggaatggaagagaaagctgaaaaacagaaccatttggatttgggtcttggagaaagctggaaatttggtatatgatagagcgttacaaatcagacattatcacttagtaaatgaaactggatcaattgggtgtccatatgaaaaaaagaagattactctttaccccatgtgatacacaaaaacaaatttcagatgtataagaggtataaaatgaaattttaaacttagaaaaaaagcataggtgatatctttatgatgtcaagatagagcagaaagcataaaccacaatggcaaatatttgtggatttgacaacattcaaaatttaaaacctttgaacaaaaaaagataccacagtcaaagggaaaagacaactcatggatagaagagaaaatacttaaaatacatcagttggcaaaggattaatattctgtgtatatataaataactcctgcatattaataaagaagacaaaaagaaaatccccccaaatgcatacaaatctgtaaaaaagacaaaagaattctcaaaatgtagaaaagttacatactttcaattcatgtaagggggaataagaaggtaaaatattgaatgcaaaagcaaagcaaattgtttaccactctcttactggcatctaggccagtgcctagaaattcaataaatacttgttgaatcaatgaatgaatgatgctaaagtaggtcctccatgcagcgtcttctttagtgagcaggttgaactgcaagccattctgctcccttctatattattgattctgtcactcctctctagactgtatgttcctccagggcatagacatgttttgtatcccttggctgttactgttcttggcccagaataggtatttaataagtttgttgaagtaattagtgaatattgtttactgtcaccatgtcctgttaagaacaggctttggatcagggtttgcaagacctagtattcttctcccttttagttgttggacttttggcaaacttaaaaaaaattttttttaaacctgagtctcagtttcttaatctctaaagaagagtagtgacctgttctgcctaaatctcagggaccacatttaaatgcactatgtgaatgtaaatagacttccaatgtcatttaagcagtgatgaaaagtatgtggttgtagagttataatgggagtagctatgctgtgtattcttagcactgtctacattccttttaggagcctgtgagcaatctatgtctcagaggagtcatcattcttttttattatctttggaaccagttcaccagcctacttttcgcaaagggagattggccccaaaatagccagaattttgtttctctttttttaccccaagccgtgagagcaaaactatctgtctgtctttggcatcagaatgatgattcatgtctgaagtatgtctgtgtgtatagaaaaaaaacgaaaagagagaaagtcaggaaattcatccagtgggacaagactgtgtagctctagtttctttttggtgccttgatagtgtgaccctggagcaacaggcaccttggtgacctcaagtactgatagaactttaagaagctgaccatctgaaaccttcagaaaaaaatcatgagaggtcactgaaagatgtatatgtttattatgttggcacaatgggggtcataaaagtggagttgaaagaaaaacattgatatttttgtgggttagtataacaaataacttttcttaacaacagaacaccatttcatatatagattatcaaagggagttttgctttaccagatataatcaaaaaaatactctaaacccagataaagggagaggaaggatgtctcaggcagagggaacatgtgcaaaaaatggtggtaggagagaaattggggcaattggtaaaccttaagctatttaagtgtagaatagagaggtaggcatggagcaaatcactaagggccttgtaggctaggctgtggcggagagtgaccacatcccttaaaccagaactgcttgagaatgaaagggggatctattcattattgagccaggacaacaggaataatccaggattgttcctggcaaaccaggtcgtatggtcaccttgtgtgaaggtgaagaagaaccattggtgtggtaacatatcctccaaggaatggaaggttaaaataaattataaactagaggattggacagctgaataatcttgactaaaagggaatgagagaggctggccaattgcttggttaggacatggaattgaaaagggctgttgttaaagagtataaagacttgagtcttgagtatgtgtaaatgcagttgggaaaaagagagagagagacagagaagagaaatagagaccaggaagagagagacagaaattgaaaattggcagggatatggagcatgagtgtggaaggactgggttttcgatagaagaatggatgccttttccattatgataagtggaaaggaagcatgctgggtttagatgcaagtgagtcttcaggtgggagggcacatcaggaaggtttagaatttctacccgatggctgcttttgttgttgggagtcctagccaatgaataaagcaataaaagacatataaggtgtaaggcttggagtagaagtaataagactattattcacagcaacttaatcgagcatatggaaaatccaaaagaatctatagatataactattagaattgagaattgaatctagcaagataagcagatacaaagtcattatataaaaatcaacgaattttttttttttttttttttgagacagagtctcgctctgtcgcccagggtggagtgcagtggcgtgatctcggctcactgtaagctccacctcccaggttcacgccattctcctgcctcagcctcctgagtagctaggactacaggcgcccaccaccaggcctggctaattttttgtatttttagtagagatggggtttcaccgtgttagccaggatggtcttgatcacctgacctcatgatctgcccgccttggcctcccaaagtactgggattacaggcatgagccaccgcacctggccaatcagtgatatttctgtatactaacaactggcaatcagaacatgaatttttttaaatggagaacatttataatagcatcaaaaagcatcaaatttttaggaataaatattaacaaaagatgagtgagacctctactcaggaaatgataaaacattattgaaatttaaaaagacctaaataaatgacagtctatttatttagactggcaaatcccagtttatttctagtcatttgagtcattatgctggcaagtgtgtgtgtgtgtgtgtgtgtgtgtgtgtaaaacgtgtgtagctgactaaaaatttatgaagagtcaagagtatccattcctgattcctgccttctcagccaacatacagaacccagtagaaatggtgatttgctttcctctgcccctttggggatggctggctatgactatgttcaagatgtttatttattaaaaaactttttttaaattggaggatttactccacctgatatccaaatgtaaagccttccagaagataatgtaggagaatattttcatggccttgggactgggaaagacttcttaaaggagacatagaaagcagaactataaaatgtaaagtcaatacactgtcctacattaaagttaagaattcttcatcaaaagatatcattatgtgagtgcaaaagcaggcaacagagtagaagtagatacttgcttaatttataaccattgaagggctcatacccatgatatagaaagaactcctacaagtcattagaaaaagatagtccagtcttgtcaatggagaagaaacttaaactatttcacaaaagaggatcttcaaatggtcagaaaccatgaaaacatacttaaccttgtcagttattagggaagtggaagttaaaaccatgatgagatgtcactacttacctgccaagaataactaaggtgaaaaactgttagtgaagttattggaacagttgaaactgtcgtataccactgatgggagtatagctgacacaaccacttttgaggacgatttgatagtatctcctaaacctgatatatgcatatcctgtgacctagcaaatttactttcctagatttgtatttaatataaatacatgtataacaaaagatatgaataagaatattcataggagctttattctaataacgtaaaactgaaaacaacataaatgtccatgcacaatggaattgataattgtgggtctatacagaggaatgatatatatagcaataaaagtgaacaaactactgcttcatgcaacaatatggatgaatcttacaaacatggtgcatgaaagaagccagacacaaaggaaaataagtggtgtgagtccatttgtatacaattcaaagacagggccaggcatgatgactcctgcctgtaatcccagcactttgagaggctgggatgggtggatcacttgaggccaggagtttgagaccagcttggccaacatggtgaaccctgtctctacaaaaaatataaaaattagccgggcgtgtggtgatgcatgcctgtaatcccagttactcaagaggctgaggcacaaatatcacttgagcctcagaagcagaggttgcagtgagctgagatcatgccactgcagtccaaccttggcaacagagtaagactctgtttcaaaaataaataaataaataaataagttcaaagacagactaaactaattgttatattagaactaaggatagtatttatctttggaatggagggttgggttaatgattaggaagtgttacaaggggagcttttctgttcattgagctgtacacttgtgatttgtatatatgttacatttcaatgtagtgttattttcagatgagatagtatatgtaaaatgcttagcataatgcctcactcatgaaaatgagttcagttcaatagctggcagcattaactatttactgtggtttagtgctctgtgatgataagattcacggcagtgttatccaacagacctttctgcagtgattaaaatgttctgtatttgtgctgttcagtttcatagtcattagccacaagtggctgttgaacatttgaagtatgactagtgtgactaagggacttactttatttatttatttagtttttgagacagagtttcgctcttgtttcccaggctggagtgcaatggggcagtcttggttcacggcaacctccagctcccggcttcaagtgattctcctgcctcagcctcccgagtagctgggattacaggcttgcaccaccatgcctggctaattttgtatttttagtagagacggggtttctccatgttggtcagactggtcttgaactcccgacctcaggtgatctgccagccttggcctcccaaagtggtgggattacaggcatgagccactgcgcccggcctgagggacttattttaaatttttacttaactttaattagaacttaaatacccaatatgtggctaatggctattgtattggacagtgtggatgtagggtttttgtcataggaaatgaaggactgaaggagaatagcaatgtagttcatttgagtaattcaacaaatcaagacactgagagaccagagcatcagatcaattgtgcatatatacactgaagaatgctcaggatcatgacaagacctgattggagtaggagactgttagctaggttcgagtcttcaaagaagccttcgattagagaggggaaagtgcaaaggtccagaaagtaatgtttttttccatatagactatctaaagtacgcagcgagaaatgtttctgcagcagcaacaggtgctccagagaaatgttttgtgtatatatatatatttttttagagtctcgctctgtcacccaggctggagtgcagtggtgcgatcttggctcacagcaatctctgccttgaagtgattctcctgcctcggcctcctgagtagctgggattacaggcatgcgccaccatgcctggctaatttttgtatttttagtagagacagggtttcaacatgttgaccaggctggtctcaaacccctgacctcaggtgatccgcccgcctcggcctcccaaagggctaggattacaggtgtgagccgccgcacccggcctccggagaagttctgtacaacaaaactaaagtagtaatgtggtcattggagatctgtgagagagaagtttggtgccgtgagaggaaggaagccagcttgcaagagtggatggaaggttaaggtacagccaattttcaaaaagctcctctctgaaagcaatgtgaggagatgtggtagctagagggagatgtgggattttgcttttgtttaacaaatggtgagaaatagagcttgaagaatgaccttaaaaagtgaaattgcttggtgtttttaaaaatttaaaatattaaaataattattttaaaaatttaagatcctcagtcatactagtcatatttcaaatgttcagtagccacttgttgctagtgactattaaactgaacagtacaaatacagaacattttaatcactgcagaaagttctgttggataacactgccgtcaatcttgtcatcacagagcactaaaccacagtgactagttaatgctgccagctattgcactgaactcattttcatgagtgaggtatgtggaagaaatgtggaagctgaattcatatggggtgtctgtgaggtggggcagaaggaagctgggtgacgatagtggaaatgttggttgggccagattttgaacagccttgaatgacattatgaagtaatgctgactttatctgttagttcatagagagccaaggaaggttttaaacatgtgagtctctaataagagtctgtgcttcagaaatattactccggcaatagcaaggactgtgaactaactgtaaagtgtccagactgaaggcaggcagattgttaccaaacaagaaacgatgaaagcctgaattacagaagtagcagagaggatggagacaagttggtgaacttaatagttgagaggtagaatgagcacagcctgtggtaatggaacaaggggtagttgtacagacctggaggtttctaccagagttgactaggtgacttgttgagcttacatttgggttcttaattaaggaactcaagagaaagagcaggcatttgagagtggagtgagttgcaatagctttgttgagatataatacatatactatgcaatttatcaacttggagtatccaatttatgtttttagtatattcacagagttgttcaaccatcatcatagtcaattttagaatgttttcatcaccttgtaaagaaatctagtatacccattagcagccattccccatttcaccccaaccctcccagcactagacaaccactaatctactgtcagtctatgaatttacctattctggacattttttgtaagtagaatcatgtaacatgtgatccttagtgactagcttctttcacttagcatactgttttcaaggttcatccagagagagataacttttcgccctgtattatagtcacctctttgcatgttttatctcctgtactggatataagtgccttgaaggcagggcatatattccagagctgtatattgcatatattttggtatttagttatggctcaggaaatatttgatacatcacaagttagaaggttaactcagttaatcacaaattacattaaccagaatgagctgtttctgcacgtgcttacccactgaagtgtgtctgtatttgctgtcgtggaatagctaggttccatgccaatggtgatctggtactggttctgctgttaaggctttgtgtgaccttgggcaagtcattatactctctggagacactttccctatttgaaaatggagataaaatttcctaccccatctgacactgaggaataagtaaagtaattcaagtaggtggaatttggatagagttggggttcatccagatagcctctggggaagaaatgaataaatgtttgatcctattccctaatattcctggtataggagtagtccccctatgtagccttttttcatgggattaggtattttgtccccttgagtcatttcaactcccttgtcaaggtctctggttttatcaagggcacacggcttctcttatcacctgaggcatttgacctattctgtgttctgtagtctttctctctggaatacttaagatacttttttcttaaggacattgaacaatagattccctattttgcttagtttcctgtctcttatcttaattcctgttgtcttcacagaatgcatgtagttgaatattaagaaaagggggccaggtgtggtggcgcactcctgtaatcccagcactttgggagactgaggcaggcagatcacttgaggtcagaagttcgagaccagcctggccaacaaggtgaaaccctgtctgtactaaaaatacaaaagttagccgggtgtggtggcacacgcttgtaatcccagctacttgggaggctgaggcaggagaatcacttgaacctgggaggtggaggttgcagtgagccgagatcgtgccactgcactccagcctgggtgacagcctaggcaacagggtgagactctgtctcaaaaaatagtaataaaaaagtattttttaaaagggttaaaacctacccagtccgccttcccaaaacaacttgtaaattcagttccccattgtgtgtgcctgcccaccccccagtttggagagttgtttgtgctcttatttagaaacatatactaagtatgtacttaagtgccatgtatcaaataaaatagtccttgatttctaagatttcatagtggttctgtaggaagatgctgacatatgaacagataatcacagtatactgtgaaaagtgctcttggagggcaatgtacaagtggttatggaagcacttggaagaaggggttgggacagtgttttgaagcaaatgtcacctggcatttctacactaacaagtatatactatcacagaagcagcctgctgaagagcacctgccttctttcagccttacaacaacctggtgaggtgtaggtttttgactcccattttagagagcattctgaagttcagaaaggctcagtggctggctcttaaaacacagatcctagattcagcttctgtgtttgtcccttccgcctcccagcacatctatgcccttaaggaaggcatagaatgtacctgtacatggtactagagtgtcctgccagctcctctcctttagttctttctccttaagcaaaactagagtctcagtttcctcttttctgtgtctagcctgcttccagtgtcgttggtgcattgagtattccagggctatagcagtagtgaatattgctgatgtcattgtttgccttattgggattttgctctttgtttcacagggagctgtgattggtatagacgatgaggacgacagcaccttcacaataactgttgatcagaaaaccttccatttccagggtgagctgaaagaagagattctttctcttcatagtcccatctgcttcttttcttctcttttgggttgtttgctggatgacttgaatggttttgcaactgatcctgcatgaacgagtgcataggaacattctggatgaagtggtactgcaggttaggcagggatttgtatctgcaatggatgtagatcgatttgaaacgactgtggatctggctgcagttggagatgaaaattttaaaggataaaaatcagtgaagggagagagtaatgggctgctgctgctgctggcttgtgtttacagaaggttgctgatcttctttatcaaggagtatggttctgcttctgcatgaagagtctaaagactgattgtgaaggttgcagtgtttgtctgtgtaaaactcaaaatataaattaaattgaagcttagtggcaacctttggcttaaaggttttgctctgcttcaagaactacaagtttgcattcatttcatctgtatttctgtgttttgtttgccagccatcatttctctgctattatcctttttatagttaaatgccatctgccactgctatgtttcggcattgcatgctatggttcaccggtagaaagggtaaggtactgtatgatcattctcatttcattttgctttgaaaactctaaaccagcaaataaaagtcaattttaatgatcttgtcctaagtacctcttgtctattaggagtgactgttagttttagtattaatggttttgttattttgcctttccagagtaatctctcttttatgtttcgagcagttcaagaaacttagaaatgaaaagatttggagaggttagcactttctctcaactacaagtaacagtgcactgttagagatgctaggtatgccaagataaataaatattaaatacatttattgcttaaaaatgttttggttatgaagtctaacagaggccagatatgttatatgaggtgtttaggcagctgttgtctttttgtgctaggatagtgaattgcagttatttttcttcattgtcttctttcagaaattgacagatagtaatgaaagatgcaggttatattcaacaaacctaaaccagtgtactcaatagtgatatctctaatgctttcttccacataaccttaaaatatttactgtgtttgatgatataatttattcagagctgctttaataacgatgctgtcctgaaattttctactatatttaacttcataaaacattttaaatcctattatgaaagcccagagtttttatttttaagttaaatatgtaatgctgcctataaatcagcaggtaattcctacactctggaactctttacttgaatgaagttgaatattttaatgcatttcaagaaagagctgctgggtgcaggtaaggctgcagtatggaattctcttctctgcagttactaagaaggagacacctcctttggaccctcagaagctgtacctctaccttctgatttacttttaaattatttatgtcccctttggcactctcatacttatttggcttataaaacaagaaatattcctcaggaaggatttaaatgataagagttatgcacattttaaaaatggattcatagttctgaaactgtcagaataattagtttattttctattgtagtagttatgggagttttagcatgagatctggattttgcaaagaacttggtaagactgtatttttttttcgttaatgagagctatttcacattcataggtccttgatcataaaatccctgcaaatttgatacaaagttatcagtgtctgagagatcttaaattcttgattagaattgaaagcaaattttagctatatatgtgaacatatctttaaatgtgctgaagtttttattgaatacaccagtttttttttaagcaaatgaaatatcagttgatgcattataaaacaaattctactgtcaactattaaagggaaagctagagtttgttcagatacattcatttattcattcaacatctattttagacattattctggggatacagtggtatacaaaacagataaaattccttgccccttgagtcatccattccaggaaaggagaaaggtaatcaacacgatcaacatgataagttagtaaaatataagtaaatgagagtgataagtcctggggagaaaaaaataaaatacgaaaggagaaaatgaaatagaggtgaggttgcagggagaggggaagtgttgaaattttaaatagggtagctagggaaagactcactgagatggtgcctttttagtgaagagctgaagaaagtcagggaacaaagtatatggctatgttggtgggggaggtggggtgaatacatcatttctttgcctggaatgacgtacccaccctgccttcctccccaacacagtcatatactttgttttgtttttctttttgtagtttatactcatatatttgaagaacagctagaggtcagctctggctggagtgcagataaccatgggtggagagtaatggagaatgaaatctgagaggacacaggaagtccaaccatatgaggcctttataagggcattgaatttgactgagataaaaggccattagaaggttttgagcagaggagtgacatggtgtgatttatgttttaacaggatgactctggccactgtgttgggagtaaaattcagaggggcaaggacagaagtagggaaactatttctgcagtaagaggctgttgtaaaccagaagagaggtggtagtggctcccacatggtagcagtggagatggggagatagtgagaagtggtcgaattgtgtgcatgtttaatcacctttattgaggtgtaattaacatacaataaaatgtacacaatatacagttaggcattttaatcagtttatttactcatgactaccaccacaatcaagatatagattccatcactccaaaagattcctttatgctcctgtcagtcagtccccagccccagcccccggccccaggcaactacttttctgctttctatcattgtagaatagatgttttgttaggagaatttcacataaatggaatcataccatatgtactctcttttctggctttattttagctcagcataatgtttttaagattcatctatgttgttgtatatattaatagttccttttatattgctaagtaatacttcattgtatgacagtatatttattctgaaggttgagctgtaacatatgacagaaagacaagtctaggttgagtaacaagaatggagttgccattaactgaagtggaagattgcaggaggaactagttttgggagggtgagggaaatgtgggcatcagagcttagctttggacatgtttactaaacaagttttaaatgtccaccaaataggcaaatggagatgtcaagtaggcagttggagttcagtggaaaagtttggtctgcagaaatagagttgggagtcattggcacatagatggtattgaaagccacaagaatttgggaataaatgttgagagaaaagaggtccaactacagagccctggggcactcaaacatttattgagagggcgcaagatgaggtaaaaccagcaaaagagattgagaagaagcaaccaaaaaggaggaggaaaaccaaatgaatgtggtactttggaagccacaagaaaaggtgtttctaggaggagagaaggatcagcaactatgtcaaatgctactgacagatcaaataagatgaggattgagaaatgattacaggatttaatactgagaagtttattggtaaccttgagaagagtgattttaagataggagtggagacagtgcattcaagttttgatgtaaagggaagatgagaaatatagcagtaaccggaaggggaaatgggagcaagggagcttttgttttgtttttgtaggataagagaaataatagcatttctatgttgttggcagtgattcagtaaacagggaagaattgatgatgcaagagagaaaggagagagttgctggatcagtgtcctggagaaagcaagagagaatgggatctaacacacaggtgggagcagtgtctttggcttggagcatgggcagtttattcatagtgttataacatagctgtggttgttgatgagaccttaaatagattaaagcagtgataatagggaggaaaatggactagatttgagattttaaaaaatctataggaactggggcacagtggtatgcacctgtagtcctagctattcaggaggctgaggccagaggaccacttgagcccaggagtttaagactgtagtgttctatgatcacacctggtgcatagccactgcactccagcctgggcaatatagtgatgccctgtctctaaaaaagttttttttttttttttaatctgtaggaactggtaattgctcagaaatgggaggtgagagaatttgggtactaagggtgatgctcttggcttggcttactgttggatgttgtcaactccttccttccttccttccttcctctccctctctctttctttcctttgttttcttcttcttctttttttttttttttcagggccttgctctgtcacccaggctggagtgtagtggcatgatcatggctcactgcagcctcgacttgctggactcaagtgatcctcccaccttagcctcccaggtagctggaactactaaaaaaattagcctgcaccaccatggctgactaattttttttttaataaaaaatttttattgtaatagttattttttgagttaaaatttatatgtgtgtatgtttaatcaactttattgaggtataactcactatgttgccagggctggtcttgaattcctgggcccaagcaatcctcctgccttagcctcccaaattactgggatttcaggtgttagccattgtgcctcactgtcagcatctgaaatagagaatataggagagcagaggtagtggtgagggacctcttatgtttaaggtgtctgtgggacacatagatgatggtaattggatctgagtctgggctggaaatggagatttgtgatcgtcagcatactgctggtaggtagaactagaagttgaaaatatgaatgcctaacggctaggcagataagtacagtcaagtgctgcataaggacatttaggtcaacgatggaccacatatatgatggtggttctataagattataataccatatttttactgtactttttctatgtttagatacacaaatacttaccattgtgttgtagttgccctcagtattgagtccagtaacatactctatagcagggcatcaaatcttttgccttccctgggccacattggaagaagaattgtcttgggtcacacataaaatacactaacgatagctgatgagctaaaaaagaaaattacaaaaaaacctcataatgttttaagaaagtttatgtatttgtattgggctgcattcaaagccatcctgtgctacatgcagcctgtgggcagcagattggacaagcttgcaggtttatagcctaggaatgatagccaaaccctatagcctaggtgtgtagtaggctttaccatctaggttcatgtactgatgttggcacagtgatgaaattgcctaatgatgcatttctcacgacacatctctcagaacagattccagtcattaagcagtgcataactgtaaatgagtgaagagtatggctgtgtaaagactagcaagttggagaggtcacaccctgtgtaaagggatagctgccacttagttccagacagttgtaggcttggaatgtttgcccattgttgtcagatcatccttttttttccaagagaagccagaaattaattaattaattaatttatttatttatttattttttgtgaatggggttgagtgtgtgtgtgtgtgtgtgaactctccagttttaggaacaattttttatgtagaccgaataaaatgcatctatgggctagataaaacctttggatttttagtctttgattaaagccatggtagtcttgagtgttatccttctggaagatcagagtgagaagagagctgatgattaaaccttggatcatactagggtggaactgctaacaggctcagaggaatgatcagagagtttaggatgaaagctgttagcttcaaccacatgaaattactgtttttaataggtgaaaagtagttgcacattagctgttcatatggctcaatctaatagaagactagttcttactaataattcgaaaaaaactaattatttgaattttaccttcaaataaaattttatctgtttaatgatttaatatcattcataatgttactgacaatatattgggataataataataatggttaacatttattgaatgtttattttatgagttttaactgaatagtgcctaccataaaataaacattttaactcatgcagttttcacaaccttatgaagtaggtactgttatactattagtgtttttattttattgattagaaaactgggagccacagacacatagctaatataagacagaactgaaatttgaacacaaacaattgtaccctagagccattttcctcttcattgttataaaatatattgtagagatttgtcaactagtttataattaacatttatcagaaaaggaattaagaggccgggcactttgggagaccgaggtggtgggtggatcacttcagaccaggagtttgagaccagcctggccaatatggtgaaaccccgtctctactacaaatacaaaaaattagccagggatggtggtgcgtgctgtagtcgcagctactcaggaggctaaggctggagaattgcttgaactcgggagtcggaagttgtagtgagccgagatcccaccattgcacccccgcctggacaacacagtgagatgccttctcaaaaaaaaacggaattaatataaaataagaaactttaaattacagtgcagtttaatgcaattaaaaaatttgacgctaattagccgggagtggtggtgatgtgcctgtaatcccagctacttgggaggctgaggtgggaggatgacttgaactcaggaggcaaagatttcagtgagccgagatcgcgccactgcactccagcctggccgacagagcaagactccatctaaaaaaaaaaaaaaaaaaaaaattgacaatgactgcaaaaatgataattatgtaaagtgacacatttgttaattggctagttcaaaccattccacaatgtatgtatacttcaaaatatgttgtacatgataaatacaattttaaaaaatgacaaaaaaacccaattgggcattgttaatgttctacatgttccattacttcgtagaaatattagtggcggtgttggtgtttgtggtagtggtaaaaactactattgctactaccaaatatctgttatgaaccaggcactgtataacaggcactgtacattacttacataattcctaaattccacagcctgtgagatagctttatgtctagttttagagttagagtaactgagtttcagagaagctaagtggcagagccaagattcgtgcacatgttggtctacatcagggattcttaaagtgtggttctcgaatagagggtcagcatcacctgggaacttgttagaaatgcagattcttgcgctctgcccctcacttgctgaatcagaaactttgggaatgggcccgctctagtgattctgatgcactcttaagtttgagaaccacaggtctggatccaatggttaaacatgttattccaatttactctcataacaaccacttacacataagaaggaattgtcctcaatttgtagataaagagaagtgagacacagagttaagtgacttgcccttgattttggattgtctgtatgtcctaacctatatattaggcatgtcttgccttaagcaaatctgatgtgtgaaaaatcaaataaaattttaaagataaaaattaagggtatgtatgtgattagttttccataaaataatccttcattttcaaaggactttacggaaaacttttttttttttttgagacggagtctcgcccaggcttgtcgcccaggctggagtgcagtggcacaacaacagctcactgtaacctccgcctaccgggttcaagcagttccctgcctcagcctcccaagtagctgggattagaggcatccaccaccactctcggctaatttttgtatttttggtagagacggggtttcaccatattgtccaggctggtcttgaactctggaccttgtgatccacccgcctcggcctcccaaagtgctgggattacagatgtgagccactgtgcctggctacagagaacattttttaagcagtgtgttctcaaaaataatttcagctgggcacagcggctcacacccgtaatcccagctctttgggaggctgaggtgggaggatggcttgaggccaagacttagagaccagcctaggcaatatagtgaggtcctgtctctacaaaaaaaaaaaatgaaaaaactcccctgagcatggtggcgtgtgtgcctgtagtcccagctactctgaaagctgaggcagatgagtcccttgagtttgggagtttaaggctgcagtgagctaggatcacaccactgcacttcagcctgggtgacacagtgagaccctgcctcaaaaaaataaaaatacgttttagtatgaaattggtttacaaatttatttgaatatactttcaaagcaatacaagttgcctaagacaaaagacataatttttaagcattaaaaaatgtaatgtaagtcttagtagaagttatctatggttggtttcacctcagttcattagagcttgcttatttattaaaatgcagtggccgggtgcagtggctcatgcctgtaatttcagcactttgggaggccaaggcgggcggatcatctgaggtcaggagtttgagaccagcctggccaacatggggaaaccccgtctctactaaaaatgcaaaaataggccgggcatggtgacgcatgcctgtaatcccagctactcggtaggctgaggcgggagaatcgtttgaacctgggaggcagaggttgcagtgagccgagatcatgccactgcactccagcctgggcgacagagcaagactctgtctccaaaaataaataaataaataaatgcagaattactacaaataaaccagttgttgatgttatggtgaaggaaagtgtttaattcagagaagttatattgatcaagtatattatggcaacatcagtgctactgcattaacatcaatcaatttagcaaggcatatctgcatcattaatcatttagtaaattataagactaaaccatggttgcaggcttaaagatcttctgctatctcaacactatcactagtaaacagaggccattatcagtaggactgttgactttaaaaaatttccctctgttgtttcatatttttgattttcatgtgataattattctccaaaatgaaaccaaataataagatatttccacactttatgtaagggaaataaatcagttataactaattttctaattagattttatcatttcaataggtgttagtagggaaatctactgaattcgtgtattgggagtttgttgtattattgaggagggtcggacttcactgatgtacttttcttcttctttatttgctttctgtacaagatcctccctaaatatttgaaattataatctttccaggtttaactaattagggactgtttggcttaatagctagcaaggttagagaggatagttttattttttgttaataattttattccaacatcctgttttccataatttctaagtagtaaaattaatacttgctcactttagaaatttgggaaaagtataaagtagtataaagatgatactaataatcattcataatcctaccacttgaagataattgttagtaacatggttgtgtatttccttctgatccttcagttgtttacagtaatcccctcttacctgaggtttcactttacacagtttcagttacctgtggtcagctgtggtctgaacatattcaatagaaaactccagaaataaacaattgataagttttaaattgcacactcttctgctccatcccacttgggtgtgaatcatccttttgtcccatgtatctatggtgatgatggtacctgcccattagtcacttactaagtaggcttctgggtatcagatttactgttgcagtgtactgcaatgtttgtgttcaagtagcccttattttatttaataatggtgccagagctctagagtagtgatgctggcatattgttataattgttctattttattattagttgttaatcttactgtgccttatttataagttaaactttattataggcaagtatgtaataggaaaaaatatatagtatatatagggttcaatactatccacagtttcaggcatccacagggggtcttcctatgataaagggggactattctgtatgtgtatgaatgtgtgcgtgttataaaattgagtcattctgccagcctggccaacatggcgaaaccccctctccactaaaaatacaaaaattagccatgtgtcgtggcttgcgactgtagtaccacctcctcgggaggctgaggctggtagaaccacttgaacccgggaggcagaggttgcagtgagccaagatcttgtcactgcactccagcctgggcaacagagtgagagaccatcttaaaaaaaaaaaattttgagtcattctgtataaataggttatccagattttcagttctaagtattatgtcatgatcctttccccatgacactgaatgttctaagaaaacatgatttttggctaggggtgatagctcacgcctgtaatcccagcactttgcaaggccaaggcggggtagatcacttgatcccaggagtttgagaccagcctagccaacatggtgaaaccctgtctctactaaaaaaaaagaaaaaaaaatttagctgacgtggtggtacgtgcctgtagtcccagctactagggaggttgaggtgggagaatcacttgaactcggggggcggaggttgcagtgagctgagattgcactgctgcactccagcctgggtgacagagtgagaccctgtctcaaaaaaaacaaaaaaaaaccatgatttgtaaaagttgcataatatttcattttataaataatatatttagccactcatctgtattgtacacatttttctccattttctccatttggttaatctttaaccaaatctctggttaactaaggatacttagattcataaaagaatttgtcagaactaaaagcataaatatttttaatatttctgaaacagtcttgcccaattgcgtttactcttctgttttcatcacacccctcatcagcacttagtattataattttaaaggcatgccaactcaatgtcactgcaaaaatatattttgatgtgtttgtttacttgtttactcctttgaccatttttttgttgttgttcatctttttttatatcctccttttttgaaagtaaaaggaaacagacttattcattaacgctatttattatttcagaaattgctgatatatttaataatgttttttcagtttggaatacattgcttggtaggtattagtgtgaggagtagattaagatatatagacaaaagcatttccctacctttgtatataatgtacctgaaaaaaatgcatggaagtaggctgtgtgagttgaacaaagacttgcatggtataggagggtatattcttaccacatactataaagtccttaatgacattttgccttttagagaaaatatttattcataagatttatttacacattttattcctttccttcaaaaatgaacatataggcaacggaccagagtctgatgggccaaattctatggattgtcccattgataaatatttactgttttcagcattcttaatgatttctcggttgtattatgtttattaaacttatgtttattattattcccattgccattttaatttttctgtttttctactaattaaagtaatgatagtacagccatttatggaaaacaggatgcaggtttctcaaaaaactaaaaattgaactgccatatgatccagcaattccactactgagtataaggttgcccctcagtatctgtggggaattggttccaggacccccactccccacccccagtaccaaaatcgcagatgcccacaccccttatataaaatggcacagtatttgcataaacctgtgcctattctcctatatactttaaaccatcaatagatttctagattacttaaagtacctaatagagcacaaatgctgtgtaaatagttatcatactatacttttaaaatttgtattattttggctgggcgtggtgactcacgcctgtaatcccagcactttgggaggctgatgtgggcagatcacctgaggtcaggagttcgaaaccagcctgggcaacatggcaaaaccctgtctctaccaaaaatacaaaaattagccaggcatggtggtgggcatctgtaattccagctactcgggaggctgaagcaggagaattttgcttgaacccgggaggcagaggttgcagtgagccaagatcacgccactgcattccagcctgggcgacagagcaagactccgtctcaaaaaaaaaattacattatttttactgttgtattattatttttaattgtttctttttaaaaatatttttaatctttaattggttgaatccacggatgcagaacctgcagatacagagggccaacatacatccaaaggaaatgaaatcagtatgttgaggagatatgtaacgcactccccgcattcactcattcactgtagcattattcacagttgccaagatatggagtcaccctaattgtccatcagtagatgaacagataaagaaaatgtgtggccgggtgcggtgtctcacacctgtaatcccagcactttgggaggccgaggcaggcagatcacgaggtcaggagtttgagaccagccagaccaacatggtgaaaccccatctctactaaaaatacaaaaattagccaggcctggtggcgcgcgcctataatcccagctactcaggaggctgaggcaggagatcgctcgaacccaggagggggaagttgtagtgagccgagatcacaccattgcactccagcctgggcaacagagcgagactccatctcaaaaaaagaaaaagaaaagaaaatgtgtatatatacacaatggaatactcttcaactttattttcctttctaattttttttttttttttggctaggagcagtgtgttgagaccagttttttgtttgtttgtttttttgagacagagtcttgctcctgttgcccatgctagagtgcaatggcatgatcttggttcactgcagcctccgcctcccaggttcaagcaattctcctaccttagcctcccgagtagctaggattacaggtgtctgccaccatgcctggcttatttttgtatttttagtagagatggggttttgccacgttggccaggctggtcttgaactcctgacctcatgatccgcccgcctctgcctcccaaagtgctgggactacaggcgtgaaccaccatgcccagttgagaccaggtttttcttttttttgagatggagtttcgctcttgttgcccaggctggagtgcaatggtgcgatctcggctcaccgcaacctccatctcccgagttcaagcgattctcctgcctcggcctccagagtagctgcgattacagacatgcaccactatgcccagctaactttgtatttttggtagagacaaggtttctccttgttggtcaggctggtctcgaactgctgaccttaggtgatccacccacctcagcctcccaaagtgctggcattacaggcatgagccactgtgcccagccgagaccaagttttcaaaaagaaggaaatcttcgctgggcttggtggctcatgcctgtaattccagtaccttgggaagctgaggtgggcagatcacctgagtccagcagttcgagaccagcctggccaacatgacaaaaccctgtctctaccaaaaatacaaaacttagccaggcattgtgacacatgcctgtaatcgcagctactcaggaggctgaggcaggagaatcccttgaacctgggaggtggaggttgcagtgagccaagatcgcgcccctgctctccaacctgggcgacagagcaagactctgtctcaaaaaaaaaaggaaattttgttatttgtgataaaatggatgaacctgaaggacattattcatttaaatgtataaactttaaaaattgaacttatagtagcagagagtagaatggtggttaccaggagctggaggcagtgaatgttggggagatgttggtcaaagggtacaaagtttcagttagacaggaggaatcagttcaagaagtcttatttatttatttattttttgagacagggtcttgctgtgtcaccgaggctagagagcagtggcacaatcatacctcactgtaacccccaacacctggcctcaagtgatctttccacctcagagtcctgagtagctaggactgcaggcactcactcccatgcccaactaatttatttattttttatttggtagagacagggtctcactatgttgcctaggctggtctcgaactcctggcctcaagtgattctcctactttggcctcccaaagtgctgggaatacaggtccgagccatgaagagatctgttataccacatggtgacaataattaataacaatgtactgtattcttgcaaattgctaagaaagtagattttaagtgttctcatcatgaaaaaataagtatgtgaggtaatatttgtgttaactggcttgatggagccattccacaatgtacatatttcaagataacatgttatacatgataaatatataaaatttgtatttgtcaattaagaaaaaaagtttatttatttatttgtttttgaggtggagtcttgctctgtcgcccaggctggagtgcagtggcatgatcttggctcactgcaacctctgccttccgggttcaagtgattctcctgccttagcctccccagtagctgggattacaggtgctcaccagcacacctggctaatttttctttaatttttagtagagacagggttttaccatgttgaccaggctggtctcgaactcctgacctcaaatgatctgcccacctcggcctcccaaagtgttgggattataggcgtgagccaccgcgcctggccaagaaaacagtttttaaaaaagaatgtttgaataggatacaaaatatattcaaatagttgcctgaacactgctcttcttcttttttttttttttttgcaagagaatctagctctgtcacccaggctggaatgcagtggcaggatcatagctcactgtggccttgaactcctggctcaagttatcctcctacttcagccctacagcccttccctaggcagtccttcgcttctagaaaataccagtactcaatttattcccttcttttcatacattcatttttttctaaagaaatatttgagtgtttattgtatcccaggcattaagttagtttctgagtataaagggtgagcaaagcaacatgcctaataccaaggtttttgcattttgaaaaccatcctagaagaggcttcctggttgcacacaatttcaggcagttctcagacccaggttaaatatctctaagttaaagctatagtaattctggtaatgcgtagactgcactcactcacccttgtttttacttttagactgccaactggtaaattctccaagaaaatgcttacttctaccatgataatcttttttttttttgagatggcatctcactctgtcactcaggctggagtatagtggcatgatcttggctcactgcaacctccacctccagggttcaagcgattctcctgccttagcctcccaagtagctgggattataggcgcgccaccacaccgtctaatttttttgtagagacgaggttttgccatgttggccaggctggtctcgaactcctgacctcaagttatctgcccgccttggcctcccaaagtgccgggattacaggcgtgattcactgcacccggcccctactatgattatctttgtcttttgaacctcctccattaacctcttacaaaagacctctacaaggcattcattcttaggatcatggtgctttcattaatgtattccacatgtaacactgatacagcgtatagattaaagttaaattttatcattagattttcttaatattaaatttgggaccataagagagtttgaatacccaggaaaaaagaaatcgagttcaaataaatataagaaagtctctatctttgccaggggacctctgctttaggtaactgcccagtgggaggaatcaggggatcaaataaaagaaaattgaactggtccttgaatatggatgatttaaatcaagtggagatgggtgtcagtgggaatttttcttggaggggatgattgtaaattttttctggagaagattattatgatatagaagtgagcctctggtgcataaaaatggggtgcagaggatgcaaatgcttacttcgggttcagttaacgtgcagggagtataattctcctaggtacctcacacatacttaaaaagtaggtatttttattctcattttatagataaggaaactgaggcttgtgtaagtttttattccatgtcacacatgtaggaagtggcagagcctggattcaaacctatgctcttttcatcacatggtgctgcttgttcatgcctttccttccttgttactcttggctatactcatgtctgtctcttttaccatggcttaacctctttgcagctctagcttcactgctgttctctctcctaaacagcatagcatccttcctacactgactgtattagcaatgttttcatgctgtcaggtggttttggttgtcacgtttctcctgtgcttagtgtatatccatgttgatgcttgtcactgggcagggacccagctgaggcaaaggaactggggcattggttggaaaagatgggcttgagtcatggcatgaggcataagatgatcaagtctgttaccaggtgtgtgggaggtttggaaacctggccagagaaaggcctagggatgctccccgtatggatttaagggtcagggagtcaaacattaacctgtacccaatttaattttaatcctgttctaacacacagttctcttactgtgtcaactgagggagtattcccagattgttgaaggaaacaaaccaatatgttttctcatatttactccttctttgcagaagtcctgctttccaaagaagactgaatgtagagcatgaggttaccagtaaaataaggatgccaatgctgactctataagtgttgtgagattagagaaatgcatataaatactcaacatggtgcctggcaaatagcagggctcgaaacaccttagctgctgctgttactctgtatgaatttacttgtgataatgctgctgctgtttctgggattccccatttctcctttttctagtctagggtttggcttagtgataacccaaaattgaaaatcccacacactgaggatggcacaagggatacagaactgatggagtgctattcagggggtctcagtttgataggaggaatgactgatgagcatagcagctggtacagcaggaactgtaccaaaggcttaagtacatcttctcatttaattcttttaacaacccaaaagataactataaggaaacttaagcacaggatgcaaaataacttatgcatagtatgtaatttggaacaaataattacagtacaacataagtgccatagagacctatggaaatgttgaagagaaaactagtagaggcaaggaaaagcttcacagaagagataatgtttgatgtgggttttgaaggatgaaatagaggtggagattggcaaggctggaagtggaaagaaggatcacttagcaacctgcagagaaaggggcagcacattctaagcaaagggaaccgtgtatgcacaagcttggaagtgtggaaaaggatgacctgtttgagaaatgtaagaagtgtcctatattttagaatacacgggaggtgaggagaaggaggcttgagttgagctggaactagatagatcatcaaagatctcatacaccagaatgataggttaaaacaccttttctgtaaattaggaaagggcaattttagtcagggaagcctcctcgtcacatttgtggctcagagggaacactaggaaccagagtgaagagaagtgagattggagacaaggagcctagtgtggagcttactgcagaggctctggtgagagatggtgaaggtttgaaccaaggcagtaacggtggttgcttttacttacacagggtacatcctgattgtcaatggatggactatgaatggaacatgactattcgaagtataaaaattgacgcttgaccatgttctctctgtgggagtttttaggtagcttacaaaacttttgaggaatttacattttcaactaatgagataaatcagggtaatgccataaatgcaatgtgcagttgaattttagcaatgtggacaggttggttcatggtagagagaagtgaatctgagccatagcctatctgaaaagaaataccttttctagctttatatatagaaactagaactaagtttaacattgttgtctaatatatattttttggcatgtcatcaagaatttcttgggccaggcatggtagcctatgcctgtaatctcaatactatgggagtttgagtcaggaggattgctcaagcccaggagttcaagaccagcctaagcaaagaggcgagatccttttgaaattaccagggcatggtgttatgcatctataatcctagctacttgggaggctgaggtgggaggatcacttgaatctaggagttcgaggctgctgtgagctatgattgtgtcagtgcacaccagcctgggcaacagagcaagatcctgtctctaaaaaataaaaataaactaaaaaaattttttaaaagaattttaaaaaagtttttacattttgtacttaatgaatttgatttaagcatagtgatttggtataaatcattgtaagtcctaaatgtagggagggctgaatcagtgacattttactatatatagattgtgttttatgagatggagttaaagcttgtggagtgtacttggattatgtctgagtttatattgcagccttggtctaggactatatgctctctgaaagaaaggtgaagatattatattaacagcttatgctaaatatagagaagggaggaagtagcttactgctagttctttgccctgagcagaagtccttggaaagctactgagggcaaagagtgaagccttcagaaaggttgtttaccaggaatattataagattataatgcagaaataccttcactctaccttataccctgaagaaatatttgcatattctttttaagtctaaagggcttccttacctgcaatgtgtaaggaataacatctgttttcagaaaattctctaaacattttatttatagtaacataaatcagtcatggtaatttcttataatgtggttctgttactctgttaggccacatctgttttggctttgcttgccttggaagccaacaaaagaattcagtagcaaattcttttttcctatagatttatatttttggccttgctttagtttctttcctgaattttctaacaggcatttttttttctttctttcctttcattgacttactcaaaagttgaatgatgtgtaatattcttcctttctgaaactcttagccttggtaatcaatgggcaggtatttttgaagttctatattttccctcatgaattgagatttagctttagcttcttctaattacctcctgtcattcttctttctcttttcttccccagaatatgttaaagatatattttacattttggctttccctggagaaggaaggttaatattcaataaaacctcttttaataagattcttgcagaggtcaagtttaccaaatttcaggattagttgagtctgagactcttccagccccaaataaaattttggtaacctaccacctcctaatctgattttcttcctgttttctctatgttataaaacagcacttcatttacccaattagccaaatttgaagccttctgtttccctaagtctacattccctacattcctctctgtatctgatgagttaccatgtccattggattccatcttttctttatctcctgtcaatgacatgacccaggttcattctttctatagctttttaagcttcctgttctccctttttctggattcttttctgccaaagcaacctccttattgacatttgagtgaattctctaaaaccatcctatttctaacatttttgtagtcctttcggtattatattaatgtatcttaaagattaaaaactcaaatcctgatttttctagatttcaaaattaagaaataatgacctaagattaggccttctctgaagcctagagttaaaataggaaatatttactgtaggagctacattttttaggatatatttacagataaatttggtgaggctttccattgactagtaataatttaactaagaagcatgtgattttagaatgaactgaaaagaacccattaatctacatttggttttcattgtctgctttgagtgaatcactgatacctggttgcccactacagtgctgactttgttccagagactcacagcattgcctcatattgtcgaagtggaagttgtgggggaggaacacttgtgtaaatatttgcctgcattttatctgacagttttggagacttcagctaaaactattcataaattgttgaaagatccaattgtggcagctttaaaaggatcattaagcaaaaataaagatttcttaggaaatctaattttagtctctaaatataataatggaaccctgcactgaataataaattagtggatcatcattcctcattcagcaaatatttattgagcacctatatgggtggcattattctaggggcttgggatacatcaatatataaaacagataaagatccctgcctttgtagagcttatatttcagaagcaggagggagaaataaacatgaataagtatacaatcatgtgttgcttaatgatggtgatcggttctgggaaatgcgtcattagacagtttcatcattgtgccaacatcacagtgtgtacttacacaaacctagatgggatagcctaatgtacacctaagctacatgagatagcctattgttcctaggctacaagcctgtagagtattactgaagtaaatactgtagatagttgtaacacaatgataagtatctgtgtatttaaacatagaaaagatacagtaaaaatatagcataaaagataaaaaatggtatgcctgtatagggcacttaccatgaacggagcttgcaggattggaagttgctctgggtgagtcagtaagtgagtggtgagtgaatgtgaaggccttggacattactgtgtaccactgtagattttataaacactgtacacttaggttacactagatttatttaaaaattttttctttcttcaataataaactaaccttagcttgctgtaacttttttttttttttttttttttttgagatggagtctcactctgtcgcccaggctggagtgtggtggcatgatctcggctcactgcaacctctgactcctgggttcaagcgattctcctgcctcagcctcttgagtaactgggattacaggcgagcgccaccatgcccggctagtttttgtatttttagtagacacggggtttcactagcctaatgtacacctaaggctggtctcgaacgcctgaccttgtgatccacctgcctcggcctcccaaagtgctgggattacaggcttgagccaccgcacccagccattagcttgctgtaactttttttactggataagctttttaatttttttaacttcatgtctcttttgtaataatacttagcttaaaacacaaacatattgtatagttataaaaatattttctttatatccttattctctaagcttttttctatttaagatttttttttatgttttaaagtttgtttttttttaaatgaagatacaaacacacacatgatcctaggcctacacagggtcaggaactttaatatcactgtcttctgcctccacatcttgtcccgctggaaggttttcaggggcaataacaggcatagagctatcatctcctatgataacaataccttcttctggaatacctcctgaaggacctgcctgaggctgttttacagctttaaaaaataaataaatagaaggcatacactctaaaataaagataaaaaggctgagtgcagtggctcacacttacaatcccagcactttgggaggccaggcaggaggattgcttgagtccacgagtttgagatcagcctgggcaacatagcgagaccctgtgtctacaaataatttttaaatattagccaggcgtggtagcatgcaccttgtattctcagctactaagaaggctgaggtgagagaatcgcttgagcctgggaggtcagggctgctgcagtgagctctgattgtgccactgcactctaacctgggcaacagagtaagacctcgtctgaaataaataagtataaagtaaaataatgttaaaaagtatagtatagtaaatacataaaccagtcacattgtcatttattatcattatcaagcattataaccatacatgtctgtacatgccatacttttttatgactggcagagcagtagatttgtttacaccagcattgccacaaacgccctgcaaagttaggacagcatcagggtggctatgtcactaggtgataggaattacaatcttacaggaccactgtcatatatgcaatccctccctccctccttttcttccttttcctttctctctctccttccttccttccttccttgccctccctccctcccttcctttctttcttctttttttttttttttccaggttcttgctatgtcactcaggctggagtacagtggcatgatcatggctcactgcagccttgatctcctgggcttagcaatcctcctaccttaccctcccaaagtgatgggattacaggagtgagccactgcaccccgcctgcagtctgtctttgactaaatgtcattgcagtccatgactgtatatgttagaagggataagtacaatagagaaaagaaaaagatagtgcaggataatgggaattgagaatgctcggttagggggccaggttttagtctatgctgtttagaagagttcattgagaagatagcatctgaaaaggtgacaaattatcacttgtcctataattatgactaccaattagttgctaagaaaatgtcaggctctgaaaattaagaaaatatggatcagcctgagtgtgatggctcacccctgtaattccaacactttgagaggtaggaggataggttgagcccaggatgtcaagaccagcctgggtaacataccgagaccctgtttctacaaaaaataaaaaaaattagcctggcatggcacttagctgtggtctcagccacttaggaggctgaagcaggagggtcgcttgagcccaggaggtcaaggctgctgcgagccatgttagtatcactgcattccagcctgggcaacagaatcttttttaagactgtctttaaaaaaaaaaaaagagagagagagagaaaagaaaagaagaaaatatagatcagattttatcccaaacctcagggatagctgagcgagggaagggaaaaaaatgtaaacaaattagagcattatagtgttgtagatgctttgacagaagcatataggaggcgtagtaaggcacacagatctttctaatgtgatctcacctctgttcttaatatgatagcagtttatttaaataatgactcagacttcgtggatatcaaagcataggcttagattactttaatctcagtcatgtgaattggtcattctctctcctcacctctttttacctttttaaaaaataccatcttaggttgaattaatgtgagctgattttaattctaaaaaatatatataccatctgactactcagcatgtcccaacttgttccaaactatagtcagttgcattttgaaccatctgattatctaagtggaatatttgtattcagcatccatgctgctattcgtagtgtaactacccacagatacataatgagcaagacactaaaatgtgcaaggcattttggaaaatgccagagatacagccatgaataaggctgtcaagcttctgctttctaggagcttacattctgttggaggaagcaatcaagtaagatatcacatgtattatataccagcagttcccagactttttggtctgaggatccttgtacactttttaatgttatttaaggactttaaacagcttttctttatgtgggttatatttattaatttgccagtttagaaattaaaactgagggattttgaaaacatgtacttatttatttaaaaatagccacaagaaacccattatactaacattaatgagaaaataataattttcccaaacaaatagtgagaagaatggcatcatgttagatttttgcaattctctttaacgtctgacttaatagaagacagctggattctcatatctgcttatgcattcaatctattatgatgagttgttcggattgaagtatatgaaaatgtagcctcaacagatacgtggttagaaaagggaggaatattttaatagcctttttagataactgcgaatattctttgatactcaccaaaatttaagtgatagttacttaaagtttagttgcaatgtgaaatctgaaattgtattaatgacgttatatgaaaatatttttattacattaaaatccattggtttgtgtggcactttgaatagatcttttatgctttgtatgagtttgtaacatcatgcgttggttatttgaaaatcaaatcggtttactgaattatatggatcttccaaatattgacacatttcattttatgacataaaaaaattacatttgttgatattgctccaaactaatcagaaaaggctttaagttttcagaatctgtcaaggtcgtggtggctggtgaatacatgttttccaaaattctaatgtttgcctacaagcttgaattttataattggcaataaatgttgtcaatttttcctgaaatgacaaactcacttcattcattttcggggaaatgtttgccaaacacccgagagtgaataatttagtttgtcatttgttctttgtagtaaaaatgatattctgttaacaaagtgcccattagttcccaactcagacatttgcacaaatgcttttccttgagataaccgttatactttagtgtgtagcagaagtactttatatgtgcttcccatttgtcacagagactatgtattaaatatttactcgagggtcaaaatttgatgatgtttactgcttttcttcaagggcattcttaaaagaaatagtaatgttttatttttccctgcaagcatgtagtggtaaagaatttagtgactaccagttctgattggtgccattgccttgatttgtgctcgtgtgccagcagttttaccaccattgttcttacagcatcattgcaaacatgacaaacgcagattatgtttcagtattagtacgaaaatagttttgcactgaggaccccaatctcgttggattcccagtgttattacataccttatttcccctgattttcacagtggaaccatgaggtagttggtgatattaaccccttttggacccaagtttcctgaccagagtttctgtcgttcattctttctgtttgctataatatctccaaactgtggaaaagtttatattgttattccttaagaagaactttgttcagcgaaaacagaatgggatggggtgagtttatttaacggaactaggggtgtctgaagcctagagattccattctcattgctgctttttaggtgctatgtcgttgtgaaatactaaacttttctgtttccttattctagaaaataaggataataataatacctatctcatgtagttgttgtgaaaatttagttaatacatgttatatgcttagaaccgtgctgacacaaattaaatgctcaataggtttagcttttattatttacagttagagatggggctcaggcattccagctgagggaacaacttgagcaaaagcagagaatcgtgtcatgtgaacagtacatacaatctaacagaatgtagtggttcatggaagagtatgtgggaaagtaaaaccgggaaggtagatttggacgctgattattgctggactagagctctaaactgttgatccaatttgtgtccctaatgcctaagacaatgactggtacatggtgtatgtatttatatattgcctgagcattggaatatttgaataaatttaaggaaggagagagcagctgctctcaccatgagcaacataggtggagaaagtgacattgtagcgtagcccagaagagtgaatagaattctagtaagcaaagatattagaggtgtgagacaaagcagcaaatttaagaaaatgagaatgtttgatgtttgcttgttctacttgccagaatttcacaaaatcccttgccaacaaaatttcacaaaggccctgactcagtgactgagcacagtcctctaaaaacaacaacaacaacaacaacaaaaagccctaaagacaataaataagatagaacacagtttcccacatctccagcttaaatcactgcatttttagaaaaggcaagttcagtgattctagtcgttgcctctttctgcacgtaagataatgtccaacaagattagtgattatgcctccgtaatatataaccagatatgcccttacacccaaactttaatgagattttgctctactataacttacaagcacatacaaaactgccaccaccaatttataaactgtgtctaaaaccctactttgaaacagtctaacaaaaattctctaaaagactctcctaggtaacagtcctcagtaagacttctaaataaaactaactttaattctttaaaagctcccctgtcccgtttttttttattttttatttttatcttttttgcttagttgacagaggctgatagaatgggtgaagatagttgggatataggctcatgcctataatcccagctgcttgggaggcttaggcaggaggatcccttgaggccaagagttcaagaccagctgagcaacatagcaagacccagccccacacccatctctaaaagaataaaaaattagctgggcgtagtggcttgtgcctgtggtcctaactacttgggagattgaagcaggaggatcgcctgagctgaggaatttgaggttgtaataagctatgatcatgccactgctctccagcctgggcaacagagtgagaccgtatttctcaaaaaaagaaaaaaaaaagaaagaaaaaagaaaaaagcgtgaagataatacctcaccaaacgatatactacccacccaagttattgtacttttcaggagacttaattacttgagatcatgaattgttttatccttgctcatataccaaacatagtaccccgtgcatattggggctcagtagctacctgagcagtgtctcagcagttaatcttgtaaatgtggtttttgtgtaatgtttttatttcacaataactttcagagaaaaggaggccttcctgattataggggttactttttttttttttttttttttttacttaaattgcagaacaggcaaataaccactttattttgtatacaggcagtaatatattcacagttgtttgtgtcttaaaggagaagatatgactttaggaggacagattcctaagcagtggatcaggaatggtaaggtataggagttttagaaagttgtcctaaaagctacttcttgtagtttaggttgtgtgagttacgctggaagagtgaaatcttttgaataacttcatattcttattcaaatgtgtataatatagaaaatgtgattagatacgtaataaatgagcaaagatgataaaatcctgaaaatgtattctacatactagataaatactgttttcctctgtgcaccttatattgtttccatataaaccaggcattattgagaattaggagttaccagtaatctcctctctactaattttctctggcaaattgttctctggattagtagaactagttttctctgttggattgatagaacatgtgataataataacatattggtattttcatgtatgtcaggcatcgtggtaaatattgtacagattatctcatttaaatctcacaaccttataaggccgaggtactgttaccatccccataggtaatattatcatccttagattatagatgagaaaagtaaagcttagagaatttaagtatcttgcccaaggtcagaatgaataaggtcaaagctaggtatcagacgaggatttggacccaagagtcagccctcttggcctttacactgtgcagcttaagagatactaaaaagcaacagctttgtgggacattggggtggcttagagtagtgttttctgaactggattgcagtccattaatggattataaaggtctatttagtgggcccaaatcagcattttaaaaaaatgaattacaacagacagaaaaatatcaatgtgtatggcatataataagagcaagcactcttttatgaaacgaatgttccagtttatatgtatatgtgtatgtacacatatgtacacatatgtgtgcatatgtatgtatgaactggctgaagttatcaaatgtacttcttattgtgggtcgcagtcaaacaaaatttggagcccactggcttagaggatggaaagcaagctggaaaatataatgaatagcagtggtagctgctagagaagaaagtctagagataagctgaatgtacaaataacattatttaaaaaagggaagaggagttaactttatatatttgataaaatactgtagtactcaaagttgttttaactagctcattaagttagaccctttgcaggattcactcagaattagtatagctttaattttacttctagagagttggctctgcaggtggttttgaattgtgtatatcattactgtatttttatttctcatatgaacaatttgttgtgattgaataataaccagacatctctggtgcttcatagacacaaagcccttttttctattagatccattagagtagaggtttgtttactgacatgctaggagaatgggagaaggtagattagattggtcagaataatattgactcttgaattttcagctggaagggagaattcagttcaacttccaattttaaggtgcaaaatgaatattcatttttttgagactatcataaaacagcacaaaaatacatattcagacaatgcaagtggcttattaaagtcaacactagaaagaagtagcaaagctacatgtatacattagtcctgctcctgctcctgtatagtaattttccctctttttttgtatagtatactaatttgccctcgtttgcttagtctgtcttttttacctggaatgtcttccctgtcagtgcccctctccttctccacatacccccacttttttctttctctctctctccctctcacccagacacacacatatacactcacatacctttgcctctaatttctactcagttttaaaactcagctttaatttccttgcctcagaagctttccctgagttcgcctttacaaacacaaatgtctttatttattttgatgctcaaattgtcctcaatttgaccagaggaatcctatttaagctgacctctgtgtccttttaacatgcccctgtcattctttaagtatttccttactttctggcacaaaaagacattccaggctcattttataccttctctgtcctagttctggaatcaaccatttttccagggagtgctgatttctaatgatatttagaaatcaacacccagtgctaggtgtagttactgcttataaagtgttatggctcccaggccctctagagagctaagaaacatatgaatgttatgtacatagagctaagaaacatgaatgttacatacataggggtgtgcttgtgtctacacatgtgtacatccatgttcatatttatttccatatgtatttatctacatgtatatcgaaaaccatgatgaggtcatgctgatacctccagttacagtctatcacaacagaaataattctgttttttcccttaccatatttaactccgttttccaaaagtgagaaaaactttatctttgttgtatttacttatttgatcaatccttctgtatgtaattattttccaatcatccatgtccttttgtaaatgtcaccatcactccattcagccttggaaaccttgtgccatgcggagcctgttcactgcaatgtggacaccttccttctttttcttgggttctgactcctcatattggactttcccattgtatagcttccctcttcctcttgctttgggctctcatgccctgtgctaggttgtgcctttacatgatgcatgccctcttcaccctactcaggctctaatgtcctgagccagatctcccacccatttggtacagtacttttaactaaactacagagctcatttgaattttccctctaatgctccttttctgttccaggattcaatccaggatgccacattgcttttagttgtaatagttctttatttgttttttatctttcatgaccttgacattttttatgagtattggtcagttattttgtagaatgtctctcattttggatttatctgatatgttctcatgattcgattgcaattatgtatttttggcaagaataccacaaacatgatgctgttgtttccttgtctcagtggattgtattcagaggtataggatgtcaattaatcttattaactggtgatgttaaccttgatcacttgattaagatagtgtaccagatttttccattgtaaaattattatttattcatttgggggagatactttattctcttgtgggagatactttgaatctatgccaatttcctgtttcttctcacttttgcccattgattttagccattagtggatcttgcctgatgtaattattgctgtggtgttggtctaatggtgatttttaacttttgtcagtccttctacacttattcattgtaattttttttttttgagatggagtctccctgttgtcacctggactggagtgcaatggcacaatctcggctcactgcaacctctgcctccccagttccagcaattcttctgcctcagcctcccaagtagctgagattacaggcacccaccaccacgcctgactaatttttgtatttttagtagagacgaggtttcaccatattggccaggctggtctcaaactcctgacctcaggtgatccacccgcctcggccacccaaagtgatgggattacaggcgtgagccaccgcgcccggcccattgtaattcttctaaaggaagagatgtctcatctcccctacttatttacttattcaattattttatattaatattggacttgtggatatttattatattctatgggttatagtccagtactctgtgaatttatttacctaaaatcatgagttcatactgaaacctccgattgtagttcaacatcacaaggtttattctaaccttctccctttctgtatttctaatttttttctgatagtaagaaacctggttctcattatctataacatactcacttgtctgtagttacagaattgctaacatgtactcctatgaaaatcaaatttactaactagagtattgtatttgtatatggttctttttttttggcctatcctttcactatatagtcaaaatactggttttttttgttttttttttatacttttaagttttagggtacatgtgcacaacgtgcaggtttgttacatatgtatacatgtgccatgttggtgtactgcacccattaactcatcatttaacattaggtatatatcctaatgctatccctccccgctctgcccaccccacaacaggccccagtgtgtgatgttccccttcctgtgtccatgtgttctcgttgttcaattcccacctatgagtgagaacatgcggtgtttcgttttttgtccttgcgatagtttgctgagaatgatggtttccagcttgatccatgtccctacaaaggacatgaactcatcattttttatggctgcatagtattccatggtgtatatgtgccacattttcttaatccagtctatcgttgttggacatttgggttggttccaagtctttgctattgtgaatagtgccacagtaaacatacgtgtgcatgtgtctttatagcagcatgatttataatccttagggtatatacccagtaatgggattgctgggtcaaatggtatttctagttctagatccctgaggaattgccacactgacttccacaatggttgaactagtttacagtcccaccaacagtgtaaaagtgtttctatttctccacatcctctccagcacctgttgtttcctgactttttaatgatcgccattctaactggtgtgagatggtatctcattgtggttttgatttgcatttctctgatggccagtgatgatgagcattttttcacgtgtctgttggctgcataaatgtcttcttttgagaagtgtctgttcatatcctttgcccacttgttgatggggttgtttttttcttgtaaatttgtttgagttcattgtagattctggatattagccctttgtcagatgagtagattgcaaaatttttctcccattctgtaggttgcctgttcagtctgatggtagtttcttttgctgtgctgaagctctttaatttaattagatcccatttgtcaattttggcttttgttgccattgcttttggtgttttagacatgaagtccttgccatgcctatgtcctgaatggtattgcctaggttttcttctgtggtttttatggttttaggtctaacatttaagtctttaatccatcttgaattaatttttgtataaggtgtaaggaagggatccagtttcagctttctacatatggctagctagttttcccagcaccatttattaaatagggaatgctttccccatttcttgtttttgtcagctttgtcaaagatcagttagttgtagatgtgtggcattatttctgagggctctgttctgttccattggtctatctctgttttggtaccagtaccatgctgttttggttactgtagccatgtagtatagtttgaagtcaggtagcttgatgcctctaggtttgttctttttgcttaggattgacttggcaatgtgggctcttttttggttccatatgaactttaaagtagttttttccaattctgtgaagaaagtcattggtagcttgatggagatggcattgaatctataaattaccttgggcagtgtggccattttcacgatattgattcttcctacccatgagcatggaatgttcttccatttctttgtatcctcttttatttcattgagcagtggtttgtagttctccttgaagaggtccttcatgtcccttgtaagttggattcctaggtattttattctctttgaagcagttgtgaatgggagttcacacatgatttggctctttgtttgtctgttattggtgtataagaatgcttgtgatttttgcacattgattttgtattctgagactttgctgaagttgcttatcagcttaaggagattttgggctgagacaatggggtcttctagatacacaatcatgtatcaagtcaagggacaatttgacttcttctcttcctaattgaagacctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatcttactattttgagatacttcccatcaacacctaatttattgagagtttttagcatgaagggttgttgaattttgtcaaaggccttttctgcatctattgagataatcatgtggtttttgtcgttggttctgtttatatgctggattacgtttattgatttgcatatgttgaaccagccttgcatcccagggatgaagcccacttgatcatggtagataagctttctgatgtgctgctggattcagtttgccagtattttattgaggatttttgcatggatgttcatcagggatattggtctaaaattctctctttttgttgtgtctctgccaggctttggtatcaggatgatgctggcctcataaaatgagttagggaggattccctctttttctattgattggaatagtttcagaaggaatggtaccagctcctccttgtacctctggtagaattcggctgtgaatccatctggtcctgggctttttttggttggtaagctattaattattgcctcaatttcagagcctgttattggtcggtctattcagagattcaacttcttcctggtttagtcctgggagggtgtatgtgtcgaggaatttatccatttcttctagattttctagtttatttgcgtagaggtgtttatagtattctctgatggtagtttgtatttctgtgggatcggtggtgatttttcaaagttacttcatgttttagttagtttgggctgctataacaaattaccatagattacgtagcttaaacagcaaacatttatttcctcacagttctggaggctggaagtttagatcaggatgccagcatggtcaggttctggtgaaagctttcttccaggttgcacagtcaacttcttgtccttatatcctcatgtgttggaaggagagtgagacagctctgaggtgcctcgtcacattaaagagggttctaccttcatgacctaattatctcccgcaggtctcacctcctaatactatgacattgaaggttaggatttcaacataggaattttggggcaacacaaacattcactccatggcactgaggttcaattatgtgaaatattatggttctgagaggctgaatatatgcaaaaagatatattcagagtgttgctacctccttaattcttactaatttgttcctattcttcctggcttcccatcctttctcacctgtggcttgtaaggtaaccaatttatttagttttctttagaagctttatatttcttttgcacaaataagaaaatacttgtatgttttctgatattccttttttcttatagtaaagacacacttcactttttaaaaatcttttatttgatggtatgtctgaaaatcactccaaatcactaaagaaatcttcctcattcctgtttttttaagagatggggtctcactgtattgtccaggttggtttcgaactcttgggctcaagtgagcctcccatctcctggggctgcaggcgtgtgctgctgcaactggcttttattctttttgatacctgcatagtattccttgatttattcaaccattctcctctgtatgagtatttagggtgtttcatatatatatatatatatatatatttttttttttttttttttttttttttttttgagacggagtttcgctcttgttgcccaggctggagtgcaatggcgtgatctcagctcaccacaacctctgcctccctggttcaagcgattctcctgcctcagcctcccgagagtagctgggattacaggcatatgccaccacacccagctaattttgtatttttagtagagttggggtttctccatgttggtcaggctcatctggaactcccgacctcaggtgatccgctggcctcagcctcccaaagtgctgggattacaggcgtgagccaccacgcctggccccaatattttaaagttacaaaaaatgctatagtaaataaccttgttccatatatatttttgtattgttagatgttgatcgattttttttcacatattcaaccaactttgtatttctaaaataaacacaacttggacatgatctattaattttttaaggtcatggtcattcattcatttcacattttattcttagtacattccactgggagaggaaagagtcatgcatcagtatatagattgtgctattctgttgtactgtttttatataggatttttgcatgtctgtttattctgttagatttgcctataatttttctctaataacagtcttgtcagattggtgtcaaagttatgctggccttaaaaaagagttgtggagtgttcactctttttccattatctggaagattttgtattagagattggcattattccttaagaattctctggtgaaggcttctaggcttggatttttctttatgagatgattttcaattattttaatattagagtgtttttgacctaccaaaagggtactttcctgtggcccaacctaatagttatagcactatctaggtttttaaagttgttattgtggtagttttggtaaattgtatttccttaaataatattttccacttaattaaaattttcagttttatagtcagggagttatgagtatgtgcatcagttgtgatgtcctctttcttattcatggcattaatgatctgtgccatcatgtttgtgttgtcttcgtcccttcctcctcctgtcatttttgttagaggttgatcaatttcattagttatttttaggtaaccaacttaggctttagtgacctatctattgaatgtttgccctctatctcattaatttatgttctttatcaattccttttctactcattttgaacttcttgttgttttcagcctttttgcttttatatatatatgcatttaatatatatatgaatttatatatatatatatgcatttaaggctacaaatttccctttatgcactactttaactgtatccaatgaatccatatatcatattttcatttattcagttctacatgttttctaatttctagtgcagatattttttcctgacctatggattatttagaagtatttatttttaaaaattccaaaacatctcagtattttgttttatttttctttctttcattctccttttggctgcatacaggggactttattgatggtacatgacaaggtggggccttccaggcccctccctcttcagggggtctggcatggaaactgtgtcaagaagagatttttgcatgtctgtttattctgttagatttgagtgcagcaggtattccccagcagctgaggtcctctcttgtcctttagttagtgctcttgctggagctggtggtcctgggcacttactccttggaggccatgtggaccatgaggtccaccaccctgttggtgtagccagattcattttcattgtcataccaggaattgagcctgacaaagtggtcattgagggcagtggtggccccatcatggaaggtggaagagtggttctcacttaaagtcggaggagacacccgggtgttcagtatagctcaggatgccctttagggggccctctggtgcctgcttcaataccttcttaatgtcatcgtatttggcagggttttctggatggcagatcagatctgacatgtaggtggtggggacttggaagaccatgccagtgatcttcccattcagtttggggatgaccttgcctacaaccttggcagcaccagtagatgcagggatgatgttcttgagagcctcatggtcgtcatgccacagtttcccagaggtaccatctacccacatcttctgggtggcagtgatggcatggagtgtggttatgagtccctccacaatgccagagttgtcatggatgaccttggatgggggtgcagtgatcaattggtggtgcaggaggcattactgaggatctcgaggctattttcttacttctcatggttcatgtccatcacaaacatgggggtgtcagcagaaaggacagagatgaagacccttttggctctcccctctaagtgagtcccagccttctccatggtagtgaagttgttgatggacccaacaacatagtcagcaccagtgtcacccccatttgattttggtgggatctcactcctggaagatggtgatgggatttcccttgatgacaagcttcccattctcagccttgatgctgccatggaacttgccatgggtggagtcatactggaacatgtagaccatgtagttgaggtcaaagaaggggtcactgatgacaacaatacctgctttgccagagttaaaagaagccctggtgaccaggtgcctaatacagccaaatccgtttattccagccttcattttcaccatggtgtctcagggacacggctggtggtgcatgagaaggggcggctgtctgtcaaatgagaggagcagagagcatcaaaaaccctagtattttctaatttatcctttttttttctttttcttttttttttttttttactggtttctagcttaaatttccactatggttagagaatatatgatttcagtcctttgatatttgttgagacttgttttagggtccaatatttggtcagtttttagaaatattctgtgttctgcttaaaaagaatatctgttttacatttgttgtattcagcattctgtatatgttcattgaatcaagtttattcatcagactgtttaaatcttctatgtccttattaatgtttcatctgcttgctttattgattaatgcaagtgatgtaacgtgtcacttgtaagcatcatatacttttacaaatcttaaagcctttgtattttaattagcacgtttacttcactcacatttaattattgattttttaggcttaaacatttgccatcttactgtatgctttctttcagtctcgtatattcgatttcttttttctcctttcttgtcaatttttggattatctttattattggattttttaattttagaagttaaacacttaaaaagcttttcttttagtgattattttagatattataacatgaatccttcagttatcaaaatcattgataattttatcttcttcccaaacaatgtaagaaacttaaaactttttattccattttcccttttccaatctatatgcagttgttttgtatatacaatctatatgcagtttaattttgcatatatttatttaaaatcccatgagagccttttggtcccagcagcagcagagctgagcaagcagctccctccctccctccgctgcccgctggccagcaggatggaacaggccacactcctttgtcaaggacttactggccggaggcattgccctcgctatttccaagagggcagcgacccgagttgagccagtcaaggcactgctgcaggtgcaacatgccagtaagcagattgtggcgacaccgtacaaaggcgtggtgtggtgggctgcaaggtccacatccccaaggagcagggcacttgtccttctggaggggcacctggccagcaccatccactgcttccccatgcaagccctcaactttgcctttagggataagtacaagcaggtccttctgggaggcgtgcataagcatgcacagttctggagatattttgcaggcaacctggcttcctgaggggcggctggggccatctccctgtgcttcttctatcccctggaatttgccagaacctgcctggcagccaacgttgggaaattgggcatatagtgggagctcaaaggcctggcagactgcctggagaagatcaaggctgatgggatccgaggcctgtcccagggcttcagcatctcggtgcagggcatccatatgtactgggcaacctacctcagcgtgtatgatacagccaagggcatgctccctgaccccaagaacacccaccacatggtgagctggatgattgccaggccatgacagtggcccatgtggcctcctacctactcctcacagtgcgggcggatggtgatgcagtccaggtgcaaaggaggtgatattacgaacacgggtgcccttgattgttggcagaagctctcctaaaatgaaggggcgaagcctccttcaaggatgcatggtccaacatcctcacaggcatggggccaagtctgggcctgtattatgagctgaagaaagtcacctaagtgcatatgtctcctccatagaaatggcaacccagagaatcatgtagaatacttaactattgtagattatggaccttcaagaaattctggtcatctttgtcctggccagagatcatgtctgtagagggctgaggtaggctctagaaaaggggttcattgtgatcacattcccctttggcacctgattccatgtattgattactgggggtgggaaaatcatgacgtcattgtgagcacacaggcgaggcaactccagctcagacctagagtccagatgcttataggacctgagttgtgtttaagtatttatttaaataaaaggaattgtatttcccatttgtacttaagcactagctcttcttttgcacagtgagtatttgtaattatgttctgtgttaggtgtgctgctgcaaaacaataaaaacaggacactgagagccagaaaaaacccccataagatattattaaatattatgattgtatgtagagaatatttagttttagccacatacttataatttctgttgctcttcattctgtgcagctcctaccaccttccatcaggcattgtttatgcctagaaaagaatactttttagaattttatttaatgagcatctgccgatagcagattctggttttgtcagtctgaaaatgagtttatttcatcttaattcataaaggatatatttcagtgaattctaaattgacagttactctcttttagccattaaatgtcgtactctattgtctcctggttctcattgtttcttttgagagcctacctgaatttaattgttgtttctttgaaagtaacctgtccttttttctccctggctgttttaaagatatttcctatatctttggtttgcagtatttttactgagatgtgcccaacttgtggatttctttgatttatcttgcttgggattcctaggacttctgaatgtctttaatcagttttggaaaattctcagccggacagtgcttccgtgccatgctctcttttgtcttcttctggggttccaatcacatgtgtgttacattttctcatacgctgtattgcttacccttacttctatattttctttttttttttttcccaaggcagaagaatttttcttagagcagaacaaaatgaaaagtctcccatgtctacttctttccacacagacacggcaaccatccgatttctcaatcttttccccacctttcccccctttctattccacaaagccgccatcgtcatcctggcccgttctcaatgagctgctgggcacacctcccagacggggtggtggccgggcagaggggctcctcacttcccagtaggggcggccgggcagaggtgcccctcacctcccggacggggcggctggccgggcagggggctgacccccccacctccctcccggactaggcggctggccgggcagaggggctctttacttcccagtaggggcggccgggtagaggcgcccctcacctcctggacggggcggctggccgggcggggggctgacccccccacctccctcccggacggggcggctggccgggcggggggctgaccccccacctccctcccggacggggtggctgccgggcggagatgctcctcacttcccagatggggtggctgccgggcggagaggctcctcacttctcagacggggcagctgctgggcggaggggctcctcacttctcagacggggtggttgccaggcagagggtctcctcacttctcagacggggcggccgggcagagatgctcctcacctcccagacggggtcacggccgggcagaggcgctcctcacatcccagatggggcggcggggcagaggcgctccccacatctcagatgatgggcggcggggcagagacgctcctcacttcctagatgtgatggtggccgggaagaggcgctcctcacttcctagatgggatggcggccgggcagagatgctcctcactttccagactaggcagccaggcagaggggctcctcacatcccagacgatgggcggccaggcagagacactcctcacttcccagacggggtggtggccgggcagaggctgcaatctcggcactttgggaggccaaggcaggcggctgggaggtgtaggttgtagcgagccgagatcacgccactgcactccagcctgggcaccattgagcactgagtgaacgagactccgtctgcaatcccggcacctcgggaggccgaggctggcggatcactcgcggttaggggctggagaccggcccggccaacacagcgaaaccccgtctccaccaaaaccagtcaggcgtggcggcgcgcgcctgcaatcgcaggcactcggcaggctgaggcaggagaatcaggcagggaggttgcagtgagccgagatggcagcagtacagtccagcttcggctccacatgagagggagaccgtggaaagagagggagaccgtggggagagggagagggagagggagagggagagctacttctatattttctatctctttgacttactgtcttttgttctcatgggtttcttctaactgctcccagttctgtaattgtctctttggttgtacttaatctgctgttgaactcatctattaaattcttaattttgattatttgtcacttttggaatttatatttgatttgattattttataaatctaagtggaaaaaaaccctaaaaataaaaaaggaaaaaattatgtcatttatgcaataatctggagctcctgttgatctgtttctgttgtcttttggttctcatttatgtgtggttttgtctccaaaagtgtctccatttatgtgtacttggttatctttgcttatgtgctagacattgtattttaaaaattgtttatgtaaatttaatttagcagctaagatgatgttatcttcctacagaaaagattttcatttgcttttgctagtagatgcctggcgtcactaaaaatctgtgatcatttaaatcaatttcaggcatcaagatttttctgggccacccatatgaccaagcaattgttttaattctagtttatcactactcccacagagaagttgtttggggtcccaactagaacatggactgtttaccagagctcccattgttggtgggccctggcttccaacttctggcctgaaaaggcttgtgtggttggttttttttgtttttttattttattttattttatttatttattttgagacagagtcgccctctgttgcccaggctggagtgcagtggcacgatcttggctcgctgcaacctccgcctcccgggttcaagtgattctcctgcctcagcctcctgagttactgggattacagggacccgccaccatgcctggctaatttttgtatttttagtagagatggggttttaccatgttggccaggctggtcttgaactcttgacctcaggtgatccgcccgcctcagcctcccaaaatgccgggattacagtcatgagccactgcacccagccagtttttttttgttcttaaattaaagaagttttaggttcacagcaaaattgaacagaaagtagagttctcatataccagcttccgccacacactgacaagcttttaagtgcattgtccggtctgcaattcctctcctggaatttgcaatgcctccatgagaagtgtccctaaatacaaggtttatcttctaaattttttgtcttctcccagatcttggcttggtaattctttattaccttgttggtttgtgatgccttcaaccagttgttttttaaaaatcagtctagcttttctagttgttctcagtgggaaggttggtctgaactatgtagcctgctattattgaacacaattattccctttcttataaattgttgcaagtagattgcatatctgtaaaaaatattaatagatcaagctgaacctattaaggaaatggtacaactaaaaaccttttctgttagccatcatagttttaaaatgatattttcaaatatggagatatattatagaattaaacttttaattttaatgtataatcttttattccagcccgtgatgctgatgagcgagagaagtggatccatgccttagaagaaacaattcttcgacatactctccagcttcaagtaagggtctttacatggtttccagatagttcattagttgttgctttctttttttgtctgttttctgttttttttttttaaataactgtggtatgatgtaataggaacttataatttctgagttgcttatttttcctttacagttatagtaaagttatactcatttattttctcctgctttctgcagagtaaaatactgatttttgtctagaaacaagacagtgcaagacaatgttgaaagtgaaattctatgttaaaatatgccagatttattttaagaatttaatatctgtagtcagttatcaatacaaccaaattacataattatgcatgataataggtaaatactgagaagttcacctcattttcttgttaaaggatttggctattaccgtatgtgtcagttagtactcttttgtatggtagtgaaagaaaactcaacccaaactgattcatgaagaagaaagtaaatctggttagatgtggtttgaattaggtaattcatgtcatgaggactcagatctcccatctctatttctacgttccacttttgcattggcttcattttcggttaggttctcccttggtggtggtaaggtggttgtagcaatgtcagcctcccatttttggaaccgagtccataggaggctattctttctagaccttaataggagtaacacaattattgctcatcaccctagctttggccatgtgtcaaatcctgaccagtcacaatttcacagtcatagattctaccctggagctgggatgttactggcctcactagaaacacattgctgatagggtagaaggtgtgttcatcctacccaacccgacccgcaccaaagtcagaatagggaaaaacagatgttgggtgacatgcaactaacgtctgccgtactacactgaagatatttttctatgtttattctccagtgaaagagcttatatttgtggtacataggggattttgttttaatttagaaaatttaattgtagaaaacatgttttataaccctttctctgtactttgttctatatcaggaattgacttgattagataaggtgacatagggtatcttaggccctacaagatagtaaaccccccatcacttgaaagtattcagtagaggcttaaaaaacattattaaaggatgtggttattaggggactttaagaaatgaatatgaaattgaagtaggaaatctttaagctactctgtgagttatgccttttaaaagcaatttgtaattcctgtagatttcttttaaatttaggcagtttcataaatgactatagcatcattttagcaaatttgtgatcctgtaagaggaggataagtgttttttgtttgtttgtttgttttttgtttttttgagacagagtctcactttgtaccccagaaagtaaatctagttagatgtggtttgtctcggctcactgcaacctccaccccgtgcgttctagcaattctcctgcctcagccaccacacctggcctaagaggggaggataagtgttttagtgatcatattagactgaatgtggcagatgagatttcccgcccccccattgttggttagactgacattcaacattcaacaagagccacctgcccttgtaggcatttctgccactatacccctacataaacctagagtgctattgcttacttgctttccttcaaatacattttttcatttgtggcctccacattcttgtgtgtgatgtcctttctctgtgaaatgtcttctaccctttttttcaaagcctagtttagaactgacctcttctatgaaccctctgccgactggcctttccttccccagtcccccaagttcaaaatgatctctttcctttgaatactatagtatttgcacaattcactatctccttatcatattcttcttgtttatttgttatcagctgatgttgacatcataagttcaggttcctaactagatccaatattggaatttttcagcttttgctaagaagagagcttgtatgtctttgggaataatgggcagaaaaagataactttgagaagtcttagacttctaatagctttgatatttaaaagtacatgtaatacaagaggtttttttcctacatttaatgcatggagaagataggacatttagaaatatggaattaatgttcatttgactggcaaaagattattttctcagatgtagtgaagtgtggtaaagaacttcactctagagccagaatgtctgtgtttgtatcccagagcccaccacttacatttaaccattaacattcaacttactgtctctgagtttcagtggcctcatctataaaatgaggataataagagtacctacttcatagagttgttttagtggttaaataaactaacgtaaacttgctagaacttgataaactaatattggatgagaactggttgaaataatgcctggctatagtaaaaacttggtaaatgttagttgccattacaatgcaactactgttcctaccattccctctgccagtgcctggtattcagtagcactcagtaaatgttagttaaatgaagaaataactgaaggaatgaatgaacaaatggttgatgtagagattgcttttccattgttgtttattgaatattttgagatgtataacatactgtctgttaggcactgtgggatgggcactcacggagctgtcttccaaaggggtataggagaggagacgcagtgatctcagcaacctacctttaaaacatatcctagtatctactgccatgttaggttctcttcttttgctttttttaaaaaaaaattctcacaaaactccccccacccacttcagtttatagatgaggaagctcctactacataatagtgcttcccagtctaattcttgacctcattgtatttatatgtcctttttttttttgacagagtctcactcattgcagtggcacaatcacagctcactgcaacctctgcctcccctgctcaagtgatcctcccacctcaacctcctgagtagctgggactacaggcatgcaccaccacgcctggctaatttttgtatttttttgtagagatgcggttttgccatgttggccaggctggtctcgaactcctgggctcaagccatctgcccactttggcctctgagagtgctgagattataggcatgagccaccattcccagccatgttttcctttttcattgaactttatctactttagccattaaactccactccattggtcttgtcattactaagagctgaaccacctgcaaaatattaagttaaaaagcgttttctttgacaacagttttcttttcttcatcttcctctatcactttacttctgaacttttattctctcattttgatctgacccctacttctctgtttttcctggccatttagtactttcttgttttgctcatcccatttcccagtggagaccttctggtctgctgctttatcactggttttgttagaagacatacaaatggcaaggaggtatatgaaaaggtgcctaacatcattgatcatcagagaaatgcagaccaaaactacaatgagatatcatttcaccccagttaaaatggctttttttttttttttccaaaagacaggcaataacaaagtactggtgaggatgtggagtaaagggaacccacatacactattagtaggaatgtaaattagtacagccactgtggagaacagtttgaaggttcctcaaaaaactaaaaatagagctaccatataatccagcaatcccactgctaggtatatatccaaaagaaaggcaatcaatatacggaagagatacctgcacacccaggtttattgcagcactattcacaatagccaagatttggaagcaacccaggtgtccaacagatgaatggataaagaaaacatggtatataaacacaatggaatactattcagctgtgaaaaagaatgaaatcctgtcatttgcaatcctgtcttgaatagaactggaggtcatgatgttaagtgaaataagacaggcacaaacttcacatgttctcacttatttgtgggagctaaaaattaaaacaatcgaactcatggagctagagaatagaattatggttaccagaggctggaagggtggttgggcgtataagtgtagggggagtggggatggttaatgggtacaaaaaaatgagaacgaataagatctacttgataacacaacagggtgactatagtcaacagtaattatacatttaaaaataactagaagagtataattagattgtaacacaaaagataaatgcttgaggtgatggatacctatttaccctgatgtgattattacttatttcatgcctatatcaaaatatttatactccaaaaatatatatacctactatgtacccacaaaaatttaaaaatttatatattgtttttgctatcacctttagaatttcttgtcattggatagttcgtctgtataccattctggtcttcattccccagggcccccgttgtctgatttttctgcttctagaactgttagaggtcacaaaagcaagatggttgtatctatcacaatttttgtctgactttaactgggtatctgttacgatttagtagtcatcttactgacttcttgttggtttccaattgaatcctcacagtagactgttttcattgtaatcagtatcgaattatagcctgttcccttcttcataaatgaaggctttcttcttcaacagttcttagtgacttcacctgtactttatttctctgctttgaatatttcgaagaaaacatattcttgctctttcccaaggttaacactacatacattaccttgaccacaggatgttttcttgcagattgtgacctaattccatcacccttcagcagcccccaccgttttcatggattcagctaaaccttctgtaagatgactctttttccccctaatctttatatctcttttgatatgtagctttagtctcactttttttccttttggattttgccagttagatgtctccctggaattccacttcagcatggctaagactaagcttgtcttctctttcctccccaaagcaaattgtaattaggatagactgaaggtgacagaagataactaagatcttcttcatcctttcggctcttatggaagctgaattccagtagtcattctaaatttgttgtatgtcagcttatggtatcttttcatgtctttacattcagccaaagaggaagttccttgaaggggagaccagagggcgtgctgtgcttcttaatcctctctttcttaaccagtaagaggcattcagtagatatctgatgatactgattaatagaggggaacttttcagattcttttttttttttaaccctagtaagctttagtacaaactaaatgctgagagattatcaagtaagggattgatcatcacaagaagactcaggatgttacatcctgtaggttttatagtttcctatattgtaaaaaatatgagttatagcagcttgtctggatgtcatacaggtataaaaatcagttttataaacttgagtaaattggggcccattttagaaaaaactcttgcaggctgtgaatgccaatatataagtaaagtattaagtataatgttatttaatgtgggcaaacataaagccaggtgtaaattttttaggtttaaaatcttatagaactatacatccaaaagaaaatttcaagttaaacataatacaaagcaatacaatctaaattaacattaatttaatgtgatgaatgatattgccttgctaaaagtgggtcactacttacaatgtgcaaatggtactcatcgttagggtatagattcttttaaactatgacatacgtacactaccatgtggaacgtgatgatgtgttctctgttctaactactgggaagacttccttggcatagcacatgccatggggtcagttggctttgacttcatatagatatgccatttacttggtcagtgtcacttctatgacaagtagtatgttgtgccagtttgattataagtacaaatatgggcaatgaagtaacttggttttaaggttgttactaagctgagtaacagtgtgtggctatacaaatttttataggctatcaggaatgaaaacacaggagattgttgtagattcaagtattttagattcaagtttgaagatgctcatgcagatgtttaactgagttgtatagacctttatgtttctttctttttctctttttttttttttgagacagagtcttgctctgtcacccaagctggagtgcaatggtgtgatctcggcttactgcaacctccgcctcccaggttcaagcaattctcctgcctcagcctcccaagtagctgggattacagatgtgcaccacgacgcccagctgattttttgtattttagtagaggcggggtctcaccatgttgtcaagatggtctcaatctcctgaccttgtgatccacccacctctgcctcccaaagtgctgtgattacaggcgtgagccaccgcgcctgactgacctttatgtttcttaactttatgctatacatcagttgatatttcaaaaatttaaatggtttctatgattattctttgggctaagaaattgggcattaattgtcctcatatgtatggtttttgtggctacttcatgtagattttatttttggtggttatcaaattggaatttttttttttttttttttttttgagacggagtctcattctgtttcccaggttggagtacagtggtgcaatctcagctcactgcagcctcgacctcccaggctcaagcagtcctctcacctcagccttctaagtagctgggactacaggcacgcaccaccacacctggctagttttttgtgtttttagtagagatggggttttaccctgttggccaggctggtcttgaactcctggcctcaagtgatccacctgcctcagcctcccaaagtgctgggattagaggcatgagccaccacacctggctgaaattggaatttcattggtactgcctgtaattttatgttaatttttttttttttttgtcgtcactagcttttatctaaagcccctagagagaaaggccatgataccttgtatacaaggttataagagtatacaagggaaagggagggctgaagggaacagggtgggctggtacaagcctcattagaaataccattgagtctgtgagtaaaacatcattatatgaaaaggagatgtggttttagggtggtccaattacttttgcaccagcctaataaaattacaagtcattatcaatagagacattgtaaaacctttttttttcccaaaagaagtatcaggtatgataattacatgtctgcccaactttcgttatagattaacataacttaattgtatttaaggtacaatttaggagagttgctgaaaaatgaatctttagtattgggatgccttgattctaccctcaatagctataatggattatgtgtctgagtagattaataaaaatcttttgagcatttttcttgaactacttcactgaagattagctttttgagcatccattttaatttctcagtatataaggatcggtttatcacaactgtattgttttccctggccttgttagattatattttcatatcatgtagaaaaataggtgtattcgttctcccttgaagtcctttgtctcccaaaggaaatggttgcaatacagatgtgtcacctcttccacaggtaaagtggaatggagaagtagccagttaaatagtgcatgctcaatttggaacatttagagcatacaggaaagttatttatttggtaaatattttttaagcatttactatgtttcatgcattgtactagttgtagaggatataattgaatacaactacatgtagcccttgactttatggaactagtctagtataaagatttaagattgcctggcatggtggctcacgccactaatcccagcactttgagaggccaaggcaggattgcttgaggccagaagtttaagagtagcttggtcaacataatgagactccatctctaaaataaatagatagatagatagatagatagatagatagatagatagatagaagtagttagacaacacaaagcagtttcactcatcttgtggcaaggagttatgtatttctaatcaaatttggcaactcaagcattttcaacaaaatctacatgttttttcagaataaagtgaccaacacagaatgttacctgtaaaaatcagagcaataattgctatctaaaataattttgaaaattaagtggtactgaaaggctcatatagcaaaaatatggcctcctgtcattgtactttcctacttcccagactcaccattttcaacattttttagtagtttattttgccattttatagcatagtacctgacattttatttattcaacagacatttcttaagtacctaatacatgccattccttgtttgaagggatgctaaggatacagtggtgaacaaggcgttgtggggttgtatagagggtattcattcctaaccttgaaccaaatatttctttctgttggataatgcattaaaaattgcaaacagtttacaaacttttggagcaatggtggccttgatcataaagtagggactgcttctaccgtatacatgcttggtggtgtatttgtgatatctggctaaagtttctacatggaaattgactgactttagttttgagacttctgggaaccagtcaggcaaaatagtgaaactgtgtatcctgtttccaagagttgtcttttaaggttatctgcttcattcatttggcctgacttgctaggcaaatgcctagggtaaatatgatttgattaactataacaacaacagcaacaacaacaactttattttttagagcagtttgaggttcacagcaaaattgagcagaatgtacagagattttccctatacccgcttcccctacgcatgtgcggcctcccctactatcaacatcccccaccagagtggtttgttacaattaatgaacctacattgacacatcattatcactcaaggtccgtagtttacattagagtccactcttggtgttgtgtatgggtttggtcgattttataatgacatttatccaccattatagtgtcatacatagtaattttgctaccctaaaaatccagtgtgctccacctgttcctccttccctcctccctcatccctggcaaccactgaactttttaacatctccatagttttgccttttccagaatgtcatatcattggaatcacacagtatgcagccttttcaaatgggcttctttccgttagtaataggcatttaagtttcatcctcatcttttcatggcttgatagctcatttctttccctccctcttttcttccctgtcttccttccttcctcttctttcctgtttcctctttcttcttccttttttaagagacaaggtgtctcactctgttgcccaggctggagtgcagtggcccaatcatagctcattgcagccttgaattcctgggctcaagtgatcctcctgcgttagcctcctgagtagctgggatcacaggctccagtcattttagtgctgaataatatttcattatctggatgtaccgcctattcattcacctactgaagaatatcttggttgcttctaagttttggcaattatgagtgaagttactataaacattgtatacaagttttatgtggatgtatgttgtcatctcccttgggcagataccaaggagtgccattgttggatcatatggtaaatatatctttagttttgtacagaattctaggttggtatttttttctctctcagtcctttattttatttggagacagtctcgctatgtcgcccaggctgccatacagtggtgccatctgggctcactgaaacctccacctcccaggttcaagcgattcttgtgccttggcctcccaagtagctgggattacaggagtgcgccaccacgcctgctaatttttgtatttttagtagagacagggttttgccatgttgcccaggctggtctcaaactcctgaccttaagtgattcacccacctcaatctcccaaaatcctgggattacaggcctgagctactgtgcctgatctctctcagtactttaaagaaatatttcattccacttttcttttttttcttctttttgagatggagtctcactctgtcgcctgggctggagtgcagtggcgcgatctcagctcactgccacctccgcctcctgggttcaagtgattctcctgcctcagcctcctgaatagctgagattacaggcgcccaccaccatgcccagctaattttttgcatttttagtagagacgggggttccaccatgttggccaggctggtctcgaactcctgacctcgtgattcgcacatctcggcctcccaaattgctgggattacaggtgtgagctaccacgcctggcccactcttcttgcttacatagtttctgaggagatgtcagatgtaatttttatttttgctcttctgtaggcaagttgagttttttccccctctagcttctctcaggatttttttctttatctttgattttcagtagtttgaaaattatatgcctagctgtcagggttttttgcttgtttgtttttgttttctcaggtgtgactccagaaaggttctaaagaggagctttacaatctcttctctggggtttatggagacttcctttacccttctgtgttagccccttaaagcactgcgtcaaccttaaaagggcacaggaaagggtgtctatgccatttttatgccatttatcctgcttggtgttttctgagctttcttcatctgcggtttaatgtctcacattaatttgtagaaattctctgtcattgtttcaaatttttcttcagttcttttctctgtttcttcttctggtgttcccattatgcttttgtggttgtcgtacagttattggatattttgttccaggcttttttttttccagtctttttttccttttgcttctcggttttgtaggtgtctgttgagatactctcaagtgcagatattctttcctcagctttgtctagtttactaataagcccattaaaggcagtcttcatttctgttacagtctttttgatcagtagcatttcttttttattctttcttaaaatttctgtctttctgcttacattgcccatctgttcttgcatggtttctactttgtccattagagttcttaggatatttatcataattatttcaaatttctggtgtaacaattccaacatccctgcaacatccaagtctagtttcgatgcttactgtgtctcttccagctgtgttttttcctatttaatatgtcttataattttttcttgatagccatacatgatgcattaggtaacagaaactgctgtgagtggacctttagtaatgtggtggtaaggtgtgcatggaggggaaacattttcagtctgttagtgaacttttgtcaacttcacatgtgcttctcaagtccatcctgtaagtgggagagtagggctagagaggactgaagttgggtatatattaaatactttctcctacaaagaagcctagaggggacgcattaggggattttttttcccccagtattcactgtgatgacccttattgagctcctggaggtaaaactcacaaaactgtggttctcccccctgcccatattactacatgtccctggagtttatatctttcagacttgtctgcactgagcttccaccaatttgtcaaatacagatcaggtttccctaccacccgtgcagttgaaaacccacatacaacttttgactcctccagagcttaactactcatagcctgctattgactggaagccttgccaataacataaacagttgattaatacatattttatatgttttctgtattatatattgtattcttacaataaagagaaaagaagatgttattaagaaaatcataaggaagataaaatatatttactgttcattaagtggttcccatgggtgctggttcccatggaggttgccccttgtgagtttttgctcagggaagttgtgattctctatatttgcctgttggtctcctaatttgggagtcatcagttttccctgtgacctcacttctcttacagagttaagaacagttgttggtttttcagtttgttcagtgttttacatgttgttagaacacagtggtacttctaagtttcttaacatgctagatcagaaacctgaagtctcacctaatttggctttttatattttttcttcttttttttcttccattgctaccaaagcatttttcatctgtgtctggggtgacattagagcagaatgtgatttctaggtaaacattattgggctccctagcagaaaaatttttgaaagtagtacatgaattctgtataattaaaattttcttttcatcttaataggtataggtaataggcacggcctattttttttttgctcaacagtctaaaatagtaatttaatcacctaatagccttagttatatagttgaaagaagagttggaaatctgattcatgggttggaaatcacctgtcacatatgagttttaggcactggtcactttattttgaaacagctttggggttttttcctttttcaactcataataggctttaacagcttttagttttgtttctgtttttttaacagcatgagttgccaaatttggttatagcttcttggtacaagatgggtaaatttgctttgtgttgtgtaattactttttattttaaatgctacctcttttatgaacactaactttacactaagattaggaaaatgagaattgcatgtctgcaacaaatagctatctgtagtattaaattgtgaaaatgtagactttggattggagctggcatctcttaatatgtaattgtaacatagagtaaataagtattttgtcccttgtagggtcaaacagtacagtgcatgggcagaattagagatgtaggcttttttttttttttttttttttactggcttagagaaccgtttgatcagctaatatggaattaagtccctagggctgcccaggcacaacattaactgctattaaaggaaaatttaaaagagtattagtgaaggttaaatactgaccatggacatctggcaaaattgatgttttttttcccctccaccattgtttatagtttattgttatttatcagagaattaatgtttattttcagaatctattaccataagaaatctgtttgaggacttcgtatgtgccaggaattctactaaataatgatataatgctgaacagaattagataggatcctcacttcgttaagcttacagtctagtggtatagatcaacattaatcaaagaataacacaaatagaaagcagagcagtggttcatgggattgactgtagagaagcatgagggaagttcccaggtgatggaaaatactttatttcttaatcgtggtggttacatgtgtgcatatgtttatgaaaatatattgtacatttaaagtggatacattttatcacatgtaaattatgactctataaagttaattaaaaagaataactcaggtaaggtggtgtgtgcgcctgtagtcccagctatttctgaggcaggaagatcacttgagcccaggagtttgagttcagcatgggcaacatgagacctgtgagactttgtctctaaaaaaatttaaataaataactaagataaatgtaaaattacagctgtagtaagttctacaaaggagagttacatgggctatgacgatgtaagatagcaagaactgacattggcagggaggaaatgatgatgagtagaagtaaataagtgaagtgtggggattgatgtcaaggggacagtataaaagaaataacagcatgcgccaaggccctaaaattggaaagtccttggcaaattaaaggagtttgaaaaaggccattgtgtgcaaagcagaaaataggtactacaaggtaaaagatggagctaagcggtaggtaaggctaaaccttgtcagccattgttaaatattgaattgtatcctaagcacaactcagtggaaagcagttaaagttctttaattgggggaggcaatgaaggggtaataaaattggttatagaaatactgctctggctctagtgttgagaatgaattggagtagccagagtagattcaagaagactttagtaagattattccaacaggccaggacctgttatagggtggtggcaatggagagagatggacagaatggagagtgtatttaggaggtaaaaatgacagaacttggtgatgcactgaatgtgaaatggggaaggtgtctaggaggactactaggtttatggtttgcgtattagggtggatgatagcagtttcatttactgagacagggagccctggcagagtacccagcttttagagtgggtagggggaaggggagagtgcatctggtgttgggcattttgaagtgatttacatacaacaaactgaaggtatctttaacactgagtccagcaggttagcatatttattcagcaagcattgcacctttttttgttgtttttggggtcttcaactcctggcctcgaatcctccctccttcccccgcctctcccagcctccgcctcccaaagtgctgggatttcaggagtgagccaccgcgcctggccagcatcgcgctgtttgtgcagtgtgccctgtgctaggtcttgcagtgggtaccagtagagacataaaagtacaaaagataattggacgtttagtagagtcctgaaagggggcgggataggaagatacctaaccataagaaaaaccagcaagagcggaaaaggagctagtcctccagatcaataagttaatcacttatgtttgtgattccctgcattttgggtgattctctgtcgaggtcctcttaagtccagacttttgatataatctgcagtttgcgccatttggattcctgaagcatctttacaagccacctacattccttatggagctgtggcacaacagcaagcccacgatgtctcaccggattaataaaaatataggcgctcacgcttttgtttaccgatatagtatctcctcctcccctcactccatcaacccccacgcgacacaactttccggaagtaagcaaaatccgttatcaaggtgaaactccggggaccaggctccacagctgccataaactggatggcacgttagaagccggtgggtgtaggtgaggcacgctggcgcccgcgggcccttctccagccgctacccagtgggaatccgcggggctgaagccccgaaaccaggctgagcgtcccagagcgcaacctccctttcccccagcagcgccggcgccgcagaagccgcgtgtccccaggcgcactcccccaaggtgaacccccgccccccacggaggcggctgggtcgcgggtctgggcggggcgctccggacgccctcccgccgctgcgcacccctcccgcgagctgccagctccctcggcctctccacccaaaactggcccaaccgccaatcgtctgcctctcacctcctacagcaggtgacccatggccaatcgccaggggtctctttgccaggagccgccagggccagccaatcggggcgacccctccgccggggaggggacgggaaaggggtggggggtgaagggggtgaagggggtgtcccgggggacgggctgaacctcagtcaggaccgcctgcaccgcagtccggggatcgggtcgaggggagaagaaaaaggggtgctcgggagcagcccccggctacctcccctggaggcacagagggcgggggccttggcgaatggctttcttgctggccacttgcggagtgagtagaccccgagggtctgggagaggggccggcccctacccctgagtccccggggtcccggccgccaggccggagcgcgaatgtcgtgctcaccctgcctccttcccgccgccccctggggtgagtaggacgacgtggctgcccgggcccctcttccttgggagttctcagttcctcagcctagatggggtggaggctgaggtcagggcctccagttccaccgagagggcattcgcccccaaatgagactttggaggaggtctctttttttctattcatttttgtggaactctgttttccttttgaaagctgtctcagaatatgattttaagcagaaaagttaagctttctcttatgtgaaagcttaattttgaccagttgcccattaatagaatctccagttgcaggccaagtgttttttggtggtggtttatttttggcacggtgttcgtgcctggccctgtattttttgtgtataaagtaattacggatgctattgtttttgagtatgtgtgtcgggaaggaggtgattttacgctttttgggtagcttgtgcaaaaatactgaaaactttggtatagttttatggggttcttagcccagccgagttatggaaagttgagtataattaatggactaggaagcatatttgagtaatgcactttttgctgacattcatactgtattataagtatttgttatgaaaggttgagagatgtattgaacaagaaaaccagttttgctaatttgaagtaatactttgttttgctttttgattaaactgtttacttttagctgtattaaggaagttaaaatcaagtaattcctagtttctcagtggagaagctggaagcatcttagaatagtagttgtagttttaaaagtttttacagtgaactttgaaactggaaattctcacgtagttaattatgaataatctctcttgaacactgcctgtattgaactaagtagttgatgaaaccctttaatgaatactgttagcacctgtcatttatttatactttaaatatattgctttactcccccccacctttttttttttgtgcagcccgacaagagacaacctaaataaaaataccgtattaccttttctagttcagggaaggtgtatgattaaaagtcagatttgggccagtcgtggtggctcagactgcaatcccaacactttgggaggctgaggcgggagaattgtttgagtccaggagctggagaccagcctgggcaacaaagccagaaccttccccccgcccctgccccaataaaaatttaaaaatgagctgagcgtggtggtgatgtgcacctgtgttcccacctgcttgggaagctgaggcggaaggatcccttgagcccagaagtttgaggttgcggtgagctatgattgcaccgctgcactctagcctggatgacagagagcaagactctgtctcaaagcaaaacaaaacaaaacaaaaaggcgggcgcagtagctcacgcctgtaattacagtgctgcctataatcccagcactttgggaggccgaggcggccggatctcttgaggtcaggggttcgagaccagactggccaacatggtgaaaccccgtctctactaaaaacacaaaaattagccgggcgtggtggcgggcgcctgtagtcccagctactcgggaggctgaggcaggagaatcgcataaaccctggagggggagcttacagtgagccgagatcgtgccactgcactccagcctggcgacagagcaagagtctgtctcaaaaaaaaaaaaaaaaaactcttaaagaaaaaaacagatttgtagtctgatttgagagcttaagtgagaaacaagaaagacaacagacaagtttcatctgtttacaaagtgccctgagtttggctttgacagagatgacgatgaatttggaagtgcccttcagtaaatacgaggatgcaaaggctgtctactggtcacgttcattttggtatttctaaagttctatgatatttttaatgtgaaatttttcaaatgttttttaatgtgaaaagattattatattttgtacgctcagccatccccacttcaatctctgttgatattaagattagtagggaatttaactgtaagtttggttcagccaggaaagagcattattttgttagcaccatgttctgctggttggaaagtcaggcactcacatggtttgcacgctgttgattaagaaaggggacgatgacaagaaaatctgataatcaggcttttgttcagagaagcaaattctaggatgtcccctggggtatgttgagttctatctgtagctaaactttatactgtagagcgaaaacagatatttatgatgattcttatatagaaaaaagactttgtgattactgtagtatacttagaaaattatatttaggaagcttttcagtaaaggtttaaacaaagattgttaagcttgaaagaatagttcttatactgacaatgtaattaagccacgtattcctccttaaatattttaatgaagttctaccacacacaggcatttaaagctactttccatcttccttattttccatctccagtcaccaggtcctgttatgtttgccttagtaatatttttcagattcgtcacttttttctagatgataatgctttaattcaggccatcatggtctctcacctagacttttgcaaggctttctgactagtctgtcactggactccccttaccccatcctttttatccaaaaacaaatttggaatgggttgccgctcttatagttaagaatgtgttttggctcctccttgccagagtccagctgcccagcatgtcctggaggcccttcttcatattctggtcctgatttatctctgagtccagactcagctccaggtgctttacccacggcatccactgtgaactgtttctcattgagaacatgccatagcctctcacagttatttgtcttttcacagcctttccttcttgcttagattaccccactgtatctcaagtggtaagcctccagttcttccttagcatacagctcctgtgttaaccttttctatgatgccttccttcaggcagggtgagtttgttactcttgtgtgtgctactacagcactttgctcatatctccatatcacagccttcactaagttgtattgtaaatttttaaacatatgtgattcttgcattaaaccctgatttcctagagatctggggttctcactcatctttgtatccccggggcctttgtccctagtttagtgcatggcacatagtaggtgttcagtaagtgcttaagtgatcaaaatatgtgacgataatagcttaagtgtgtaaacctttgactcagttttactggagttaggtttttccctgtgagttaaaaatgcttcctaggtcaccaagctccctggttgctaccagacatgagaaacgggggattggaaaaatgtttagaaacagtgctaaaaatggtgagcagggccgggtgcggtggctcacgctgtaatcctagcactttgggaggcccaggctggcagatcacctgaggtcaggagttggagagcagcctggccaacatggtaaaacctcatctctaataaacgtacaaaaattagctgggtgtggtggtgggcatctgtaagcccagccacttggggggctgaggcaggagaattgcttgaacctgggaggaggaggttgcagtgagccgaggtcacaccattgcaccccagcctgggtgacagagcgagactctgtctcaaaaacaaacaaaaaaaaaagtgggcagacttccaggactccccaccttcccctacccaatctataggacctctaacatgattaaaataatactaatagtagtacgagtactaattggttctggagtattgttagtatcataggaaaaagcatgtaggctagctagaatgtcagggaaactgctttaaaggtgaaatttgagctcattccagatgattaggtaatgcttaattatatttgctattaatattatctctattgtccttaaagacatcctttgaagatgatgatagtacctggccataatagacattaaataaatatatgtgtcatgaatgaatggtttggttgctctgtatgtgtgtgtatacatgtgcgcacgcaggagagagagaagagaactgtagttcctgccatattggagttcatttatttctggagacacctttaggaacttggcttctttgctgtattgactgaacaactcgtttttcccaaaatgtgccacttcaattaagttattctgcttactccgttgtttctttgcattctctgcattccagagcatgttttaaaatctggttgtgttagtctttctcactcagtttcaaggttacactaaatgacagagtttgcttgtgttttgacatattttgtcataccgtggaggacttggctgcagttggaacctgtaaattcttactgtgtttatttaaatgaaattaatttttattaaggtgaatacacgggccccaggttttccaatatggttaggaatttatcctcctggtgaacctagttgtttacctggaagtattggcatcacacaatcctagagctggagagaattttcaaattctaattccatttctacctttttaaaaatttttattattgtggagaaatcagtctcaaagcagctaaacgacttgcccatggccacatagctagagagtaaatgactagggccagagcctagatgactcttgctcttttattttctccagagagactcagggtgctgccctggtagtctccaccccttggtcgcctttcccccccaaaccctagtacttattcccatttttagccactaattttggtttccttgagattcagcatccagatccaaaaaatatacattcttctgtaacagaatattgttcctcagttggcctccttgtgcttctcagctcctcagtttgggaatatgccttttctggttattctccattttcttgcagatttgttctctggccttctctcttccgtgctctaggaggctgacttttacagctttcagcatctgggatcctttatcccttggcttctggttggggtttagcaaatgggaagcagtgacagaaaatggaagggaaaaaaggcctttggagtatttgttccttctgctccttccatgctttgaggcaattctggcagtgactgttttacagccgtccatgtccactggccggtgggaaccttgtttgtttccttgccccttcaggctacttgcagctcttaattcctgagtacctcagcatctcttgttagttttcttagccctactctcacttctgtgggtactgtagtcacttgattaaagaaaagttcaaacattgtatctgattatgctgtttcctgccagggcccactagcccggtggagtactgctttacccctcccatttctgtccaaatcctacactctaaattgcatcctctgtgaaagctttctcgtccttataactttctcctttgaatttcttcgtgcttttctgataacattttaccatgcttgaatcaattatttgtagacagatatatattccctctaatagaatgaaactcttttagatctgtgtctgcttcatcttggcatccccaaaggatccggcacagggccatagtcataagagatgctcagtgaataagtaattattgtaacactgaattctaaggtccagcatagtatgtgtaaaaatgtgctcaggataagatttagtgtgagataacgagtttttagagagacaagaagattgtcattgcctcatcttgtttcttgttttactaccatttatttcaatgtgtttttctcctagttagtttctctttcttcttaaaaacgtttagccttggaaaaattcagcagccatacattacagcaaccaactaatataataaatcccttaaaataactctatgagttatttatgatttttccacgaatattctgatttataatctgcaagaactagttccttgattactttttgtgtttaaatgttaacaggtgggcacattgcagaattccttaattcatttacaaaatttttattgaggacttgctacaaaccaaacactagcccggtggagatagtagagaataaaacgaagtcctgttttcattggcttgtattttatatcatcttgatagattctgacaattaaactaaatcagtaattttgtatgcactttttaacaactttagcgaaaaccgaatctgttttcttctggtactcattggcagctaaaattagatatacgaagacagctttggcatatataatttctaagagataaatgtcagaacaattgttgagtctattcaagtcagggtcgttgttttattttgtttgcctgtgactgatcatctatctgttagtcctgactagctatcaccttgagtgttaatttgtcaatttgttatattctgctgtagagattcagtcttgttagattaatatatcaggttttgtttttgaaaacatttcataatcaaattttcaagaagtattaggctataagaattttgcagttatttcagaacctgaactaactactaaagtactcagtttaaggattcacgtatttaatgttaatttttcctagttatttgtagaacacatttccaggaaatttactcatttttgatggatccttaaaagtagactccagataggctttccaaaatgctcttaatctgaggttggggaatggaagaatatttttctttcatcctgtactagtaaacctctcagagtttatttagatcctggaatgatttactccatgacttctaagaaagatactgcaagtagcctaaccaactaaagtatctcagaagaaaagtgttggctgattgccagcactacatagtccaacagtgcttttgttaggtggtgtgctgtagtaggtgttttcttctttaagagattgctttcttggatgttgagtcatgatcatgttgttggcaggaaggaggtggaaaaaaaaaactttgccattttgcttggttatattggccacttttcattattttatttattccagtatagtgattacgaagttttaagtgctttttgctagtgcgtgctttacctttaaatgatattataaatttgctatcctacttttttgcttggaaaggtgtatctgagcagctttagcatttgccagatttactcctggaaaacattttataattttatagacaatttcaaaagaataatgcttatgaccttgcatgctaaaatggttataaaattttctaaaaatgttcataacctgtagcttctgaacatttttacctaaagcttttgaatgtaaattataaaataaatgcatatttattttaaaaaattaaacaacatgaatgtgtaaaataaaaactcagagtcactgtctcacatgccctcattcctcagtcccattccctaggggtaactgcaggtgttttgtttcttttgtttcatgtgttatatttcaggggtgtgtgtgtgtgtgtgtgtgtgtgtgtgtgtgtgtgtacattttttaaaatgaaacttctagtgcgtaagtaaaattacataaaactgcaacttgagtattattcatgtgtgtacttatctagcataaggtaagcactcagttaatattaactgcattgaattccagtgtcttttatttctgtagcttgctttctgcattcagaacctgtaaactcatttcattttaggttttgtagttttttaaaaaggcaatttgctggattctgaatcatctgaggcaattttatatgcctttcataacatttgtgtcttaaaaatcctagctatatcctatatagagagggtgaccatgtaatttattgcctaaactgggatacttgagagtgaaggaggctgctaataataactttgctgagacaaccaggcataaactgaccatccaggcaaactaaaatatacagtcatcctatttacagacttaagttttttgtttgttttggttagtttagtaacttcttatatgggtttgttgaataaattgggagtgtctgggaaagacaagctgtcagtgatttaaatagagaaaaatggtacgaattccagacctttattgtttagttgtataagtaaccaaatcactttatggagttagtatttgtgttttgttctataagtcaaagggtgtattagtatcagatgagggtatcatgaagagtaaggaattgtgctaagggttatgattgaagttcttgcattttagctgtacccgattcctgtaccagattttagctgtaccagatttattttttagcagaaactgaacattacacataaacctttctttgtaaatttaaagataaacgcaattctggtttttcaaagcactaacatatgttcaaaaattagattcttttatgaaaaaaactttctttatattgtttgattctttgttaccaaggtaataattaagtacagtttaccttttgtggttcagtcataatacccagtgctttcctgaacatctcatattggaatatttttcctgctctgttttccatactgtgttttaccacttgttttgtctgttattcatttcttttttattaccattctctattatcttcttgggagttcatcaacttatagcttgtttttaaaacagatgttaaatacaatttaacttatgcttatagcctttacttgattgtagatctatatgaaaattgcctgtggttatagtattatctagttcttgattcgttttgtttttatccatccgtactcattgagtgccttctatgcgtaagggcctggagatatagtggtgaatcctggttatctaaggctccaaattatgaaggggaagtagaacacctaccactgtgttactttacatgtattactcatttaatctctccagtaaccttgagtagtttattattatactcatggatgagaaaatgtaagtgaaaaaagtaatttggctagatcacacaggtaattcattagaaagttgcagattcaggatttaaaactagatgagtccttaaagctgtgctcgtttccactatgtcaagggccttcaggcagtttttagattacattttagtgcccttctgtcattaattccttttaaacatcattgtgatttaatagaaaagtataatggatttggtcaaaggactaggttgatatcccaattgaaaaaaaattcagctggatgatttgggtaagcacttataaaacaggtttaatatctgtctaccttactgtattataatgctcaaatgagaaagcttgtaaagtgtctagtagagtacctaatactctgaaaaaaatttaatatacattgtgcatccatgatgttagagctgcttacttagcattacagaaaaagaccttacttttcagggcattcttgaggtacctagcagttggtaaggtaactacagctaccatgttgacaataaagaacctaatttgaagccttagattatcaagacattggtaaatggaaaataacttctctaaggtatagtgaaaggaaaggtttaatactaggctcaattttatggatattttttaattgatgatcttcactccaaatgaattgatagttgactattccttaggattaaaagagatgaaaatcttaaccccagaacttccctgttcttctaagtcctgttcttcccttagcagaaatggataaaccacggggacagtagggattgtaaatgtttccaaattttcagtaatccaaggaaatcacagattagtgtgcctcacataaaatcatggtataagtaatatttctggtctctttaatatactttttttcatcgtcaaaccacttttggtagggagacaagatgtcatttctctaaaaacttaatttgctaacttaaatttctaagaaaggccattatgtttggcataatctttttttttttaacttgccacttgctgctcatgtacctacttttcctctgtgtagttacagatttttctcttactattcctttacttgattattgatgttagactcacagcatggtaactttctattctctcttttccttacttttatggaagatcagtaccacacttgcttttttccagtcttctggtatctctccagttcttgaattttcaaaaataattgtaagtgattgaattgtaagtatgctctatacttctttcattggatgaaagcttatctgtgatgcatgtcatctcaaattgctaattgtgaacataaactttccaatattctcatattttaatcaaaattacattcctgctaagttttcattagttttattatagggtatgtgttttactaattaaaaaaaaatgtctgcttttgtccagattcatgccatttatttttcattaggaggcttgttgtgtgttttttctttgttaagtttttaagctattgtttaatttacagttctactactgataacttacctgtttttcttgttattctgattttttctatgagacaaagaataacttacttctaatatattttctttttctctttttacaacatatttttattatatatgattttgccctataagaaagtactgcatataggacacttactcctttaagttttcactgtgaaataaaattagatatgaaaacaattattcatttgtgaatttctttttacaatgttattactcagccttcctgttctaccttattctcggttcctcaggttgcccataggtttcttaatttccggattctggactcaagaacttcacctttatctccactgttcattactcttcctctgtcagcaggaattactttaaaagctcctactctgcctcaggaattgactcttgtgttgttttactaaggaagtgtctctccaaagcaactataatttatatgcacttcagacagttttaaggacttctcttgcagtactccttttaatgggggtaaaacattcagttacgtgtatgtgtaaagtataaatagtgtttaatgtcccaactgaaatcattaagaattgattttgctgacatttgttagcttttaagttccttctgaaaaaagtagtgttatttaacttaagtattagaaaggtagtaggaagtaccgacatacagttttgaggcagtttgatattcttctacaagtctagttatattattttagaaattccccttaaattggcccagatgtgtatgtttctctttctctctctattaaactggatacatagattctggatgatatagaagtatgtgttattcttcttgactttatgtatctactttagattttgcttcttttctttctctctttccctctctccttccctccttccctccctcccttccttccatccttccttctccctctctctcccttccttctttccttccttcctcctttcctttccttcccttttttctttacttcctcttccccttgcccttcccttccctctctccccactccctcccccaacctctctttctctctctttctttcttttttttttgagggtcttaccctgtgcccaggctagagtagctttattaataaagtgtttttgaaaaacagagactttttttttttagcatattcaccacagaagtggtttttctttacataggtttctaaattttatggttagattgaagtttaatttctattgagattcttctaatttaatttcttgttacatcacagaccattttgtctttatttctctataattgttgtgtataatttaaactttaaatgaattcatacaggaatcatctaattagagctgtggctcacatcagtgtaataaaccaaagagcagcaacctctttggtcctgagtgccaataatgcgacataatcccttcagttactactgaaggacctggacaaaagagaaagaaagacaacatggagaaaaggcttgagggagtagagaataggagaaagagaacagaaaggtaagagaaatctcgggagaggaggtcgggggaagaccgatgttgtggcatcaacaatttccagtcactgtagccagcgccatgtgtgttcatttaacactgagctggccctgatgggtatagtgatgaatgaatggcatagttcctgcccttgtggagttttaatccttcagagaagtcactcaaatattcaattatgataaaatgtgataaatgttagagcaagtacagaatactagaatgtgtatctacttgactcccagcttacttgttctcaaaagctactgtaagaagtatgaagtcacactgtctgaaagaatttgccctattctcagttcttttcaaagacagaccaccctcaatatggtaaaggactatattcttagtcctgtttaaaactcggccgggcgcattggcccacaccttgtaatctcagcacttttggggacactgaggtgggaggattgcttgagctcaggagtttttattttattgcggagacagggtcttgcaacatagcaagaccctgtctccacaaaaaaagtaaaataaaaaattatctgggcttggtggcacatgcctatagtcccagctacttgggaggctgaggtgggaggattccctgagctcaggaggttgagtctgcagtgagccctgattgtaccactgcactccagcctgggtgacagagcaagaccctgtctcaaaaaataaataaaaataaatctccattaaaaaggattaatatgaataagtgttgtggcttagtgttctaaatgttgaatggaaagagaaacagttaacacttcaggagaattttaatgaaatattctacattaggaagtagtgggtttctcatctcatgagatacttaagacaagactagatgactttcaaagatgttatgaaaagaacttctgtgaatgggaggttgaattaggtgactgctgtaagtcacaatataaagtcatacttgtgctttcttctagagtattagttttactagatttgagaaaacacttgttaactacttgttcatgttatcgatgaattttacatgatattttattggttgcagatggggcaactatatacataaattttccttttaaatacatgaaaaatttttgcattactatgcaagggtgattgggccagttctgggactgtcattataaacctcctgttacacattacctaaagaaaaatggattgatgagtagatctttggcttggaccttgtgaagtgtgaagtttattctagagttaaaagaaggttatggaagactatctagaggcaagtgtaagaagagagtcaaggtgaggtttatatgattctacaaacatcaaaaagttgtttctgaagaattgatttaggtaaggtttagatagcagtaatttaaatctgtttccattcagtcactgaacaatttttaatctaatcggtaatttgtttaaaaaggatgttttagttagatttttacaatgttaattctaaatggattcagaagagtgaaaatacttaaagatcacttttcccctctcatttagatgctttttttattcatttatgaatatgccattaaccttttaaaatatttactaaaaacaatgtatttagctgattttaactgggtcttgatagttaattattgataatcatgttacattgctgtgtgaaacaaaaccaaaaaacaagccaaacagtcctgatttttctgtggcacagtaacatggaaataagttgctcatttctttcatagtacagtactctaatatctatgaaatatgatgtacttatccatttctatgtcttttgtcaccaaactgtatattttaaatgtctctaacaggaacttctttgggttatctttaaaaatgaagaagtttaaacacagttttataaatatatctggattttgtatacattgtttattaagattttttttttcaacttttgtttttgtacatgtcatctcattgggaaggggctttgtaatactcattgtcaaacagtttcttgatatgtatgtaaaatagacatttatcgcctttgaatttgaaaaagaaaacaaattatgagataagttgatttttcccatggtcttaataggacttagatttttaataaaattctattttttctttggttccaaatttttgaattttagtttgggaagagcaacaaaagtactataatagtagtaattgatagtgtcattagttgttgtctttagtagaggtagtagctgctgtactaataataggaggaggaggatgcccgtatttggctggcaagaaaacccagatttggacagccacaatattgtgttagtgaatgcactagaattagaaaccagatttgccagcccattactgtttccataataccataccatcttaatttgatgttttgagataatggttgtaaaagtgctttaatgataaagtatacaaagatcaggtgttgctgtaatataaaataaactttggcttcagtttactaaaatgagaatgtgaaaataatcagcatgctttgggcgaaggcagggaggagatgacaagtgaaagtcaagtgtgagatgggtatgttgatcaagtatattttacccatttagtgcagaattttgtggttgggttgggatttttacagtagcagttcctaaccctcagtcccctgcttaacagtatgatgactgggcatgaaaatgtggcagtcagagaagattaagaactcaaaagtttcttttggctaaagttaaaacataagaatcccatgctcttggagcttaaactctttacgtatgcaaaaagtaggacatgcaaatgctgcacttttagaccgagaaataagtaggccttctaaataaataaacatctataccacgtctaagtgtagtgttcatgccaagggtgaaagtgagtaggaaacttgattaggacaggtgttgttactttcacttagagaggggccacctcttagaagaggagaaaatttagaggttctttctttagtaggggaggagggaggaaaacttcagagatcatggggtgggttgaggaatgggagaactaaacagtgagaatatgaagttaacattaagggaagggaggaatgaactgaatgaaaaaggggaaaatagaagtaacctaggtgggttttgtttatgttcctttgttaaattactgttgttctagtggtgactgggagccaattacagggtttgggggagataagaaagtgattctggagagaagagtaaatccaatttgagcagcagcatgtgtaactgctgagaagggaagcagtgctccaagttaatgaggaagattgatgtaccactgtttaaatagacctaactgttaaatagacctattatttgtgtcaaaatagaactgtattttaaaaattgaaatgtcttcatgtatgaagggaaaagtattttttgtactattaaactttgcttgggttctggtagatttattgcaaattctctttctctagggtttggattcaggatttgttcctagtgtccaagattttgataagaaacttacagaagctgatgcttacctacaaatcttgattgaacaattaaaggtatggcattagtttgtatattaaatttatataaatagaaaatgttactgagcttgatttttgagtaaaaacagttacttgatgttaatttacagccctcatgtggttcttcagcagtttttaaagcagacttaaaagatctagctgacttattcaaaggtctttatctctaattatattggtaaatagcatatttacataatgcttttttggtcattaagaaaaaaaaggtaaatatgtaggcataattagaaaaaaataaggcaagatttggttcatattctgtttaaaatttccatgaaactgtgttttagtggctcaatttctttttttgtttgtttgttttttgagacagagtctcactctgtcacccaggctggagtgcagtggcacgatctcagctcactgcaacctccgcctcccgggttcaagcaattgttcttctgcctcagcctcctaagtagctgggattacagaggtgcccgtatttttagtagagacggggtttcgccatattggccaggctggtctcgaactcctgaccttgtgatccgcctgcctcggcctcccaaaatgctgggattacaggtgtgagtcaccgtgccctgcctagtggctcaatttctaacacttttttaatttgagggagatggaatatggggaggtgatttctctacctcttttatcattactgaaatgaattgtctccttcagttcctacttaaaattaattaaaagcagaggtgctgggaaaaggactgttgataaacttggaaaacaaagcagaaaaaaaacttcaagtttgaattcatagtttaattttttaaaagtcatctgttttcttttgcttataattcttccagagtgattgatcttgaccagttaaaatgatttcatacaatagaatttgactttgattgagtgctcgaaaaaaaatacatgttgtcttgaaaataacatataaatcatccctggacaaaatgtgtttaagaacaaatgtttgtttttctgtgtttagtgaatgtacatcgtatagtaaagtggcttgatactataaccattttttaaaatcttgtagctttttgatgacaagcttcaaaactgcaaagaagatgaacagagaaaggtaacttccataaccgtgcttttgacgttaaaaattttaaattcagccttttggagaacactaagtatcttagtgtgtttttacttactataataatattattgacctagtgtaatattactgccatatggacctcaagggtacttttctgataaatttctgttatggtttcataattaaacaaaaggataatatacagagttgtggagtttttttggttttgttttgttttgagatagtcttgctctgttgcccaggctggagtgcattggcacgatctcagctcactgcaacctccaccctctgggttaaaatgattctcctgtctcagcctcccaagtagctgggattacaggcatgtgccacacctggccaatttttgtatttttagtagagacagggtttcaccatgttggccaggctggtttcgaactcctgacctcaggtgatccacccaccttgacctcccaaagtgctgggattacaggtgtgagccaccacacccagcccagagttttaatataataccttttctgtatcatattcctaggagtaagttatttccttttcatgtatcatatgttgaaggtagaaagttggttacatatggtcacttcagataccaataaaccaaccagcaagaatgttcagaataaataaaaagccatatatgaagaaacaaatcaaatactgctttaattatggttctgctattgtcccccacttgcatttctgacagctactttgtagtttgcatattgtcttttttctaattaacatttttcctctccttggcttttttttttttttttttttttttgctcttctgttgactgtatagccttgcgtttggctcttttatacctgttaatagtaactcatgttataactcacctttcatttttagttttgggatttagtcccatgtcgttttaaaacaacttaggaaagataaatgtgattttaaaataagtgaaattcgtagaaaagccaaaacttgctttcaggtaaggaataagaattttttgttgttgttttttgttttgttttgagatggaatcttgctctgtcgcccaggctggagtgcagtggcgtgatctcggctcactgcaagctctgcctcccaggttcacgccattctcctgcctcagcctcccaagtaggtgggactacaggtgcctgccaccacgcccagctaattttttgtatttttagtagaggtggggtttcaccatgttagccaggatggtctcgatctcctgacctcatgatccgcccacctcggcctcccaaagtgctgggattaccggctcaagccaccgtgcccagccaggaataagaatgttttatattattcttacaaaccttaaattgaatcacgtgaattttattaaagagaacatataattcataaaagtctggaatttttatacaaataattgatttagataaaaaacaaaatacaacaaaaagtactcccttcccaacttgcttgtactcacttagaatgagtacattttggtaaaattctttaaatgactagccagtaaaaaataaccgtccttctttgtgcttctgattatttctgtttaaacttattatttttcacagaaaattgaaactctcaaagagacaacaaatgtaagttatatgtttgatacattctgactttgcattagaaaatgttttaaaaagttatttctattttaagctgccactattgatgacagcaattgagatgttagtttttatgaatattatacaggggtgcttaagcattgtatttttttttaaaggaatttaaaataatactaatagaataagccccttaatcgaaattgacttcatgtaccatttacctgtttctggtctcgtttgaaatcttgataaaaggtgtcttccacgcacagtggatatgttatttcatattttaaaaaaaataattaatttctttgattcttaaggcagggtcttactatgttgtccaggtctcaactcctgggctcaagcgatcctcctgcctcagccttcaaaagtggtgggattggccgggcgcggtggctcacacctgtaatcccagcactttgggaggccgaggtgggcggatcacctgaggttgggagttccagaccagactgaccaacatggataaaccccatctctactaaaaatacaaaattatccaggcgtggtggcttatgcctgtaatcctagctactctggaggctgagacaggagaatcgcttgaactggggaggcagaagttgcagtgagttgagatcgtgccattgcactccagcctgggcaacaagagcgaaactgtgtctcaaaaaaaaaaaaagtgatgggattataggcatgagccactgcagctggcttctttcttattaaaatatattataattcaagttttctgatatagtggacttctgacattatataatgggctacttatgagatgtgtaccttgctcaaaattttaaaacaggtaaaataataatttgattcaccagtgttttgacaggatcctttattctccatacttccatcaaagtctttttatttttttttaagaaacagggtcttgctgtgtcatccaggctggagtacaatggtgcagtcatagctcactgcagcttcgaactcctgggctcagacaatcctcctgcttcagccatttgagtagctagggctataggcacacgctaccacacacagctaatttttattttaattttttatagagatgggattctgctatgttgcctaggctggtctcctagcctcaagcgatcctccttccttggcctaccaaagcagtgggattacaggtgtgaatcaccatacccagcctatcagtgtcttaggtagatttcttagggttgcttgctgttgatgtaagaattcgtaagttaatcagattcgtatgtctttctgtttgaagtgttgaaaaaccatttagagccaagcacggtggcatgtgcatgtagtgccagctactcgggaggctgagacggggatcgcttgagcctctgagtttgaggctgcagtgtgctataattgtgcctgtgaatagccactgcaatccagcgtgatcagcatagtgagaccttgtctcttaaaaaaaaaaaaaaagaaaaaaaaattagatattatttagtataaattaacaatttgtggcattcgttaaaattcatagaactgctaatgaataacttcatttggcattatcagcatactagaacccactagatccaaagaggatatttcttgtgtagtatagacttaaactctatacatctgaactgatttttatattttaagctttaacattatatatccatttatttgagccaagatcctaaaatcagtgttttgtttttatagagcatggtagaatcaattaaacactgcattgtgttgctgcagattgccaaagtaagtaaattttactttcaattacctttgtgtatggagttcaaaaattataatggcgtttttctttaatagcaaaaaaactcagatctgaaacatagtacctttctacattaaactgtattgtgagcttattctatggaacaactgttgtgtttggctattatcttagctactgtttctggtaatgtcatttctggtagctgggaaggaggggagcatgtttgaatgactcatcccttccttccattttatccattatcactgcttagaacagggacatattttacaaaaccttccacaaaaaaagtttttcttagaaaatagagaagtaagttctgacagttattgtccataatgaagaatataatagagatatattttttaaatttttacggatttttttctggtagtgaactacgttagtggattttaattattcttccttattcatgaaacaaaatatattttgaattattgtgggttaaaaatttcatatatgttgtctctttttctgaaaaattttggtgtattcaacctaaatatatattttattgcctgagagtttctgaaataagaatattattgtttgagaataggaatttttaaaactatttctacctcactacacccctttatttccagcaagtggctagcaaggggtgggtgaccagctccacagcccagttgagaaatgttgtttgaatgagtttataattactcatctcttttacttcttcagttgcatatgtttgtttgccaaatcatagagacttttaacctactgttgttaatgacacaatagcataggacagtccatttgcatttggatagtaaggatatttagcttataaattaaatggggcaatgtcattttcttttgaggcctgatttaaaatatattttttattttttgagacagtctcgctctgttgcccaggctggagtgcagtggcacaatctcagctcactgcaacctctgcctcctgggtgcaactgattctcgtgcctcagcctcctgagtagcgaggttacaggcatgcaccaccacgcctggctaattcttatatttttagtagagatgggggtttcaccatgttacccaggctggtctgaactcctggcctcccaaagtgctgggattacaggcgtgagctaccaaacccagcccaatgtattatacttaaagtgtcagaacttagggcttatgttctgtttctagatgttagtgatatctagatttcctatgtatgtgtctaaatttttcatttcctgttgtagatcatagtatattccaaagccaagcagaaggaaagataggattggaggcacaaaagagataaagtttttattttagtttttcttggctctggaattacataggtgagtagaagcacctatagttatccaaaagcttacctacagataaccagtaaaccacaccatgccctgtttgagtgactaggtattttagggaatacatactgccttctattgaagattggggaagcagaggagctgatacagtgtttaagccagtttgggtgatctctgaaaatcattcaggactttagatagttgtacagtaggtcagcctagcctatttcagtagctcactgtttagccactcatcgagaacatttttagtgtaatttgtacttgctacctgtctgtgttagcccagcttaataaaactacgttttagggttcttcgcaatggataacttggatcacgtaaatgaaatttggccttttatttattccagaaggaagttttattgttgttaagtcttcttatgtacaaatacaatcctcaattatatttgtactgtatatggactctgtatctttaaacttaatttaaatgtaaatgagaccgtgtcacttgcctgctcaaatacccctgatgttttccatctcatttggaatgaaatagaaactacttacgttcactgccctcttacctgtctcctacccttgcttggtcacaccattccagtaacattggctcatttctttttctcaggcaagacaagcttcccccctccacccccgcccccggctttagggatttttacttgctgttccctccacgtggagggcatttaccacagattgccactaggctcactctctcactttattcatatttctgccacaaggaacatctttggaaagacttttcctgactcctgtatctaaaatagcctatacctcccactggtttctttttcttcgtggcctcgtatcactagtcaagtttacacgatatatttgtttgtttatctctttattgactgtctaccctagagtacaatcttggtgaggaatttgctcgtcttaccacttgtattagtctgcatgggctgccataacaaaataccatagactgggtggcttaaagaacagaagtttattttctcaccgttctggaagccagaagtccaagatcaacattctggcctgttcagtttctgatgagggtccttctcttggcctgtagatagccatgtcttcacatagtctttccttggtgagtatgcacagagagagggagcgtgcacgtgtgagatagcaagctgtttggtttctcttcttacaaggacactaatcttattgaatcagggccccacccttatgatcccatttaaccttagttacttctgtagaggtctcatctccaaatatagccacctttggggttagggcttcaacacaggaatttggggagggacacaaacattcagtccataaccccattgtatcctcagtgcctacagttgcttaccatataggaggtgcctgataaataactgaattactgagtgatttttctaatgcattacttttaatggttgcatggtttagtattttcactatatgtatgattttttttacttagccacctctctgatgtgctgtgatgaccatccctataaactaatctttaggtaaatttaatcagttaatctatgattaagataaaagattttaaaataataacaacagtcaactttgcatagtcttaaagagcgtggattatggcccccagactgagtttgaatccaagccccaccactggagcaagtttatttatcctttctgtgctttggtttatattccatatacaagagggataatagtaatgtctgtctcttactgatgctgtgagactaaatgattatttgtgatgctcttggtagctggcatgtaataagctctaaataagtgtttattaaatttaaaaaaagaaggatgcaaattttaaagtgacagtaacacatctggtaaaagttggagaacttccattgagtactgatggaaatataaattgttatagccactttggcagactcttattcactggcaggttaataaaataccagaatcaactactttgagggagataatgccatttgagaccccacagtgatatgagaagatagctaatttgatacctttcttgtttggggctgattagtatcagcttcttagaggcggcatgctgtaagtaaaaattttaattttaagctccttccagttttgattctttgatttgaattcctattcccagtagattctctcctgcctaaatgattagtgtattggttcctaaactttactgcatattggagtcatttggaaatcagttctgattcctggctcccatccctagacattgtgttataattctgttgtgtggggtatcacctgggtattgggattattttaaaccccctgggtggttttaatgtgcaacaaagttttgagaccacctggttagtggaattttcaagtgggctttgttatctcagaagacatccctccccttacccttggtggagacagctgatgttcttctcctgggagactgcagtggagctggggagtaaggggagagaaggggagtagggcaggacagagtgaagataagctaggaggcccctgcaggtggagacttaaccagtatcacagtcaggtgatgtgaccacataccacaactcagaatgcctgtcagaatggcatgtgccagggggttgactgtgatttactagaacactatttttgcattgtttaattatcactgaaattgggaaaaaggctatgctagacatgctttggttttgaggtatagttgctacaaacttaaactctggttgattttcaccagttaaatcatgcggtaaaacagtatttcaatacaattaaaatcaggcactttaaatggtcattcttacaggcaaagatagagactattaacatttttcaaggtagacacagatcaatttgatttatgtagtttttatagtcttgcataaaatagatgcaaataaatactgttgattacttagaatttgaggctttaattttgtcagttcctgttgattatcctaagtctagaccagtgctatacaataaaaatatgagagctataaatgtattttaaaattttcttataacatttcgaaaggtaaaaagaaacaagtgagattaattttaataatgtatgttagtaacccagtgtaccaaaaatattatttcaacatgtaatcagtataaaaatttactaatgagatagttcatattctccctctctcttctttcttactctctctctcattttttaagagatagtgtcttgctctgtcactcagactggagtgcagtgtcacaatcataaataactcactgcaacgtcaaactcctgggttcaagcaatcctcctgcctcagccacctgagtagctgggactacaggtactcaccactgtgcctgactaatttttaaattttttgtagagacagggtcttgctttgttgcttagactggtctcaaactcttggcttcaagtgattctccgtcctcggccttccaaaatgctggcattacaggcatgactctttctctttttgcaccaagtcttcaaagtcatggatgttctttaagccacccagtctatggtattttgttatggcagcccaagcagattaatacaagtggtaagatgagcaaagtcctcaccaagattgtactctagggtagacggccaataaagagataaataaacaaatggtttatttcaatggtttttgttatatttacaaaattgtacagccatcaccataatctaattttagcatacttctatcaccgcaaaaagaaaccctatacctattaagcaaatattttctatatagattttctatatagatggtccctgacttaataatggttttacttaggattctttgacttcatgatggcagaaaagtaatatgcgttcaatagaaactgtactttgaattttgagttttggttttttcccaggctactggtaatgctatatgatcttctctcactatactgggcagtggcagcaagccacagctgccagttcgccacgcgatcacaagggtagccagctgaaactctgcactgtgtactgtgttgcgagatggtttttgcccaactgtaggctaatgtaagtgttctacaacacgtttaaggtaggttaggataagctatgctgtttggtaggttagatgaattaaatgcatctttgacttaacaatattttcaacttaagatgggtttattgggaggtaaactccattgtaagttgaggagcgtcagtgcctccctttctcttccaacagcctcctactcttcaccccatccagcccttggcaactattaatctactttctctctctagatttgtctattcttgactcttcatgtaagttgaatcttacaatatgtggtcttttgtgactagcttctttcacttaacatcatgttttcaaaggttcatccatgtagagatcacttttgcctggaattttgaatgtgactacagttctacaggatatttccacgatgaacttagttaaatccctatatagaaaaataattgccatgctgttggtgttgattgttgtgtagccagagttagaattgtgtttggctaagaatgtacacatggaattaaaatcttagtggaggcagataaatcatgttctaacattattacttacctagtaaataagctttcttgtaggagaaatacacaaggagttacttacatgtaagaatgaagttaatatttttaacatttttccttaaggaccagagtaatgcggagaagcacgcagatggaatgatagtaagtttaatgtaatctttttgtttccctttacttctgcagagcattataaccagtcatatcaggagaagcctgaattactactcatttttcaatgccaactactcactgctttttgttgttgactcttgcagtttcctttaagctcccttctttcagcaatcatttgcaggggaaatgacaatcttaaaatttttctaagtgtgggttcagattgaatcactttgcatgtattaacttgaagggttaatcatggtatgaatactcagcttttacaattaaataatgcataactcagtgccacatttcttgtctaatttctatttttctcagatgaaagtgggggtgggggagtacaatattgaaacacaccttaatctatttgaatatatttataggttcctattatcttttatttttagtttttgtgtatgtgttaaccatcattgttaatgtggtatgtactgcatttttgttggaacaatttacaacatgaattctttctcttataaccatcttctcactctttcctctctcttatctttttacctttcctttatattcaacttcccctccaaaaagaaagaagaaaattgtattgttagtatttcccagatggaaataaaagagtttgaaggtttgtggtttgtgcttaccctagttttatggtaactgagtgaccttagtctgtattcctgaagcaggaggcagcttttttgtttgtcctagactttacaaatgccagcttgtctgagatctggaaaaacattctgtaaattttcaaaaacatctcctgattgtacttgaaaggatgagcatgttatctttatatttggtttaaaaattttttttaagttaaatctgtgtttgcgtatttcttaagaaagcagaagtaaaataagcatgtttggaatttgaattaaatatatcagaatttttgtcagttcaaagtatgatccatggtgatataatacaattgtatgatataaatgtaatacaaactgaaataatatctcttcatgagatactatcgaagattgttagcctcataggaaaggactgtatgtattgtctagcattttatggtctccaaagactccaaaggaaaaccatgttggctgttatttttatctcttttccctcaaagccaaattagttatattatgttaaataaaacaggcaggattttataaaacataccaaaaacacttgatcatttgcaatgaaaaacatctagaaagtttatactcatagaaaatttaacctaatagaaaaatatctttgaatcatttgcccagggactagagcatattttccttaagaatttttattttgaaaaaatagaggaactattcatggaataggccttagaggcaggctgcttgggttcaaataaaatagccctgccactcactacctgtgaccttggcaaattacttaacctttctgagtcttaatttcttttcctgtaaagaaagctgaaatgttctaccttagaagtttgttgtaaggtacagaacaagcgcatagtattcaatgaatgttagctatatgtacatgtatgtgtatgtgcaatacattgtattacgtgggtttcattaatgtcaaaacagattagggctgagtagtattatttttgcttctcaagttctgcacatttatttttaaagcaagttgtagaatgtaatgtgacatatttgagcctgaagttggctgaccaaggactgtggataagtgtagcatagttattttttctatcaaaaacaataacaaaaagattgagtacttttaatatacatgttgtcaaaagacaaaattacaacaaatttaatcatagatctaattggcttttattcaagatgcatgaatcggatcagcctccattctacaaaatagaatgagaggtctcactgggcagtggcaaagcagtgggttttgtaaggtgagaactgtaacaggaaaaaatgctgattggttaacatcagattacttttcttttaagggttaaaacagtgagcatttccgtattacactgattcgggtagactggaatctcctattttcagaaaaaaaaaaaaaaacctggtctattttgggatccacttgcttccttagagtttaatgatacggcatttaacaagagtgactccattttggtttggtctaatctgttgggccctagtacaagagctcagtccaaaacagtggcctctcataatttttgtttaacagtgcacaaagtttttaagtgttttctttggttgaccagcctaattgtaagaacgtttcatctggaaaataaaagattacatccaaaagagaattctggtcccttgttccaaagttattttatttcttattcccttcagtgggaggggtaaggaggtgtgacatattctcactgctatatatcaaagcgttaatggtggaattttgtctttgtaaagcatttggagttattttcgagaaaagcgctgtgtaaacaaggaatttattttaagaacaactccatgtttgttgagatacttgtttagttattatggcttggtctagtatctgaaaatagaatcaaagtaataaccagaaaacccttagcacccatgtaaatacagactttttattttgcagaccgggaaactgaggcccatagaggataagagacttaaagattctaagctattaaaaactccaagtctctgtttctttgcttttctcagtgcttcaaaacattccccacttcagtttcttagttgtttttttttttaattattactgattgttttgggggtgttttctctaagtgtccttcatttttcagttaaagtatttgtggcagataaactattttagtgacaagaatcagaattcctgtgttcaagtcacttgatcgaaaagaccttatttaatgagttttagatattcatgcagaaagagggctgggtttttttggttttaaattttctttaacagtcctgaacacagtgtatgtttgtttttcacatggcctggaaaaaaatttttaacttagatattacgtgagaatgctacaaaaactttaccattacctcagtttctattattaggtgattttaagtttttacaactgcttttttgggcttatttattggcaaagtatttcccttatatttctgttttagtatcttctgttataagcactacttaatatatatgtgaagttcagttttccagatcaattaaaggtaaagaacttacatttttatttcttgggtttgcccagtttagtcttctaaatggtaaatgtaaactttgctgtggcaaagactttggtttaacatgtacacactcgcacccccctgctgccctatggagttttctttttaaaatgccttcatgctgtcagaataatttcttgacttagaatcagagaatcctagacttttctcccctctaaaattaactacatgtctgaatttttctccctctcttctgaatcctcagaaagcaagccctcttctctacactccccagttagaagatgcatctctttctctttagtgaccataaaactagacacacagtcagccttctgcatctgtggattcaaccaaccatggattcaaaatatttgaggaaaaaaaaagtacctctttactgaatatgtatatactgttttccttgtcatgatttcctaaacaatacagtataatggtgatttatataatatttacataatattaggtgtcataagtaatttagagatgatttaacttatatgggagcgtatgtgtaggttgtatgcaaatactacacgatattttatcagggacttgagtgtctgtggattttggcatcctcggggggtgcttggaaccagtccccctggatacctgaggagtgactgtactgtgtgatagcagcagtatgggatggaaagatgagatcctagtggtgcaggtacatcagttggacatttggtgtaactcaccaaaagtgaaaaaaacagagaaacaatatttgtggtgaattaagagattgagaagcaccgaattgaattgagaggtggttttgacttcctgaaatctccccacaccattttataactcctcagtttttccatttagctttaccttcttctgtgacagagattcattcattgtctttccttactatgctttaagcaactcttacacttctgtatagaaaaggtgtttcattccctcttttcattttgatcaacatatctatatagctaccctcaggattttgaagtcataaatgtgggcatttgggagggtagcatgagaagagcatttaattaaaaatagctatattgtgtttctttattttagagtactattaatcccgtagatgcaatatatcaacctagtcctttggaacctgtgatcagcacaatgccttcccagactgtgttacctccaggtaatttgggaaaatgtttcttagattcattgatgagaaaaaaataatttgtgtggctgtcatagcagtcttagctattactgtttatttttgattttccttgtttttaataaaagcactcaaaaaataatacagccaaaagtgaactgaaaaaagatgataatgttttgatattggggctttactgaagtgtgatgaaagtggttttgttattcaaagtgagatagaaaacaaacttggttactacgatttggattcactggtagaacaggattctatgactcagaattcatggctagcgaggaaaaattactataccttattctggataatccagggatgttccgttttggggtattctgtgtagctctgaacaatacaaatggtatgttcatggtagattttaagataatgagaaagtgaagagggaaatttatgatgcctactgatcacatgacatctgggttttgttttgttttttttttttttgtataaagcaatacatgcaattttttaaaaactggcaaagaagggctcagggccaatacctagctacactgactgattccttttgcccttttgttatatccaacatttctatgttctcgatggcatagtgaagtcagaaattgtactgtaaaatggaaaactctttttaaaagtactagtaagtatgtgaaatccttttgtgagtttttacttcttaagtgaattagcttaaactacctcttggggctaaagaggaacaggtactgtactccacttcagattttttgtggtttgaggctcagaaacacattatcatcagaagcatttgttggttttacagcatagttatactgcagtattggcctactgtggctggttttttgatatcctgcctggtatcttagtactctgtagcctatcatcattgagtttaagaggctaggaagtcaaaaggaaggagtagcatggaactagacttaatgaaataaagtttcaaaaattactggcctttaggattttgaatcccagacaattacagtcaatagaatgtgtgtttggctgtttctgtaccttattttatacgttcaaatctcctagaacctgttcagttgtgtaagtcagagcagcgtccatcttccctaccagttggacctgtgttggctaccttgggacatcatcagactcctacaccaaatagtacaggtacagatttgcataatttctttatgtctcataactctattaacatttgaggtttgtttgtgacctctgatgaggagggggaaagttgaagaaatgtgttgtatattttctgttggagatatgttagttttaacattatagttccatacatgaagtggttagctttgtgtttgaaagagaagctttagttaagttttatttatttttaagtttttaaaatttttatttttgagacagggtctcactctgtcattcaggctggagtgcagtggtacgatcagggctcactgtagttttgacctcccaggcctcaggctcccaagtagctgggaccacaggcacacacaccacacttggctgatttttaatttttgtagagaggagtctccctatgttgctcaggctggtctcaaactcttgggctcaagcagtcttcctgcctcagcctcccagtgtgctgggattatacaagcatgaggcaccatgcctggaataatttaaataaaataaaatattacagagttttgtttgtttgttaccttaacatttatttggtgatctatgttgactttttgaaaaatttactccagctagacttgcatactttcttattatgaagctgacacagaagtgcacagaataaaaactgcaagtcctctttactctccccccagtaatttgcatacatgtatgtgcatatacacttatgtcgtgtatttttattgtttttgtttaaacctaacttaggttatgtgtttctgtgacttgcgtttttcctttaacaaagaacacttagagcactttccatgtttgtaaaattaggtctacagcattctttttacagctgcctgggcaggtattgcttgttttttccactgatggaagcaatacttcagtgatatccttgtacagcacctttggcatatgtatatttttttagaaaacatttatcagtctttcacctttttgccagttttatagttagaaaaaagatacttcattttaatttgcattttctttttgtttgtttaaacgttttgttttttgtttttgagatggagtctcactctgttgcccaggctggagtccagtggcactgtctcgactcactgcaccctccacttcctgggttgaggtgattctcctgcctcagcctcctgagtagctgggattaaagatgtgcgccaccacgccccacaaatttttgtatttttagtagagacggcatttcactatgttggccaggctggtctcgagcttctgacctcaggtgatctgtccacctccacctcccaaagtgctgggattacaggtgtgagccaccgcgcccagcctgcattttcttaattcgtttaggcttagggtctttattttttctctgttttacagggatactatcagtgttagatactagatttatcttgttttaaaattaattaaatgtatgttgaataacttgtagaaccaaactcaaggaagcatctagcacttttcacactgttaaacctggaaaccaaaaccaaaaccactcttgaagaagtgggagatcagccccttttgttcatcctcagatttttttcccgggtaggatttttcctgtgtaatgatgaataattaccctgtgatttaaaaaattcgaattagtaaaagtactgatgctattactttgatctttactatttaacagcatgggcagttgcctttgaattttgaaagaaaaaaaatagctctcttacttgaagctcttgggaaaaggctgataagcaatttgaataatgaaattgaaatattttggctgacttctgtatttcctgagctgtgtcacctcttcttcatttaaaaaatagtacctgtttgttgttgttcgtatttttatgttggaattttgaaacaaccaaaattccaaaatttttctgtttggaaatacgtaaaactagcaacagactttgagaaagtgagaagctcttcttatgtatattaatttttgtaaaaattacttccagaagataatcttctgaaaactatttcagttgaaggtatttcaaaaatctaacactttagagtagatttaaagaaaaatttaaaattaaattcctgtgatttatatcttatttgatttttcatcctaacttcattttctccacttttctttcccttacttctcttgttaatacaaaaaagaaataaaggaataagataaaatgtttgctctcctaagtaaatctcagatcttttgtttgcagttcccactcaaacttttcttcttagatacagtttcacttgtgtgatcacctggaatatttgcatgctacttaatcatttgcaattcttgatcaattttttttttattccaataagaaaaagctgcttttctctcttactttttctgttgggtaataaaaagaatatgaagttatttactaataaggtgagctacctttggaatttccaaaataagcattaccttttaggggttaaactttttgtgttatctttttaaaatacctttgtgaatatgatgactaaatgtggcaaactgatgtgctttttttcacaactattgaaccatacatataggaatgggcaaaaaatccgtaagtgactctggattcttttttttttttttttgagacaaggtctcactctgtttacccaggctgtaatgcaatggcacaaacacaactcactgcagcctcgacctcctcagattaagtgatcctgccccagcctgtcgtgtagctgagaccacaggcacatgccaccatgcccagctaatttatttatctatttttttaagagatggggctctcactttgttgcacaggctggtcttgaactcctggcctcaagcagtcctcccaactggtcctcccaaagtgctggaattacaggcatgagccattgtgcctagcctggattcatttttattgctgtcttcaatttcttccagaactgtggccctggctttcagattgccatcagtgtcttaataaactttagtcttcaccagacatctgtagattagtataaattgcctgactgacagcccttaaatgctcagtaagttaaattgatcttaatactccatttgtcgattggtttgatacttttttgttcttgctttactagtagataaggtaccagatgatcatctcagagattagatggcaggcttctttgtctgggtcttcattaatttccatttctttagttagactatttaggaatagaaaaatgttcttctgaatcttttcattttctgcattcttctcatcgtagtcctctatttttatctccacctctgagcccctgacttaggtggaaaagaggagaggaatttggatggtgtgtgtattttccatgtgattgccaaaaaatattgaatgataggaatgtgatatcctgcaatattttaatgtttatgtggtcttaatattcttttcattttgcattcccagtggctcactgctgcatttttaggtatctggatctgcagtgtaaaataagagtcccggcatcccattgtaatcatatctgttgttggacttgcaactccacaactcatataatcaaaagggcccccttcctagtattaatgataatctttaattatagaatgaggacatagctttttgtttcatttatttaaaaggctgtgtcctcattttatatcatgatttgccattttctgtgtggagtttaaatgttgattttctttataaatactgtagcgacttttacaaacttaaccaaactcttttttgattttagaaaagtctgctttgactccatctccctagtttcttctctttcaccaatatttttctctaaaacccttttaacttcctaggcagtggccattcaccaccgagtagcagtctcacttctccaagccacgtgaacttgtctccaaatacagtcccagagttctcttactccagcagtgaagatgaattttatgatgctgatgaattccatcaaagtggctcatccccaaagcgcttaatagagtgagtagatgaacagaatatgtatttaaatgattctcctgatttttaaaaatctaatttgattttgagactagtgttaatgacagacttgcctcatcagttattatttgggaaaattaaaagggcaacctttttaatagaagtttttttattgatgtataatagttgtatggacaacttgtttttggttggcttattgagcaaagccagttctgtgagagttttgattttagtcctaagttaatccaagtggaataaatagcatcacctatagtaatgtgccagcgttattagttgaaccctggccgtttctacagtaccaacattaggagagggtccaatgagagtgaataagctatgaagcattatacaaataagaggtttctattacttttttctttttttaattagagtggaaatattcaacacctatcagccaggcactgtgctaggttgatatcaaggttacaaagatccaggccctgcccacagggaacttttgggggaataggcagacatttataatctaatgaaatacgtggtatggtatcttagtccctttaagctgccataacaaaatacagtaatctaggtagcttataaacaacagaaatttatttcctacagtgttatggagcaaaaggggcttgctgcccaatgtgctagaagccattactaagtcccaggtttttgaggaaagaaaagctttttattgcaagtctacttacagggaaatggaagtccacctcaaatctgtctctctgcactggctttaaggcactaattttatttaaaaacgtttagggaggccaagtgtggtggctcacgcctgtaatcccagcactttgggaggctgaggctggcagatcatgaggtcaggagttcgagaccagcctgaccaacatggtgaaaccatctctactaaaaataccaaaaaaaaaaaaaaattagccaggcatggtggtacatgcctataaattccagctactcaggaggctgaggcaggagaatcacttgaacctgggaggcggaggttgcagtgagctgagatcacaccactgcactctagcctgggcaacagagcaagactctgtttccaaacaaacaacaacaacaaaaacagtttagggagccaggtgtggtggcttatgcccctaatctcagcaatctgggaggctgaggtgggaggatcagttgagcccaggagtttgagaccagcttgggcaacatggtaaaaccctgtctctaaaaaaatacaaaaattagctgagtgtggtggcacacgcctgtcgtcctagctactcgggaggctaagatgggagaatctcttgaacacaggaggtgtaggttgcagtgagccgagattgggctgctgtactccagcctgggtgacaagagtgagactctgtcttaaaaaaaaaaaaaaaagaagtagaattactgatttactttcattttacttgtgtttgttgtagatgtattaatagcttagtttttgttgggaattacttctaattctgctttctcaggggactgttactatactgttactatagctagggtttttgctttttaacacagtacaaatttggaaataattaaatgtaaatttgcaagccaattaccttcagccagtcctatgtggtctaggtgaatatatatagttaagacgtggaagggaggtttaaatctacaactaaagaaggccagtgtagcagaaagggcttagtttagcatattggtttctttttttcattttgaatgttaaaacataaactattgagaaaccattgttagcagtttgccaatagaaatttaattttggaaaaaaagtttttataataatggggttaaaagaaaataagcatttggaagaaaattcgaaaatgaaaggttattattaatttttgaagggttcagtcattattttatttaaaagagaattaaagaccgtctttttttttttttttttttttttttttgagacacagtctttgtcgcccaggctggagtgcagtggcgccatcttggctcactgcaagctccgcctcccgggttcacgccattttcctgcctcagcctcccgagtagctgggactacaggcgcccgccaccacgcctggctagttttttgtatttttagtagagacggggtttcaccgtgttagccaggatggtctcgatctcctgacctcatgatcagcccgcctcggcctcccaaagtgctgggattacaggcatgagccaccgcgcccagccttttttgagacggagttttgctcttgttgcccaggctggagtgcaatggtgcaatctcggcctcctgggttcaagcaattctcctgcctcagcctcctgaatagctgggattacaggtgcccaccaccatgcccagctaatttttgtacttttagtagaggaggggttttgccatgttggccaggctggtgtcgaactcctgacctcaggctgtccgcctgcctcggcctcccaaagtgctgggatcacaggcatgagccactgcacctggcctaaagacaatacattagctattgttctaaaaaagtgcaattgaatgtcacttgctagtaaatcactcatgtatccatcctttaaaagcatatgactgtattcagtaaaagcttgataatatgtggttagctcttggtaacatcactgatagacactctctggctccgttttgagggattctcccaaaatttctatgaaatcgaaacatttaaaacacctgttgtacctgtaataggcaggtctacaaagtcatgcacaggctcatgggcttcttctattcctgctgttaaggttccttctatgctctcccagtaccctgtcccataataaacacacagttcatgaacatctctttgaaagggtccagagttaagtttttatgtccaactaacccactctgtgttccttttctccctcaatttcactcttccttgtttgtatattctaatctagaagcccaaaccagtaaggactgcagatgttttatttgggcagcacagtgttctgttgacttgttttttgttttgttttaacaaggctttagattctttcaggttgggtatgctgactccccagttccatatatatcttatgtcttggtcctatccacatattctctgcctggcatctgtagctatttgagcttgtgacacctgctggtcatcagctgctactgctgattttctaactgaggtcaaatttctttttactattttttgtttttctctttctgaaggaagagaacttgaaagcttaagtcctttcactgttctttttctaaagacctatactaatgatagcttctgtgtaactatggcactgagcactgtagtttacacatttataaattagataaaagtacatgttggaaagaacttgtactttggagccagacgtgtttgaaatggctccactactcaccagctgtatgacttcagaccagtcattgaacctccgagcgtctgtgtattatgagcgtcattgtgttttccttagggttgtaatgtagatatagacataccgtgtatggtgcatacaaggtactcgataaattattattataattcatagctttaaattgtttttgcatactttatgattttatgcctaaattctagacaacttagcccattgcagataaaactttcctgtatacataggtgttgtttttaactgttttctttatatcatttgttctgaacaaggtaaattatgaaatggctgaaaatttatcccattttttttcaatttacagtcttactgagtatttcacttggctcagacatggtttctaatcatgggtaaggagaaaaaacacagcataaataggacctttgaaattacatctaaaataagattcatatgttataggatttggggtttttaggtcaattgatttaaaagattgactctattttgagatacatcacagaggcacaaagcattttaaaggtaactttcatgcttttttttgagacagagggtctcactctatcactcaggctagagtgcagtggcacgaacacagctcactatagcctcaacctcatgggctcaagtgatcctcccacctcagccgccccagtagctggaaccacaggcacacaccaccatgcccagctaattttttttttttttttgagacagaatctcactctgtcgcccaaactggagctggagtgcagaggtgcgatgtcggcttattgcaacctccacctcccaggttcaaacgattctcatgtctcagtctccaaagtagctgggactacaggcgcatgccaccacgctcggctaactttttgtatttttagtagagatggggcttcaccatgttaaccaggctggtcttgaactcctcacctcaagtgatctgcccaccttggctttacaaagtgctgggattacaagcctgagccaccatgcccagcctaattttttattttttgtagagatggggtctcaccatgttacccaggctagactcaaactcctgggctcaagtgatcctcttgccttggcctcccaaagtgttggaattacaggcgtgagccatcatgcctggccccagttctgtcatttaatgatcatttgatttctcttacctgtatcttttagacatattttccattgcctctcaaaactggtgaggtggacattagttataataccttgtgatatatactactaaataatcaaagaagtaatacttagttactcaagaaattttgaaaaataggtaagtaaccagggcaaactagaataacataatatattctaattttagaatatcctaatattctagtgttctaatacaggcagagcccagaggatttttacagcagtgaaactattctgtatgatacaatggtggatacatgttgtcatatatttatcaaaaccgatagaacaggcaactccaagagtgaaccctaatataaactgtagactttgagtgataatgatgtgtcaatgtaggctcattggttgtaagaaatatacctctctggtatgggatgttgatcatgagggaggtttgcaggtgtggagacagggaatgtatgcatgctgtctatattttctgttcagttttgccatgaacctaaaactgctctaaaaataaagtttattaatttaaaaaaattaaaagaagttaagtaacaagggcaaattatgattagattagaatacatgttttcgcacgtgtagagttgtaataagactcatgtgtactgttttataaatatctaaagcgtgagaaatttgatttcaatttttacatttaataagtaaattgtgtgccttttttatttttcctttatttatatacaaataccaactgggtgtggtggctcacacctgtaaacccagtgacttgggtggctgaggtgggaggatcacttgaggccaggagttcgagtccatcctgggcaacataaggagaccttgtctcttaagaaaaatataaatatacgtgcgtgtgcgcgcacacacacacacttccatcggtaaattatgatcacaggtatgataatctattaataatagaataatctttctttagacctgttaactggctcataaaagccagttagcatgaatttacttgcataaataagatgtttttttattttataatttcaagtacagttttttaatgattaggaagagtgttaataccaatgtgggcttttattaaaggatctcaaacataaagacaagacatgtttctgagacttgccgtttctggaattgttgccaagaattgtgacatatttagatttatacccagtaacaaaatcataaaaggaactctagttttaaacttaaatgcagaggcaaagatctcactaatttttgatgacttctaggtcttgactatcaacatggctttgttgagcacatcctgtgcataaaggataagacaagagaccttgtcatcaagagaattctaaagcatatatatgcatgcatgtaaccagctaactgtacgagtctagcttactatgattctaaattgctttctttagcttaaataaggtaattaatgtttttatagttcttctggatctgcctcagtcctgacacacagcagctcgggaaatagtctaaaacgcccagataccacagaatcacttaattcttccttgtccaatggaacaagtgatgctggtaagtgacctttgataatttaacttttttttctttaaaaatatttgtggccagatgtggtggctcatgccgtaatcccagcactttgggagaccgaggtgggcagatcacttgaggtccggagttcaagaccagcctgaccaacatggtgaaaccccatctctactaaaaaaatacaaaaaattagctgggcatggtggtgcgtgcctgtaatcccagctgccaaggaggctgattcaggagaattgcttgaacctggaagatggaggtttacagtgagccaagatcgtgccattgcactccagcctgggcgaaagaatgagactccatctcaaacaaacaaacaaacaaaattgtaattctagtatcaggacagattggcccaatttagcaccattctaataagatctgctttattttagacctgtttgattcacatgatgacagagatgatgatgcggaggcagggtctgtggaggagcacaagagcgttatcatgcatctcttgtcgcaggttagacttggaatggatcttactaaggtaagaccaaatttgctgtaagtctgtgtgggtatgtatggattctcagtgattgcgtggtgagtgtgcctgcaaatgtagtaaaatgacataatttctttttatacctgtgtcttcttgtgatttaatatagatgtagataagtaaacaaaattttataaatgatgaaataagtcaagctaggataatttcatagagaacagtgtgtatgagttgtatggattaagatttggtagagttctaatcttagggtcagaggatctgtgttttcgtcctacctctaatattagcaaaccacgcacggtcttcagtgagtttcttctgtttcttcctctgtggacttcagggttctctatgcaaattggacacatagtaacctgtttcagagggttattgtaaggattggaagaggtagtaaatgtaaaattgtgacatatttgtgacctctgtctcccaggttcaagcgattctcctgcctcagcctccttggtagctgggactacaggcacgcaaaatgacacatattgagtcatgcaaaattaccatagtctggatttgaatttgaatttaaacttggagctctcaacagaatgcatgcttgaattaggagactggtgtatgggtgcctttgtatattcctgccactgtgctagaaaaccccctcctttcacttaattctcaccacagtaccacagagtaggtgttattaacttcatttcatcaggaaactaaaactcagaagttaagtaatgtggctgagtcgtgttaagtcatattaagtggcagactgagattctaatctgctccatgattttaaaacctgtaatctttccactactgcctttgtcttgaaggcttgaactgtattaactttcatattgattattgttctgccgagctttggggagttgattaaatttagagttctcacttttgttagggcaaaatcaattccagtgttatagtctttgtcagtagtgaactcctttttgttttggatttagagggccattaagaaaaagactaattcataataccttcaagtaagtgtctgtaataaaaccttttacccctaatctaagtgagaacagagacacaaggacaacttttatttgtggagcccaacacacttactaggaatgttctaggtaggagaacatttgcaggagtttgtccccggaattgcttcagtaatcattagattgtacagctgctggcgttgttgttgttgttgttgttgttgttgttgttgttgttaggaaggacgttgttttccaggagtggctcattaggcttcctgttgaatctcattggccagtatcaggcatatgctcgtgcctaaacctgccactggcaagggggaggctaaatgattggtttaaatgaatccacattcaccccttgagacgtggaagagaaggccatggcagcccacagctgaacctgaactgaatcagagttcttgggggtgaagcatggatggggagaggcaaccagatgtatttgccacaatcaagtttgtaattcttgcctcacataattttctctgccaaataaaccatatttgagtccatagctgctaaaagcttgttatattataaatgatattatcataattattttttactgaatgtgtttaaaataagtcatttttgaaatttttattggcacaaatggctgtgattgccaacagattctgaaatcttggttccttttatgcattccaaagtattgttacaataatgccttaaatttgtgtcttttataagaatgttttctcacttcagatactttccaaaaagagtttgttttccaaatactttgtagtttttaaaaatactacacagtcacatcccatttaacctcactcagtctttaaaataaaagaaccctaacatataagcagggcatgtaattatcttccttttcaggtacttagagaaattgagttaatttttcagggcctcctcacagctaagaagaggctaaacaagctcttgaacccaggttgaagacagctaaacccagctctcttcatcactgttacagcagtttgacttaatagcatgtatcagtatagcactacaaacattgaagaaaatctgttaaataagagttctcagaaaaatcctaagtagaagaaaaaaatatttattttttttaaattacgtgtgaaattaaactttttaaaaatgttttttggctgttcagttcctttgtccatttatctactggagtagtgatcttcatcttgagttgtaagagctgtttatacattaaaggtatttatccatgttttcttcttcagcatttttactcggtggtttataattctgcgttatctaaagtggtaagaagttgtaccaaggcagtatataagcttccctgctaatctaaccctatttggattatgaatttacatgttctgtggaagaaaaatgtttacctaaaatttaaatgctgagagtctgataatagagattctaagtgttacagtcttagtgtccctttccaagcttgtgttcatcagcccactttatattttcattatatgtccagccacactggttcactgattaatccctgtcacacccctcttcctatcctttccttgtctttttttttttctcccgtctccatgtcttgttcttttatcacagccttactcttctttaaggcttttctctagtgccacctcaataaattgtttcccagctctgccctcattctgttcccccaaacagagcatgatctttccttgaactgaacttccagggtgcttagagcattcttgtatgatgtttgtcacattccacctacaatttaaatgctcttgttattctctcatacttacctttgtctccaccatagcttgcttgcatttatttatttatttatttatttagagatggggtcttgctctgtcacccaggctggagtatagtggtgcaatcttggctcacggcaacctctgcctcctgggttcaagtgattctcctgcctcagcctctcgagtagctgggactacgggtgtgcgccaccacactcaggtaatttttgtatttttagtagagacggggtttcactgtgttggccaggctggtctcgaactcctgacctcgggtgatccacccacctcagcctcccaaagtgctgggattataggcacaagccagtatgcccagcctccaccacagcttttaacacaggaccttgaatatagtggatatgtagttattactaaatgttaagaaatttttgcttactctggggtgttctacttcgtaatgaataattgataatctgatactcatttcaaaaactcttctcccattcccattctctaatgaaattcttctctttttttcattggttaatcatctttctcatgtcttcccgtattccagtttgttggttcccagtctgtattcttttcttctttttgtttattcctttaattgctcatttaaaagtttcttactgtgtaaatagtagtgagagcgcgagtgtgaataaaacttaattcttggattgtaggtgctcatcatgtatttcctatacacttgtctaatgatgatagagcaacagcagtagaaagtgcacacacgccccaaactcagatccagtttgaattccacattaataatgggacaattaatagtgggacgctgagcttcatatttcttcactgtaataatttcttcatcatagggctattgtaatataatatgtatgtaatatacaaataataaaataatgtatatgtaatgtccagcagataggaggcatcaaaggattcctctgagtgagtttgttgagtagtttgttgttgttactatacttagggagaaaaaggaagtttcacagaggaagtgacatttgaacattcaaaagtctttctctgtttttgatctgctaggcaggttaatggtcatttctgaatctgacaggttgagaattagtttttggagcatgcctgggcaatatgtggtggatgttaccatgatttgaatgaggtggtgttttgttttgttttcttttttttttttttagtctgtttatctgaagagaaatttgatcttcaagggtcaaatgtgtatgtttttcaggtagttcttccaacgtttattcttgaaagaagatctcttttagaaatgtatgcagacttttttgcacatccggacctgtttgtgaggtatttgactgaacatggtagtttccaacgtttacagatgttactcagcagctttctgccttttattttgcaggatagatggattccttgtcacctttcaaacatttctgggtattctgtggtattgaataatgtgtttacactggttgcctgtttgcttaaagttatatggtggcgatgttaggcaaccaagtttaacactttaaaaaattctcaagagcccgttaataggtagccaatattcacaaggccaatggtataagtttatttaatccaggcactggcaatcactgtcaaattatttgtactatatcctaatgaagcttaattttctgagttcagcaaacctttccaaagcacctgttgtttgctaggcactttcttacaagttggagaaaggaaaagtcatgtctgcccttgagcttacaatatagtatccaaattatagatgatttataaattttaaatataaagcttgcaatattatatatgtgtatatgtatgagatagaagtaatgtaaaggtgaaattgatttacaaggaggtgagttcacattgcctttcgctggtagcaggaaatttttttgtaatggggaatgttgttagttcgtcttctctgcattccttagtctcagactgtggtttactgaagctagatacatatcactgaagtttcttgctgggtggatacattggctgacattgataaatatatattttttttttcttgatgaagatttaaaagaataaccaattccccaaaggcagaaatttaaataaatatggcagtgtttaaattaacagataatttaagaagtaaaatttaagcatttattagtaacgtgtaagcaaaaatggaacgtaccagttgttcattgggtatagatttgagatttaagggtagtttttatgtgtgagaatttaaactttgaggcccccagaactatttacaggccagttgcagtggctcatgcctgtaatcccagcactttgggaggccaaagtagaaggattgcttgaagccaggagtttgagaccagccagggcaacacagcacaaccctgtccctacaaaaaaaaatttttaataataagccaggcttggtggtgtgcacctgtagttccagctacttgggaggctaaggcaggagggtcatgcagtcccagcaatttgaggctgggactgtgagctataatcacaccactgcagcttgggtgacagagcaagaccctgtcttaaaaaaaataaaagtacagttcaaaagccagtagataagattaaacggaatcatacaaatactccattaattctaagaaaggagaaaaggagaaataatggcatgaacaaggaacaaagggggcatgtagaaaacctattaaaatggtagagttaatcccaactatatcaacagttaccactccatttaatgtcagactggattaaaaaagcaggatttatctatatgatattttcaagagagaaactttaaagacactggttaaaagtaaaaggatggaaaatgagatactatgcaaaacactaaacatagcaaaaactggtgtatctgtataagtatcaaaggagacttttaagacaagaaatattattagagacaaataggaatattttgtaatgataaaagcatctatttatcaagaataaataatactcctaaatatgtatgtacctaataacacagcttcaaaatacatgcagcaacaaaaattgactaaaaagagaaatagccaagtccacaaattcatccgtcagggtctcatgaagcaagtagcctctgccttcaccacctccccgcccccccaaaaaatcaggaaggctatagaagatttaaacagcatatcaaatcaacttgacccagttggcctttctaaacactacccaacaattgtataacacagagtcttttccaggtgcatgtgaaatgtttatcaagatagaacatatatagggaagtcttaataaatttaaaataattggaatcatacagggtgtatattctacacccatgaattaaattagtaattgataacatacagaaaatctccaattatttggcaattaagcaatgcacttacatggacttaatctatgatactagaaaccagaagcagtgtttgcctcagagtaagtaagatgtggcgattgtttggaaagggagatatggaaactttctggattaatggaaatattctgttttttgattaagtgacgattaattaaatagatatatacgtttgtcaaatcctcaagcaaaacactaagacccaggcacatagaccaatggaacagaatagagaacccagaaataaagccaaatacagccaactgatctttgacaaagcaaacaaaaacataaagtgggaaaaggacacccttctcaacaaatggtgctgggataactagcaagccacatgtagaagaatgaaattggatccacatcactcaccttatacaaaaatcaactcaacatatatcagagacttaaatctaagacctaaaatcataaaaattctagaagataacattggaaaaacttctggacattggcctaggcaaagactttatgaccaataatccaaaagtgaatgcaacaaagataaatagatggaacttagtcaaattaaaaagtttctgcacagcaaaagaaataacagagtaaacagacaacccagagagtaggagaaaatattcgcaaactatgcatctggcaaaggactaatatccagaatctacaaggaactcaaacagatcaggaagaaaaaaaaacaaaaacaaaaacaaataatcccatcaaaaagtgggctaaggacatgaatagacaattatcaaaagaagataatgataataaaataaatggttggccgggcgcggtggctcacacctgtaatcccagcattttgggaggccaaggcaggtggatcacgaggtcaggagagtgagaccatcctggctaacacagtgaaaccccgtctctactaaaaatacaaaaaaattagctgggcgtggtggcaggtgcctgtagtcccagctactggggaggctgaggcaggagaatggcgtgaacccggcaggtggagcttgcagtgagccaagatcgcgccactgcactccagcctggacaacagagcgagactccatctcaaaaagaaaaaaaaaaaaaaggccaacaaacatgaaaaaatgctcaacatcactaattatcagggaaatgcaaatcaaaaccacaatgcaataataccaccttactcctgcaagaatggccatattaaaaaaaaaaaaaatagatgttgatgtggatatggtggaaagggaacacttttacactgctggtgggaatgtaaactagtacaaccactatggaaaacagaatagagatgccgtaaagaactgaaagtagatccaccatttgattcagcagtcccactcctgggtatttactcagaggaaaagaagtcattatatgaaaaagacacatgcacacacatgtttatagcagcacaatttgcaattgcaaaaatggaactagcccaaatgcccatcaatcaacaagcaaataaagaaaacgtggcatatatatactgtggaatgctactcagccataaaaaggaacgaaataatggcattcacagcaatctagatggagttggaaaccattatgctaaatgaagagactcaggaatgaaaaaccaagctggtggcaagcacctgtaatcccagctactcgggaggctgaggcagagaattgcttgaacctgggaggtgaggttacagtgagccgagatcacgccactgcactccagcctgggtgacagagcgagactccgtctcaaaaagaaagaatgatacagtggactttggggcttcaaggggaagggtgggaggggtgtgaaggataaaagactacacattggatatagtgtacactgcttgggtgatgggtgcaccaaaatctcagaaatcaccactgaagaagttatccatgtaaccaaacacaccacctgttccccaaaaacctgttgaaattaaaaaaaaaagaaaaaaccactaagaccaatgcatttaattatatatattatactcaattttaaaatgaaactgtaagctaactcctggtcctaggtcctcagtcctctcagcctgacttaggtggaccatgctgggggttgttgcatcatcttgtcttgtaccagaaagcaggacattaaattttgtctttctcccttgcagcattagtgaccagaaggatcccaaggatcgaatggttcaggttgtgaaatggtacctctcagcctttcatgcgggaaggaaaggatcagttgccaaaaagccatacaatcccattttgggcgagatttttcagtgtcattggacattaccaaatgatactgaagagaacacagtgagttctgcattgacatttttaaattatcttaattgtatactgattcaagattttatttaggggcaaataataatgatgaaagcaatgatcaaaagatggtcaccacccatagaagaaattgttgttagagcagcatagtttgaatgtagtgagaaggaggaaaaagagtaggatgagatgaggatggggatgtagaaatcagatcttgcaaggtcttgtagaccataatataattttatggcttttcaggatctcatttttgttttgagaagatcaatagaatgattttgtgaaaaataaattgagaaggggcaaatatagaagcatgaagaccattgtggaggttttgacattattccaagagagacatggtgattcaagctttattttggaggtagaactgattgatggattgggggaggtaagggaaaggagacatcagagatgaatccttgcatgtggatgtaagcagtggcagtgtcatttactgataaggaaaagattggatttggggagggaaaaatcaaaagctaatataaaatataaagttttagaggtctgtgaagctgtcaagtagggagatggaatttaagagtgtggagtttagggagaggtctgagatggggatggggctttcaaagagtatagtgtatttagatgacattttaaagctctaggattggataaaattatttaggaagacagcatagctacagaagagtaggtaacccagaactggctctgaggctccaacaaatttagtggttgaagaaaatgaccagcagggaagactcaaatgcatgtaaaaaggctttaagaagtaaaaaaaacaaaaccatagcccacagcacctgacacataataatctgtcagtaaacatgattctccatatatttccctctccaagtgatgcactacgtatagtccatactgaagacagacaagtatgtgtctgttcttattcatttggcagacattgataagtgcctactcttgtcagccctgaatgaggcacacaatccttgcctttaagaatgtcttagtctagtcagggagactgacacaaagcaattaaaatattgtagttaagttctacaatagaaatatatatatagggtgcttggtgtgtgtagagcgagcagagaccccaattaccagattctctgaaatgtcatttgtgttttctcatcaaaagaaaattatgttatatttgcttgcaggaactagtttcagaaggaccagttccctgggtttccaaaaacagtgtaacatttgtggctgagcaggtttcccatcatccacccagtaagttacagagctcctctgcaacctgtgctctcaaaactattctgtctaaagagggtcattaaaagcgccatagctgagggtactgtcagttgtgtgactagctgtgtgtttcttattccctgaagtggaaactcaagttgatttgttcctcatatcttttccttttgtaagctccagactcttagcttcacaaattaagtgcgtataaaaagaagggatttaggaaaccaacttttaatgcttccagagtcatcttatatatagtaatttgtgctgtagagacctcagcaactgtgagacagtttatataagtgatacgtagtttctacacagtatattcctggcatactgcagataccaaaaccgaggatgctgaagtctcttacataaaatggtgtcttttatattcatataacctatgcacaccctcctgtatacttgagtcatctctagattacttataatacctaatacaatgtaaatgctatgtaaatagttgtttcactatttatttgtattatttttattttgtatttttaaattttttcttttgagacagggtcttgctctgtcccccagggtggaatgcagtggcacaatcatagctcactgcagcctcctgggctcacatgatcctcccacctcagcctcccagttagctgggactatggacatgtgccaccacacccaactaattttcttatttttttttttttttttttagagtcagtgtatcactatgttgcccaggctggtctcaaattcctggccccaagtgatcctcccgtcttggcctcccaaagtactgggattgcaggcgttagccactgagcccagcctctgtatattttagatccacagttggctgaatctgtgggtacaaaacccatggatatggagggtcaactgtacataccctcaacatctggtttgtttagtgcagtattaaaactggaaacactggctgggcctaggttggggctggagcctgggtgtacttgcagaccagaacagatagcccttttggttttaagcttcctgggttggccacagcatcatttcagggatgatcctgcccacgtggctctgaatgaatgcttgcattggggaaaagggtataaaaggcaggtaggtacctcctggcgtaattggaggctgtttgaagggtaaaggatttccccatgaagccaattatttccccaggttatgtgattttggagaggtggctgtaggtatatataatctactaattgaaaatttctattcagtttcagccttttatgctgagtgttttaacaagaagatacaattcaatgctcatatctggaccaaatcaaaattccttgggatgtcaattggggtgcacaacatagggcagggtaagtgtgttggcattgggtggactacaatgttataggagaattttatgaaaatggctagactagatgtcattgttagcaactaagcattggtattgggggtgagagcaaagggtggggaactagataggttatccctaaattgaatggagtatcctggagtaaccatcagctcgacaagaaagccttgtggccacttggcactactcatcagagattctgtcccttctctccacaggctgtgtctcatgtctagactatgatgaacattacattctcacattccccaatggctatggaaggcaagtgtgtccatttcctctgatcagcagtagactctgctgttccttgagacatgccccttccccctcttcctcttaactgtcaaccttacctaaaaacttttgattttgcaggtctatcctcacagtgccctgggtggaattaggaggagaatgcaatattaattgttccaaaacaggctatagtgcaaatatcatcttccacactaaacccttctatgggggcaagaagcacagaattactgccgagattttgtaggtattttttctgccttagagctcttatgcttttctgaaataactgccttttgtcttgaactacagcttctggattaggagtgtgaaagaatggttctgtctttgtaagcgtgtttcacattttatgtgtcatgtcttttgctgaagtcccatatcagaagaagacctaaaacatatattcagagcagtcagaggtcattgataggtttccttcctaaaaacctgacttgcaatgttgaactaaaagaggccttcctaggttgcctagctaaaccagattatggatccctaatttattcttgccagattgaatgatgagctggtccttacagcagactttgtgacccctgcagcactgcctcctggtcctcacagctatccctttttctgtgcctttgctggggaaaaacagtaaccatcacattttgcacgcatctggcttgcttccacttgacactcttgggtcacgtgcagatgactgtgccagtcagtggaaagtctatagtgatggcaccatgactctctctgcctctggaacccttaactgggggggaaggggacagtgggaaagaaagtttcaggcgttgatagcagctctcctccctctgccctggtcatgtctcccttttctggcctctttcaatcctgtttatgccttgcccttcctaaccaggcctttgctgtgttgcttatcttctcacattccatagttgtgtgtccaagtagaggtctgttacggcttttgcagaatggatccttgctcagggaaagtattcacaccatctggcacagaggtccctttcaacctgaggatgaaagcctgcattatattcttaagcaaagccttccctgacccccagtgcccatgtaagctcaccacagcacttaccacctagaatttcaatggtggttacgtctctctccactacgctgtgaacagcttgaggatagggaatttgccaactctgttatggtccttgcacccagaataggacgttcttgcccaaacccaccattcttgggatctcaagttcataagcgtcctgttgaaggccctcattcttatagttagccctggggagtccagttctgttaagatgctttcatcaaaaacttcacagttgctcttctgtgctctactctgtagttgggccacactgagcagattctttggtagaattttcaacttgagactaacacaagtatttccttttctgttcagttctccaaatgacaagaagtctttttgctcaattgaaggggaatggaatggtgtgatgtatgcaaaatatgcaacaggggtaagatcctctattttgccacttgttttaggctacattagattgtactctatccctttttctggcttccttcattagtacttccttcataatgcatttccttctacagtatattagagctggaactttaggacagctccagtgtatgtcatctcttcagggcaagctttttctttccttcccccaccttctcccagcagtataggtaattataatcatttttacttttctctctgctctcaaaacacttgagaataatatatgtaaaacaatgcctggcacatagtaagaacccagtaaatgttaggtatgtggcgtatgtttataaaatgaagcactaaactgtgtgtttccatacacacacagttgaagattttgtataataaaatttactgactgcctggcaccagagataccaaaatgagttaagatagacctttccttcaaagaacttgcactctgtactactgcccactcagtgttcttaaacagaggaaagatgttatgaaattaacaggaggagccagttaactgcattttggacctagagaatttgaagtgtcaaaagcactacaatgcatctaacattaggttaggggtttatgggtctagttcccatccacctctattgttttctaggaaaatacagtctttgtagataccaagaagttgcctataatcaagaagaaagtgaggaagttggaagatcagaacgagtatgaatcccgcaggtaagccgacattgttaagtggaactattgctgcagtgcttaaactttgcctaggcgtaggcacagggctgggtttgagagacagtagggcagagcataatagtatagaccaagtttgaattcctgggttcgtatgtcagaactaccacttactacctttgtgaccatggatggctcagtcagctaacttctctttaccttctttcctgaaatgagaataaaggccttgagaggaagccacatcttaactaactttaaagcctctgtaatttacttcttgacccttattctctccattcatactattttctccatcatattgttaaatccaagggagtttttctgaaatggaacttctcagttcctctaacacttacaggtatatattaagggacactcaagccctacagaggtaaactgattgacccagagttgcacagtaagttagacatagagccagaagtagaatcccaggtctcagcttccactattctttttcttctgttgaccttatcatactatcaggcagcccttatttccttctttgacaactagcagtggagtcttctgagcccatatgtctgttccttactccagtgccctggtgccagcgtaaggagatttagtctgtgacctacagcacttaaagccatttgacttgtattatactatattcaggatggctgcaggctttcattctcaacattggcagctcctcttacctctttgttttagcctttggaaggatgtcactttcaacttaaaaatcagagacattgatgcagcaactgaagcaaagcacaggcttgaagaaagacaaagagcagaagcccgagaaaggaaggagaaggaaattcagtgggagacaagggtaagcttgcctgccccaccctcctaagtgctgttcctcctaatttatttcagtgaatgttgaagaagtgatgtgccaaacactgtttataaacaagatgatcgctggtccctacttgaaactcatttcagtctaatggcggggtggggagcagatatgaaatagtaagtatattacagaagtacaaagcaaatatgtaactaaattcttcctctttgtcttacagttatttcatgaagatggagaatgctgggtttatgatgaaccattactgaaacgtcttggtgctgccaagcattaggttggaagatgcaaagtttatacctgatgatcagggcagtaggcataattcagcaacaaacaatcttcctttgggagaaacctgttcattccaatcttctaattacagtggttcctatctcagggatactggactttctgacgcagatgaacaattaaggggaaaagcttcccttttccctctgtggcagttacgattttgacttcagtcctgagaaaaacttcaggttttgaaaatcagatgatgtcttctccttttccaaacaccacacgttgaaagcatttataaatccaagtctgaaactctgcgctctagtactgctgttaagatacacaacttgtttcttagttcatataatctcgggatacacacacacacacacatatatatacacacacatacgtatacacacacatacatatatataaatatacctgatgccagatttttttcataaatattctgcctactgtaaatatgggttcctctgagttgttttagaaaattagcgcaatgtattaaaatcaagtgttaggaaatttcatggtcttacctacaataacttttattttggaattgaactattattaaattgtatctaatcctggattacagtttaattaattattcttagtgcttaaggcttcataaagtaatttttccaacctttttttt

SEQ ID NO: 38278 - DNA, 10672 bp, Homo sapiens
acacacacaggcttgatgctcgctcccgtttctacaggaggttttgacggctggatgctgcagggcatcccctcgcctggaggaggttcacttgtggccaggttcccagcacacccacttgctcactggggccctggggacaccgccacactcgagcccatcctacggcctcaatccttaccagtccccaggccatggactgccacactgtaggtcttcaatcaaggttcagtggagtttcgaatgtacacacaccctgaaagacagcgcggccacctcagaaaacaacgcgcgcccagctggctcccctccgacagggcccacggctactgggtcggcctcctccggaccctgagcacagcctggtatgcgtgcgggctcggaatacggatctgagcagaagaaatgcgagtggagagcggttctgcgcaggaaagaggaattttgttggaaagcctgtcgacgttgctagaaaagaccacagcatctcacgaggggcgtgcgccgggaaaccgggagttgacgggtcagtgcggccagttgccgaggtccgaaccaagcgggcgcagtgaccgtggcccacaaccctgcagcgcacggcccagtcacctggttagcggacgtcggctgccctgcaggcccctcggcctcccccagcgtgggcctggcaccgggaagcgcgggaagggctctttatttgttagaccagtgagtggactggcccgggctctggtcagtgggcagtcagtccgagcccagagaccggggaccaggaccccgggaaaggagagcaccaggactagggggaggagcggaggatctggggtcagaagcatccagaggcgcagggtagggcgggcggacccgggagcggagagggcggcagaggacccgggggcccggggggtacccgtcgcgctccggctgtctcctctcggcgcctcggccgtccggagcctctcagggacggccgctcttaggcccgctgacttccagggctggggccagggaaaggcgccgccatcgccggcgtgacggccgaaggggggcgcagagtcctcccggaccgcgccggagactggctgggggagggggctggggagccctccccgccccgccccgccccgccgggtccggggcctcccgccccccgggccgaggggcgcgcccattggcaggccgggctccgcgcgccgcacccattggccggccgccgtgaggagcacgaggccaccgtggcgggcgcgcagtcggagggcggcgggcggcgggcggcgggctggccgagggcagcgcgggcggcgggcggcgcgcggtgggcatggcgggtgcggggctgcgggcggccgctcggcgctggctgctgtgcggaggccacggcgggccgcgagccgcctcgtcctcgccctcctgccctgggtgcggccccccgggtcccggcgcccactgccccggcgtcccgcgctccgcgcccgcccaggcacccaccagcggcgccgacctcagcgcgcacctatgggctcgctaccaggacatgcggagactggtgcacggtgggtgagccggggcgggacgtgcgccggggtgtcttccgcgtggactgatggacggaccgagccccagggtgccgctcctccggggaaacacccagtggggctcgccagggccccggagcgcaagggccgggcggcttttcgcgagaagctccggccgttcatcccgggggcctctggggcgccccgacgcccgggggcgggcgggaggtttgttccccggctcggtctgcaggagctcggggctcctcgagcggctgccggagtgctgggcccccgccgacttccttcggggtcccgcctgccgtgaagccgcggtggaaacgcccccaaccccttgttctcggccaacccttagttggggcgggagagtgctgtggacaaagccagcgagcggcgccgggcggaacgggctcctagggacggccggaccaaaggggacaccggttggacttcccagacacacctcgatgtcgccctggaggtccggccccctctcagcccgggcagcgaaggctgggagaagccaagtcacccccgccccctggagcccagactagggctgcaaagggcacttaacctccctgtccctgctctctccctctgagaaatggcgtgaggaggctgaggccccttcttggagggggccggctggggcgcactagtgaggccccagagctgagagtgctggacatctgcctgcttgtctccgtgggtctagtggggccctgcttctgcagcagacagatatggtttgggtcgtgaccctatcactgaccagttgggtggtcccccagcaagtctcaccctctctcaagcatgaaacgcagtcctggggcctctctgtcccagggttgggtgatgactggaaccaggccaagcagggcaggagagcttccggaggaacccccaggggtgacgtggcttttgttgtctgataaaacaaagtagccctgtctggaagattctaactggctagacaggggttttcactccggctttgtggggtggcggagaatcacttcttgaccagtaaaggcaggatggtaaaggcccctgaggaatggtcattttgaagccttgggcatctgtccaccctcgaggtcccaggttgagtttgtgtctgtggaggggcggcccagcgttatttaagaagtctttgctctgggcccggagaagaccctcagagtatcctgagaagcctgccttggaggtttcagggaggactacggggatctactggacattgtcctcctgggcctgcctgcatctttggagcctcacagccctctaagctcctcttgtcatacaaggagcaaagtcattcccaccaagatcccatggtgagcaccagcaggagccagcttcacacctctgggcgccgaggtccgctttgggctaatgcccacgggctgagagcagtgcaacaggtccctcagtcccccagcccccacccacctggcctcagtgtggtgacattgggaggctaggctgagaggcagagtgattaatgcaggtggggtgacttgaatggtgatctcaaccccggtgcctgttactgggtggtttggagcaagtgacttcacctccctgagccccagtttcttcctccggacgatgggggaataagtgggactgcctcacaggatgggagtgaggattgaacaagacaagcctctaaggcatccacaagtgtcacggctgctagggagcagttggccctgggacctggcaccatgggcaggtgtgggagctagggctgaggagaaaggagggcaattgctggacatgctgagtgggacacaccctcagctgccccacccccaccccccacccacaccacctatggaagggaacaggcttctgtcgccccagagccaaggttcttctagtctagaaatcaggccaggccaccaggccctgtggctgtttccacatcctgctttgttcctgggaggactgtctgcccctgggcccctgggaacatccttaggggcagaggtgaaggcctggacctaaccaggactctgtgccagcaaggggctgcactgccgagcagaccctcccaggtcttctgcaccaagagtcacagtcacagttggtatccgggaactcagggccatgggaagggcaaggcccagggtcctagtgacacaccagaaccctgggccttgaggggtggctcagaagcagctccctagagcgttgcagtcaactgtctcacttgcatccaagtgaagactcctgtctacacccacagatcttcggagcagccgctctgtgctggcctggggaaccagccacacctgatcccccacccacaccctgaacttggctccaaaggaaaggggtgggaatggagccctgtgtccccagagtgcctctgaggcaagtgctctgggcacggagcacatcagcgagatgtctgcctcttgagtgcagcagctgccaggcacactgtggggcttccctggccctctggcctggcagctcctgctttgtcatcggcactggggttgtggctgagacagggatcccctggagtcttagagctggggcccctgcaaggcaggggtactagatgtaccctgtacatctagtcctgcctgctcccttctccctgcagcccctgcttctggagggacactgggaaattggggacaggatgctcataggctcaggaaacatatcacccatttaatcctgcatatgtgcaggtgcagagtgagattgctgcacagagcagcaccttccatatgacagtcttagtaattctgtaggttggtacaattttttttttctttttaaaaatgttttcacagagacagggtatcgctatatggcttagaccagtcttgaactactgggtttcaagcaatcctctcgcctcagcctcctgagtagcagggactgtaggtgtgtgccaccatgccccacttggtacaattttttgtacccttttagaaactaggaaacaggcccaagaggtgaggtgacattcctgaagtcatagccatgagagggagggcctggtcttgtctggctgacctcattgcatgtggccttcctagcacatctccttccctttcctttcccttccactttctccattgtacacatagggaaaccagggcaggtaacatggggcctctcagccccatctgcctccttgggaccccagagcccatgccacacagtgctctgctcagcaccctgctgtgggcctcaaagccaactgcagcctcctgggagcagccagggacttggggtggccacgaccacatccccagaaggagcaacctggataatggcccagaacctgacatcacgtcctgactgtcgtaattagcaatgttccctggctagagccagcaaatgtcattatatgggcttgcgggcagctgaaatctgattagaggggcctcactctccctgggctgtgggaagtgcacagagctggcagcccgatcggcagaggggctccccctcccactaatgttcctgagccccagtcccagctctgggcaaggtagaaaagtcagcatccatggcctcaaccccctagtctggccatacagagccagcccctctgggttggagtcctcagtgcccacatggtatcctcacacataatcccagggaggctgagagatgaggccagggggcagggcagggcagctgagaggagcagaggaggcgctgaattgtggggggccagacagtggtgttcctgcacgggttttgagcaagtgggaggctttgctttgtagagcatcccaaaagcagctgttctggggctaggcggtgaggagttgagtgactgctgccagggttctagcatggccttgtgtctgatggggcttagtggtgagggcctggagtagtcacgggctcagtatacctggtgggctataggagatagtgtaatgtaggcaggtgtaaccatgaggaggagctccagccaggggctctgccttaccctaactgcgtgaccctgggcaagtgacttctctctgggcctgtttgaccatctccagcactggaataagaggtgccattgtggggcgtttctgaggctcacagggctaggtccccacagagtgctcaggagccatagctgctgcagggatcatcatccccatcactgcctccctgcatctccttcctctagacctcctgccccccgaggtctgcagtctcctgaacccagcagccatctacgccaacaacgagatcagcctgcgtgacgttgaggtctacggctttgactacgactacaccctggcccagtatgcagacgcactgcaccccgagatcttcagtaccgcccgtgacatcctgatcgagcactacaaggtgagacgggggtccttgccaccaacaaacccagggcttggaggctggccagacccaccttggcctaagctcagggctgagtcgtggggctcccctggccctcttgcctggcagctgccctgggcaggtggctggattgaccccctggggtggccacccagccagcaggtctggcagggctattggcttaggcctggcccctttcccccggcagtacccagaagggattcggaagtatgactacaaccccagctttgccatccgtggcctccactatgacattcagaaggtgagtggctggacctgtataggggctccctccttggcctcctcttggtatggtcattacccctccgtcccatccagctggggttctggcatgggctgaaagaggctggcttggggccacggtgaaactgcctcctcaccatccgtcctgcctccctggcgcccccagagccttctgatgaagattgacgccttccactacgtgcagctggggacagcctacaggtcagtcggctctgccccaaccccacccccgccccaccctacactgctgttctggctcaggactaccttggactgatggtatcttgggcctgctcaggggcctccagcctgtgccagacgaggaggtgattgagctgtatgggggtacccagcacatcccactataccagatgagtggcttctatggcaaggtactccataccccagcagccagcctgccccatggacatgtgcccatgtcccaaggcagatttggggccctcgtctccagcactgaaggggttggggtcccaaagggtgtctgagacaatggccccctccccagggtccctccattaagcagttcatggacatcttctcgctaccggagatggctctgctgtcctgtgtggtggactactttctgggccacagcctggagtttgaccaagcacatctctacaaggacgtgacggtgaggatgctgggcctgccctcggatggcaggaaagactaagtccagccacagtgggacagccccacctgggccctgctgtaccctcattgtcctccactgcccccaggacgccatccgagacgtgcatgtgaagggcctcatgtaccagtggatcgagcaggacatgggtaagtgtggacagaagccctgccgtggccggcctgagcaggtggcaggactgaccctcacagactcatctgccccattagagaagtacatcctgagaggggatgagacgtttgctgtcctgagccgcctggtggcccatgggaaacagctgttcctcatcaccaacagtcctttcagcttcgtgtgagtccagcccctgtggatggagggacagcagggccagggctctgggtggggagggcaggcacggagccgccctcagactacttgccacctgaaactcctccacacagagacaaggggatgcggcacatggtgggtcccgattggcgccagctcttcgatgtggtcattgtccaggcagacaagcccagcttcttcactgaccggcgcaagtatgggcatggtgggggttgcagggccagggaaggggaatagaggccccaccccaatgaggggactgaagcaggaggccaacctggcccttgcccactgcccaatgtgcttggggtgagaacacccccttgctggcatgggtccacttgagcaggtgggcctttacggaggagggatgggggttgcccggcccgtggcccagccacagactggaagtcatgccctttacctgcaccccaggcctttcagaaaactcgatgagaagggctcacttcagtgggaccggatcacccgcttggaaaagggcaagatctatcggcaggtaagggccatctggggagagcagcatgtggtgggggcatggggcctagctagggccccaggctgtgcagaggcagcctctgaagaagcagcacagctccttggccctgagcagcctcacacaggcaatggctggcagggagcaggtctgggtggcctcgagagcttgacctctgggtcaagcagcctggctttgaattcctaactccactactcagcagagggagcctggcctggttgcctgacctctgtgccttgcttcccttgtctgcaaaagaggtgtaatactctctactgaagctgtggtataaagctctcagaatggccagtgcgccaggcaccgtggctcatgcctataatcccagcagtttgggaggctgaggctgcaggatagtttgttgagctcaggagtttgagaccagcctggccaacatggcgaaaccccatctctactaaaaatagaaaaaattagcggggcatggtagcatgcacctgtggtcccagctactccagaggctgaggtgggaggatcacttgagcccaggagttcgaggctgtggtgagctgtgatcacaccactgcactttagcctgggcaacaatgcaagaccctgtcttcaaaaaacaagaatggtcagagatcgtgaaatgcctgatgaatggtgtcatttcttggggttgagcactctgctgcagccagaacaagtctggttgggggcagctcactgggtgatctagagaaactcctccttcctacctggctaggaaaatgagagggactggtgttgaggtgggattaggtgtctatgagcaggcagtgattaaggtttagccctggctggaatgcggaaatcctggctgagctgggcttcttcaggctaggggttctaaaggccttggggctggaggagggggaagccagcagctggccaggggagcaatgtggaggtggccaatgcccagcctggcctgcaggaaacacccccaccctctcagccctgcccacttctctgcctcccacccttccgcacccaaactctccacagccctcgggcccaggtgcgtcccttcagctctgagggcgctgctctcccctgccttggcatccagcctcagctaaagagggtcatacacctttgtgagaaacacatgactttcttccctggcagctttcaggcagttctttatgcccagtattctgaagctgctttccactgtgtgttggatcctgcctgtcagtcactaggagtctgtcagtctcctgccctttgagactctttctcttggtctggggcctgcctgggcctctgcccctccacttgaacttagttcagcaattggcttctcccacaccacctgtttcccccagcgcttccacttctgaggcttggaatgcacagactgcttcaagaactgtgcttgctgggtgtcaattattctcgcttttggggtgtggactcctaccctggtggctgctgcctgagcactagtctggtgattcctgctctgggccgctcagtttctgccaccctgtgagcttccccagttacatgtgggcctggctgagtgtctccatctttctctggctccaagatgctggtggccccggtgaggtctgccattggtctgccaggtccctctgcactgaggcaggggaggccagcaaggacttcagggctgcagagccttccctgcagtttctaccttacaaacagggatctaatccctaacctggggtacgtgtgagaccacagggagaaggccctcgaggcatgggcaccatgccaggcctgtagggcaccttcctgcagcaggcagaatccccttcccaagtaggaggggaaagtgacaagaaccagggcccagggagggagcagcaaggccatgggaaagggcagccagcatccggctggatttgggctgcctctggggattcgggagggaggactggtggaggacaaggcacacttggctcagcagcattcccctcctctccctagggaaacctgtttgacttcttacgcttgacggaatggcgtggcccccgcgtgctctacttcggggaccacctctatagtgatctggcggtgagggaggcagggctgggctgcagtgggggagggccaggaaacccccccccccccgcccccagcaactggcgctgagcccagttctgccgccccacccaccaggatctcatgctgcggcacggctggcgcacaggcgccatcatccccgagctggagcgtgagatccgcatcatcaacacggagcagtacatgcactcgctgacgtggcagcaggcgctcacggggctgctggagcgcatgcaggtgtgggccggggtggctgtgggagggccagggcggtagcctcctgggtgcacacacccaatgcacactttgtgtccccagacctatcaggacgcggagtcgaggcaggtgctggctgcctggatgaaagagcggcaggagctgaggtgagcaggtggggccagggcaggagtcccagccaagccaccaccccaggcccaccccttgagcgcatcgtgtctccctcgccaggtgcatcaccaaggccctgttcaatgcgcagttcggcagcatcttccgcaccttccacaaccccacctacttctcaaggcgcctcgtgcgcttctctgacctctacatggcctccctcagctgcctgctcaactaccgcgtggacttcaccttctacccacgccgtacgccgctgcagcacgaggcacccctctggatggaccagctctgcaccggctgcatgaagacccccttccttggtgacatggcccacatccgctgagggcacctttattgtctgggacaggccctcagcccctcctgccccatccacccagacaagcaataaaagtggtctcctccctg

SEQ ID NO: 38279 - DNA, 8098 bp, Homo sapiens
aggagcttgcagtagcgggcggcagagctggagtgaagggagctagtggtaaagggagctggtggaggggtggcggcaggggtaaggggcaggggacaccctctagacggagagcgggctccgaggtcctggctggccctcggtgcgcccgcccctgtgttggtcccacaatccctggcaatgagaggccagggtttattggacagagtcagttgtggggttcagagggtcagcaatcaatcaatcctccgaatccagagatttagacccagtcgtccgtattaggactggaggggggtcaataggttcagtgtttgagatgccaagggaacctgtcttttgatttggggttcaacatacagaggttagttttaggattcatgtttagcatatagaggatttttgctgggattaggggttcttcaaattcagatcagtgttagttcagtacttggggattacgttcaggatttaagttaaatatctgaggctcactcagggtttgctgtccaatattcagggttcactattggggttcagggcttaatatctagaatgaagacgcaacactttgggaatttgaggcttcagtattttgaggtttgggtctgagaagggagtctctgccaggtttctgaatttgcagaatttgttcatggccagagggaagtcttttagagatcaaattgtggggtgtgaatttcagaatttgggaggaatcactgtgaggtttgaaggccgactggaatctgggttgggatttgagatgtgtgggatttgtgaggttctgtccaggcagggactatattgagctttgggtttacatcttgggggagggctaagtgctgctatttggggtttggggtttggttggggtgtgagatctgagcttgatttctctgctgggatttgagatgtgtgggatttgtgaggtgttgggtccaggcagagactatattgagctttgggtttacatcttgggagagggctaagtgttgctatttgggttttggggcttggttggggtaggagatctgagcttgatttctctgttggaatttgaagtttaggtagcagtcaccattatgctcaaagcggtgatcctgattggaggccctcaaaagggtgaggtgccaggggaatggggggaggaggttgggctggagtggtaggcgggatgggggcagaggaaggcaggaggccgaaatgttctcctctctcctctcccaggaactcgcttcagacctttgtcttttgaggtgcccaaaccattgtttcctgtggcaggggtccctatgatccaacaccatattgaagcctgtgcccaggtaacctcaggggctcccctctctcacctcacttcctgcttatcttcatgctgtttccccctttcccaaccatgaactcttcccaccaggcataactccaaggaccatcattcacagatgacaatgtgaatggcgccccctcaagttatgctgtgcagctgccctgctgtcttcccctaatctagtttctcatctggcctcttcctgctcagatttcactcctatttttaaagtgtggaatgtgagatcaggcaaggatcttggagacaatgtaaagccgtagcatggagactcttaatgataaccaagcacaaattcatatccttgatcacattgttgctcatttctttattgcttttcgtattgagccaggcaaggttttggtttgaattcagtctctgcctgctgtgaggtctgcaacaaataacacaccctctctgacactcagtttccttatgtgtaaaatgggggtgattagacctaccttgttgggtggtgaagcttagaaatgatatttgtaaaatgcctagtacaacgcagacccttgataaatggtacccttacctcatgctgatctcaagcttaggctgacagataataaaaatggccgggggggagggggcggggtggaaatggattaatgcagcttggtaggcaaagtctttcttagagtgagtcccagttcaggttggtgggggtaataattgattgaaagatcaggcctggcatggtagctcatgtctgtaatcccaacgctttttgaggccgagtcaggaggatcgcttgaggccaggagttctagcctagctttggcaacatcaagagaccccttctctacaaaaagtttaaaaattagctagatgtgatggcctggctgtagtcctagctgctctagaggctgaggcaggtggtgacatggctgtagtcttcaatactcaggaggctgaggtgggaggatcgcttgagcccaggacgtggaggctgcagtgagccaaaatcatgccactgcactccagcctgggcaacagagcgagaccctttttcacaaaaataaaacaaaacgaaaaaagatcaggcctccgacttcctccaaattcctcattgtccagaggagaaaatagcccagagtggtgagtgccctggggccccacagctgagactgaaactggtttctggactttgggccagcaccaaggatttccccaacatcccctcctattagatattcttcatcccagcctcttcccttgtcctcaggtccctggaatgcaggagattctgctcattggcttctaccaacctgatgagcccctcacccagttcctagaagccgcccagcaggagtttaaccttccagtcaggtgtttgtgcacacactcgtatatgggggggtggggatgccctaggcctctgagttcttggaagtgggttgagtcagcatttgctggagttcatcctcgcctactagaaggattcttgtttggacatcaatgaatctctgagtatatagagtttctctgtgggccttgggcaggagtagtcctgggagcaagcggtggcggtcaggtgccctggctcatggtatctgtttcctaagatccactgagctggctctcgggtccctggggacaggtacctgcaggaatttgcccccctaggcacagggggtggtctttaccattttcgagaccagatcctggctgggagccccgaggcattcttcgtgctcaatgctgatgtctgctccgacttccccttgagtgctatgttggaagcccaccgacgccagcgtcaccctttcttactccttggcactacggtgagggggtcaggagggctggagggtgtagaggaggtgatcccaagagcttcccggaattcagggtgttggggaggcaggggcgccccgggagttggtgtgggagctggcgtcaggagggagatgcgctgctctggcagcatggaggtgttagtggagaccccgagccctctggctgttcagaagtagggagggggagggcagctgtcagtttccacccttgctgaaggcctgtcagtggcagagctgcatgccaggtgctgtagcggagggaaagaaagaaaaaacagacgtggctgccctggagcaggcgggtcactgtctcgggtgtgtctgtctttcaggctaacaggacgcaatccctcaactacggctgcatcgttgagaatccacagacacacgaggtgagagcagagtgggggctgggtgggtgcctactctgtgtcatcatcccctctacctcaggcctctagagaatgctggcacagtatggggtgggctctagtcttgtcagacaggtgagacactcccgattaatcatcttatatccctttaagagagattgaccagggggagggggggaatggttaatttccctgggggtggtgctgtaataaatgtatgcacagtgcatgatgggaacaccaagggggccccaacccagccttgctggggtgggagtagagagggcttcctggaggaagcaaggtctgagcagagtcccatttgtctagatgacaaaggagacaggaaggtactacaggcagagggaatggcaggtataaaggcctggaggcaggaagtaacataccagaagcaggagcatgataggcagggcagcagggctctgtcctgttttgtgaaactcccttctcctaagccccttgactttcacataaccctccctcctttatttatttatgtatgtatgtgtttatttatttattttgagacagagtctcactttgtcttccaggctggagtgcagtggcatgatcttgggtcactgcatcctcgacctcccaggtttaagccatcctcccacttcagcccctcaagtagctgggactataggcatgagccaccatgcccagctgatttttttttttttttgagacagagtctcactctgttgcccaggctggagtgcagtggtgcgatcttggctcactgcagcctctgcctcctgggttcatgccgttctcctgcctcagcctcctgagtagctgggattacaggcaggtgccaggctaatttttgtatttttagtagagacaggctttcgtcatactgcccaggctggtctcgaactccggagctcaagtgatccacctacttcagccttccaaagtgctaggattataggcatgagccaccaccatacctggcgtcacatactccttttatttgttcgtgctttaatataaaacatacatataaacacgcacacacacatgcatgtacacacctacacacatatagttttgtgctcagcaccaggtagctgtgagagaaacagagccaaatgggtgcagtccctgcctcttggttactgtgagtctaataggagtgacagaatcaaaaggcaacctttgcaaatgatacaatgccatgggtgaggcgtggccagagttcaggagtgcccaggcatgaacagctaactcgggccagcaagagaggacgcacagagagagtgacagtgtcaactgggtttggaaaggtgggctttccagatgaagagatgagaaaggccattccaggcacaggcatgcagtcgggtggaaatgcgtctgagaggtaggtggtggggaggatcaggcagggaaagccatggactttggatttatctgaagctgaatcaggtgaagggcagtcatctcagggtttaaagccaggcagcagtaggatgcggatgcgcactgcattttagccaggccaccctggcagcagggaggagaggcaagaagggcctagaaatcagagggtcttaggggactgtggcggtagtcccttcttctactgaacccagcctgctctgtcctcaggtattgcactatgtggagaaacccagcacatttatcagtgacatcatcaactgcggcatctacctcttttctcctgaagccttgaagcctcttcgggatgtcttccagcgtaatcagcaggatgggcaattgtgaggcaggccccatagccctgtgaccccaagtacccccagtcacggaccccaacacataccagtctctgcaggctccatctcaacttgctcaccttcctcctcccctctcccttctccacttgccatctccagcagagcctcctgagtccctccccttctaacctcattctgtccctcttccttatccatcccagttcctcctctgtcactgcctgcccactccccttctggtccatttctcctaagccctgagtgtcccagagacgtctttcagaacagacagcaacacacagttgggcgcacacatgctcgggtgcagacgtgtgcacgtgcacacacagacagacatgcatactctcaggctgaggctccccttggaacatagcaccagagccctgctcaccagtcccagggtcttccctcctggggctagaagctgttcccttctagggatccttgccttaaccccccaccgccccatctaaggcctcctctgctcatagccatttctcactcccacccgtgtctctgcttccctctccatctctcctggcctctctgtctctgtctctgctgagctggcatctctaccatctctctctccctttctttctgtgactgtctctgccctcaccagctgccttgctctggggtgagtctgtctgtgtttcattccatccaatgagggggagggtaacttggagggggtaaagggctgaatggggatgagaatgtgaaaatggggggaactccttatggaaatggggcagggatgggaagcaggcctctgcctggggctcccttgtgatagcacccacccaagtgggggctgggtgggagaggttcctgggatgtgagcagccacatcccagagagggccgaaccagacctggagagaggggcttagagaggtggtgggaatcctcctactcctgtccctgggagactgtgttagccccacagtcggggctcagctgggggactaatgtcagcattcttcctctctgccagggaggactcaccaggcttgtggccaggggcaggtaccatccgcctagagcaggatgtgttttcagccctggcagggcagggccagatatacgtgcatctcactgatggtatctggagtcagatcaagtccgcagggtatggaaggctgggtcccctggggattgaaattttggggtggtgggcacaggccctgctgacccctgagcccctgtcccccttgcggtccccagttcagccctctacgcctcccgcctctacctgagccgataccaggacactcacccagaacggctggccaagcacaccccagggggcccatggatccgaggtacccagcctgccccaattcctaacctttggcttccaccccagccctctgaaccaggattcttgacctcgagtccagagttaaagcctcaatccctgccccttcctgatcaaattcggtttgggatatttgcccccagggcctctcttctgcttctagggaatgtgtacatccacccgaccgccaaggtggccccctcggctgtggtgagcactggtcccagccccagggagggaagggtggtggtcggatggatggagggtgcccacgctgcctgagttctgggtgccggtttcttcactttgtcacagcctattgtgtgtcctcgagcaggtcacttatgccttatctgttctagaagggagttgggtttggggatcctccaagtccctccagggcttatggtgtgtgcttctctccacagctgggccccaacgtctccatcgggaagggggtgaccgtgggtgagggtgtgcggctccgggagagcatcgtcctccatggagccactttgcaggtaggtaccagcatacacagcagcatgtgacaccccaagaggctgcggggagggcccaggcatccccccaagaacagagaagggtgaacgccgtgggctctgcatctggccacacctcacaccctccggttcctgctgcctcctgcctcttccccttacctttcactgtcctctttggcaggagcacacgtgtgttctgcatagcatcgtgggctgggggagcaccgtgggacgctgggcccgcgtggagggtacccccagtgaccctaaccccaacgatccccgagcccgcatggacagtgagagcctcttcaaggacgggaagctgctgcctgctatcaccatcctgggtatggcttcctgggggccagggctgggggaacccctcagctgatggccagtggccccggggagcattcgttcctctgtgtgcacgcgtgtttcttcttttagcaaacagttaccaagggcctgctgtgtgccaggccctgtgtgagtcaccgggggcatgagaccaggggcacagatgggcaggagggctccctccctgctggcagtggcccccagctccctgcccctgtctcccctcccatgacctcccctggtgccctcatccatgctgcaggctgccgagtccggatccctgccgaggtgctcatcctgaactcgattgttctgccacacaaggagctgagccgaagcttcaccaaccagatcatcctctgagtagggctgccagaaggcccccagctcctacccactccccttgaggctgctgcctgcttggccagcctctgtccagaaaggaccagagaaagccaggctggatcgtcacatgccggggagcaatgtggatggcctggggactcctgggttttctccctcccgactccctaataaaccccgtgaaccttgg

SEQ ID NO: 38280 - DNA, 26638 bp, Homo sapiens
ggccgggccagggccaaggccgaggcggcagcggctgcgagaggcggcggcacgacgacggtccctcagcccagccaccatgagcaccaagcagatcacttgcaggtcagtgcgctggagccaggagcttcgggccgctcccccaggccgcaggggggccggtgcgcgccagtgctgtggtccgggaacctgaggctagagcgggactcggaaagttactcggctgttcgcggcggggctttgcgaggcagagcgagcgctgccgccacagccggggatccgggggatgcgtggccgagacgctgggcgaggccagcgcggggggctacgccccgagtttgaagcgtggcccctgtgggctgggaggaaggacgtcctagccagggccgtgcaggatgccggggcgctgtcgggaaggctctggggcttacgctttaactggaaaagatttgaagttgagtaaagggacgccgagaggacggttacaaatggggataccacataggagtaatttgttaatcgattatgagggcctcaaagtttggagaatccagatgcaatctaaacttgcagagagttaacaagtaaaagttgttgtgtggaaaataacgacaggtagcatattgtgaatatcggcgaagcgccctgcatatttccaagtcctttatattcattatcatcagacttcacagtaagacaacttagtagttattattaccattttacagtgcaggaaactgagaccgaaagacgttgacactcatttatcttactgagagagccatttacgaggagaaatgcgacggtaatggatggtttattgtagaaaatagccagatagctacactacgactgctcctatgaaatagaatagtgtggttgtgtaacaccctcattgcttggtcagcttgtggcttactggtaatggagtctagtcctattgaattgtatgtttggaaaacgcaaattgaattgtatgcttggaaaatgcaaatttcatttaataatttttatgggaaacattgcttaaaaacagttatagagtttgtgtaataaacagtttattttctatgttgttacttctcttcattggtatgaatagttgagacgtgactgtgtagtaagttttctgttagcattagtgtacatttactgttcaatttatccaaggcccaggtggcttatgttaagctgttgtcagaaatttgcacctagtgtctataaaaagacttttactaggttatttgtactagaaggtgttttgtgaagacgggtttgtgtgtgtttacgtatttttatttgtataaagtttctcctgctggaggaagtattcctaggtcattgtgcactgtaaagcagcttgtagcctcctagaaaaacctctgtattcctcccctcgctctatggtttaattctaccatttattcccgtacctcatctaagaagtgtccacaaaacagtacacatttatgtaataatgctttataattgaatctcaactctgtagtatcttattttacaaataaggaatcttatgctcagaaagacttgaaatttgcctaaaattttacaccttagtagaggcacaaggacctaaatcaggatcatcttggttttttccttgtatacctggagatagcttgacttgaaagctttaattctgtttcccaaacaggggtgttctgtaggatgttgctccatataaatgaagattgggttggaatgttgagaagggatcacttctgtttaagtgtttagtcatgtttgttggggacttacaatgtgctgcggctcttaggtactgtagtgtataatccagcaaccagcgctcttccacagatcgtaaaactgagcctcagcattgaagcgacttgcctaaggtcatttagcttccaagtgacagaggtgtgaaatcaaagttcatgccctcatagactgtagggcctccagataagttttgaaatgctaaattaaaatttatttattgcaggacttatcaaagcttttaatgtgttcccatgaaaggaaactcatacaaggatatgtaaaactgcaaagaagtttactcacaaaagggtgtaaaggagtcagggctcccgatgactgccttgccaaataaaaaacataacaggtgttttaagtgggaaaaaaccaatatgaccaagagtaccaagtttacattagtgtgtttatctaccatcaacttttctaccagcttatctaccaaaagcttttctcactttattatctcattaacaaaagccttgtctctagacattgataatttataggaaatgttcaaggtatgatttattttggggaccagatctaagcagcgtgtgcggttttttgtgggttttgtttgtttttttgttttttttaatctcaggtcacaaagttttaggtttgttttcctgactgtgggatgtgatgtacatgtttattttgaatgacagcagaataatgtcagttttgcttccaatctgttagatattatgtatctccaagagttgcttatcaaatgctaggagtctcaaacctaatgacaaagacactccatgtttttattgcctggagtggtaaaaatgactgctcgtacagttatgctgtcagtcagctcttctgattccttgacatgccgctctatccagaatctcaatctgtgcctttttgctgattcccctcccccacaaccatctccctgtcttccagtctgttttcggagccctgggggaggcccttattatagcttagtaaccagtttatttcaccttctcctcttgtgatagagcttccctgcatctcataatcactattagaagacacaggatttcattgtcctaagatagtcaaacctagggggcttttgattctttgaaagtcacaaaacatgggggatcttttcagctggcaggtggtaggaagagtttgagccccagggttgggcagttctggattctaatcctggtaccacctgtgcaacaactgcctcatctgtgaaatgaggatggtaatgcctaaccggcagggctgtttaaaaattaaataatagcaacaaaccatttattttgtattaggatgagcacttacatgcattttctcagttaaatgtcccagtagtctatcatagcagtctatgaagtaagtgcagttattataatcacattacagatggggaaactgaggctcagtgacttaaataacttgcttaagctcacatagcaagcagtctgacttcagtgtcttcaccaccacactgtacttcatttcattcccgcctctaatcagtacatttattgcaagcctgccacagtgcctaccatttgcttccttccccctcagtggatctgctgtcacaaggagtatagccgtaaaattttagcctgtgaaaatatgtaggaaaatgtaaaaaaaaaaaaaaaaaaagacactgaggatgcaaattacctgtatacttggaagtgatttgcaaaagcgttttgctaaacaggcaacattcaagggcctgtaagaaaccagattgattgttttgcttagcactgctgctgctggagctgctggtggttctgtggccagcagtgaacctgatatgctctgcagtgtataatagccatactgtctgaaacagtcttttgggtttacccagggtaacacccctttggagtgtcccccagaaagaacctacctgctctgagtctccagctatgcacttcacccacctagtcgtctctcccctcctccagttcatgtctcagtcgtctctcttggaagatatgaggggcggtttgtccatcagaaaggttgagcagttggaaattcattacaaagcgcaacatgaaagaggcttggagtaagatcagtataacatagatggagaggagtgactataagcacatgacagagatgccccaaaggacaagcaggatgtgctctaggtggctttgtgcttgtcactggggagtggaaatggtgacatatgctacaaaaataggactgggctgacttcacctcttacataactctcatttcatactttcctttcttgaaggcagtgatggtggtctagaaattatttttgaatctgtttaaatctcagctcagtcacttacagaagtgaagtggcttttatgaagtcaccagcttataaatggcaaaattaactagaagctctggttggcagttaaatatttgtattttagtggaagagataattagtgcagtttggaaggcaagttttctggataggacgtatggaaggcggaggtagaattataaaaggcatccttgcaggagaccactacctaaaaaagtctttcttcttgtctgccttgttaacaaatagtatctggtagagggcctgtggtagtcttccaccctggttctttcaggaaattttctgttctaattgcttcaaaagaaacaatacagtattggctggtgcagtggctcattcctataatcccagcacttggggaggctgaggtaggaagatcacttgagccctggagtttgagaccagcctgggcaacatagcaagatcctgtctctacccgagaaaaggaaagaaactatacagtatttattcgatatcacttttgtttaactgcttatgttgccactttgaacctgtcctctttcagtatttatgagtttactaatcctgatacctctttgtcattcagacttggctcttggcactgacttttttttttaaattattataccttcaaagattaccatgtctgaggacaattgaaatattgcagtcttgagtagcatttctcaaaaataattctcaaactgcttagatgtatactctacttttgtgtttgggatctccaagaccaccccaaatccagagactgtctagaactaggacaagtgggtcccagtatacagctgtattcaaggctgagattattaccatatctagtaaggggtcacagccagatcatgatggcagaagacatggggggtctggaggagcctgggtgcaggcttcctacatctgtccctccctgagagggccacacagcaatgaaaatgcagcaacatgtgtccagggaagcccattagggattcagtgcccaagctggtcacataggcaccctctgcctagcatgaaccaaaattccagactcccagaaggcaagcaggttttcagcatgaactacattgtacatcagtttagacacagcgagacactctccatcatttagggaaaattttgtatctgtgtagagaactgttactagccaagttcccagatgccaggcaaggggcagccttggaagcagaccttcctaaggatagcagtctcacatctgctgtgtaactctcttctgtgcatttataaaatcggtattgtaaataacaggaactctaagtttctaacaaaaagtttcccagcttctgtttgtgctttttctttttaaaaaataaaactttaacagccttatggcaaattactgcacaatgtctgatctagtgcagtggtccccaaccagtctatggccttttaggaaccaggccacacagcaggaggtgagtagtgggcaagtgagcaaagctttatctgtgtttatagccactccccatcactcacattaccacctgagctccacctcctgtcagatcagcagcagcattagattctaatagaagcactaaccctattgtcagctgtgcatgtgagggatctacgttgtgtgcttcttatgagaatctaatgcctgatgaactgtcactgtctcccatgacccccagatgggaccatctagttgcagaaaaacaagctcagtgttccactgattctacactatggtgagttgtatacttatttcattatatattataataataaagtgcacaataaatgtaatgtgcttgaatcatcctgaaaccatcccccatccccccattccgtggaaaaattgtcttccataaaactggtccctggctccaaaaagattggggactgctgatctaatggtaggccacaagagggtgtttcctggggaaagcctagctgactacctagcaaaggctgtaggatggcaccattgtatagtcacttaagtcatgaggtccagttctcattttgtaggctcagaaatttgattctgttggtgtacatagaggtggctcatactagccaaacgcatgagagactgacttatatactagaatatccttttataatttccctgggaaaaaaataaactgtcaggtaggtctggtcagcacttcctctgcttttggggagagaaacaggtggagaagtcagaggtttctgattggggcggatgtgcagcatgttcactagtaccctttctctggagacaccagcagtctgggcctctcgggcctccctggcattccttgcataccattccctcctgttgtctagttcttttttttttttttttttttttcctgagacggagtctcactctgtcgccaggctggagtgcagtggcacgatctcggctcactgcagcctccgcctcctgagttcaagcgattctcatgcctcagcttcccgagtagctgggattacaggcacctgccaccatgcccggctactttttgtatttttagtagagacggggtttcaccatgttggccaggctggtcttgaactcctgacctcatgatccgcctgcctcggcctcccaaagtgctgggattacgggtgtgagccaccacacccggccagaatcacctttctttttaagcttgattgtatggatagaccacatcttgtttatgcattcgtccattagcgcacgcttgagttgcttccaccttttggctattgtgaataatgctggtatgaacacgggtgtgcaaatgtttgtttgagtccctactttgaagtcttctattttttttgaaacagattcactctgttgcccaggctggagtgcagtggcgtgatcttggctcactgcaacctctccctcccaggttcaagtgattctcctgcctcggcccccaaagtagctgggattacaggcgcccaccaccacgcccggctaatttttgtatttttagtagagatggggtttcaccatgttgatccggctggtctcaaattcctgacctcaggtgatccacccacctcggcctcccacagttctgggattacaggcgtgagccactgggcctggcctgaattattttgtgtctatacccagaagtggaattgccggatcatatggtaaatatatttttaattttttaaggaacttccgtactgtttttctatagaagctgcaccattagctgttttataatctactcttctcagttaattgtgtttaactttccatattaataaattttcattttatacctagtccatactcacatttatttcaaaatatctttcaaaatatctggtttcaaaaatgtcttttgtatctggtttgttgaaaccagattctagtccagaggtaagtattgcatctggttatgtcccttgtgttctgtctgctaacctagcattgtcccttcccttttttctcttttttaacagctttttctgaggtataacttatataccataaaatttacctgtttgaagtgtacagtgcaaaactttttaatgaatttacaaagttgtacaaccatcaccacagttaaattttaggacatttctatcacccccaaaagatcccttgtgcccattaacagtcaccctcacttctctcctcccaaccctaggcaaccacttaatctactttttgtctctgtagatttgccttttctgacattgcatataaatggaatcatgcaacatgtggtcttttgtgtccagcttctttcactctgcgtaatgttttcaaggttcacccatgttgtagtgtgtgccagtacttctttcctttttatggctggataagagcccattgtatggataaatcacattttctctgtctgttcatcagttgatggacatttggattgtttccactttttggctgttatgcatagtgctgctttggacattcatgtacaagtatttgtgtggacatagattttcattttcttgggtacatacctaggcgtagaattgttgggtcatatggtagatttatgtttacattttttaagaaactgtcaaactgtcttccaaactcagcctcctttagttacatggcacttataaagacagtaggcctaggtcccacgtacagcctcttttgtatttatttggttgttttctcgagatgtctttcataggttgtccccagtctcctgtattttctatgaactggatgttagatctggagttttgtggattcaaattaattgtttctggctagaatacgtcataggttgttttatacttcattttgggtcatatcagcaggtacatatttaagttttttccaagtcgattttgggtccagcatcatttgttgaaaagattctttccccaacttacctttttttttttttttttttttttttttgggagacagggtctcactctgtcacccaggctagagtgcagcagcatgatcttggcttattgcaaccactgcctcctgggctcaatcgatcctcctacctcatcttcccaagtagctgggagcacaggtgcacgctaccgtgcctggctaattttttgtatattttttggtagagacgaggtttcaccatgttgcccagtctcatctcaaactcctgagctcaagcaatccactcaccttggcctcccaaagtgctgggattacaggcatgagccactgcatgcggcctatgtgtggttctatttacagggttttttgtttgtttttttgtttgttttgagacagggtcttgctttgtcacccaggctggagtacagtggtgcaaacagagctcactgcaggctctctccttctgggctcaagcagtcctcccacctcaggcccccaagtagccatcatgcacggctgatttttgtattttttatacagattgggttttgccatgttgcccaggctgacctcaaactcctgggttcaagcagtcctcacaccttggcctcctgaagtggtgggattacgggcatgagcctctgagcccagactatttatggatctttaaagaatccctgcagcctccctaaactcaatctctgtgatttgcctgaggttctactcccagtaccaagacctagaatatgcctccaggtaggaagtcagactaaatgtggggcttacttcctgtgtttcccttctcttaaggaccagtccttttttctattgtctgaaagcagttgtttcacatattttgtttcatttttcagttgggtttgttttgttttgttttgtttttttacagtgagaagccaagatccatgctccttggtagtcagaagcaagtttgtttctctctctctctctctcagatggtttctattctgtgtcttcaagtattctgatattttcctttgtagtatcccatctactaaactcatctaatgtaattctcatttcagacattgtatttttcacttctagaagtttcatttgttttttgttttgttttgttttgaggtggagtttcgctcttattgcccaggctggagtgcaatggcgcgatcttggctcactgcaacctccgcctccagggttcaggtgattctcctgcctcagcctcccaagtagctgggattacaggcacctgccaccacacctggctaatttttgtatttttaatagagatggtgtttcaccatgttgaccaggctggtttcgaactcctgacctctggtcatccacccacctcagtctcccaaagcgctgggattataggcgtgagccaccacacctagtatttggtcttatttaaatcatccatttctctccacattatgtttatgtttttctttaaatctttcagcatattgagcatatgtataatagctgttcttaaggtcttattttgctgattccatcatctctgtaattcctgttctttatttttctcctggttataggtcacattattttctgctttttggcatatctagtaatttatgattggatgccaagcattgtgagtttctgagcatttggattgtattgtcttcctttaaagtttgttttggctgacagtaagttatatacttgctatcagcttgtgttttttttttttaagccttattagggtgtgtctaaaatacttctactctaacactagtttactttttttttttcttttgtgagacaggatcttgctgtcacccaggctagagtgcagtggcacaatcatggctactgcagccttgaactcctgggtttaagcaatcctcctgtctcactctcctgagtagctgaaccacaggtgcataccaccatgctaggctaatttttaaattttagggtctccctttgttgccctggctagtttatctttttttttttttttttttttttgagacagagtttttgctcttgtcacccaggctggagtgcaatggcgcaatctcggctcaccgcaacctccacctcctgagttcaagcgattctcctgcctcagcctcccaagtagctgggattacaggcatgcacctccactcctgactaattttgtattttttttagtagagacggggtttctccatgttggtcagactggtctggaacccccgacctcaggtgatgcgcccgccttggcctcccaaagtactaggattacaggtgtgagccaccacacccagcctagtttatctttaatatcaagacatgttcatctagggtctctactgtttgagtattcactcaggtctctctaccctgtctggacagagttagcctcccaggtattcctgtaccacttattcttcaaggccaggatctgatatctcagtggaatattctgatacagaacatgtgatacatctgatattctgaaacatctgaaacaatgtatgagaaacagctttcattaaaaactacaagtacccatacaacctttctgtttctcactttcagtacggtgttcaataaattgcatgagattattctacactttattgtaaaatagattttgtgttagatgatttggcccaactgtaggctgatgtaagtgttctaagcataagtaaggtagcccaggctgagctaggagaatcgcttgaacccggaaggcagaggttgcagtgagctgagactgtgccattgcacttcagcctgggtgacagagagactccatctcaaaacaaaaaacaaaaaacagtggctttattgggatgtaactccatcattagtcaaggagcatctgtgtatatcttttgataccacactatggtatttgatcctcaccacgaccagttaagtgggtagtataatcttcattttatagggaaaggtagcaaggcccagggaagttggttttgtgacatgttcttaagtggcagagctgggtcttgagcccagatcttctggtttcgttagtcatgccctttaagctccttgagaacagagagaacagtttttcacagagtgttttctcaattatgtggctcacattgaacatatctcaaatcaggaagatatatcttcacatagaaatatatgggatcatttgtttttctttcagaaaagctgtcattgaatcagttgtagtgcctctgaaatcactgttgtagaatcaaggaaatatatagatctctctccagtgcctaatagagcctttatacataatatatgcctggtaaatgtttgtatgctaagttcaagaataagctgattttataaagcaaaatgtgcttctaaaagttgtatgcctgtgcttgtctctgcaggtattttatgcatggtgtgtgtcgggaaggaagtcagtgcctattctcacatgacttggcaaacagcaaaccgtccaccatctgcaagtactaccagaagggctactgtgcctatggaactcggtgcaggcaaggactctgcaacagattccagctgtgacactgatttcatttggagaatgggtcttgataagggggaaattttaatgtaaaagtaatatggcaacatcacaaaaagtatggcaaataagtttaaaacctcagtttcagtaccctaaaactaattttcttttctttttttttttgagatagagtctctcactgttgcccaggctggagggcagtggtgcgatctcagttctctgcaacctccgcctccagggttctcctgcctcagcctcccaagtagctgagattacaggcatctgccactacgcctggctgattttttttttttttgtatttttagtagagatggggtttcaccatgttggtcaggctggtctctaactcctgacctcgtgatcctcccgcctcagcttcccaaagtgctggaattacaggcgtgagccaccgtgcctggcctaattttcattttttaaaactacttttcagccttattcttatgaatatatagttataaaattgtacacaattccggaaacttgttcatgcttttgtagcaaagagccgatcttttctttctagactgcaaagcttccttccctcctttttctctgcagtgcagtgggagatgatggaagtaggcccacgttggtcttcccctgtcaatgagtgccaagagagacagtcagggagagatcattggcccttgtcagcattttggggactcctgctcaaaagaatactgggtcagtcaggcatcaggagattttagctcaacatctgtttggaactttcaggttctctgtgtggtctggtgctgtgtgtctgtcccactcaagtcccacagagacacttaagcataggtgatagatagcaaatgtccccctcacaatgaattgccaagcatctgttaataatcgataatcctgttagagtttaaatattggaaaagatggccgccttcttcacctcaacaagtgcagcagaaggagggccattggcatctggggagtgtgggagatgtgtgtgggtggcatgtctgtaatgcatctgctgtgtgttttgtttagatatgaccacacgaggccctctgctgcagctggaggtgctgtgggcaccatggcccacagtgtgccctccccagctttccacagtcctcaccctccttccgaggtcactgcatccattgtgaaaactaactcacatgaacccggaaagcgtgaaaagagaacattggttcttagagaccgaagtgagtaagcggaagccttttgttgcgtctttttgcatagcactcttgttaatgcttggtgctcctttctagcctcctcttgtcaagaggactcctaacctaatacacctccagattgtctgcgcggagagacttcagaactgttctgaagaggctccatgtggctgcagatcattcaaatgatacattcgccctcgtgcccaaggctgggttgagctccaagactggcctggtaaaacataaaaacacaatctttttgtcaacatgtaacttccatcttcatatggtggttgtccagctggtgagaagcatcaagctcttcatttcaaacgtaaatattttgtctgggtaaagtggctcacacctataaccccaacactttgggaggctgaggcgggtggatcacctgaggtcaggagttcgagaccagcctggccaacatggtttagtagaaaccctgtctctactaaaaatacaaaaattagccgggtgtagtggcaggtgtctgtaatcccagctacttgggaggctgaggcaggagaatttcttgaacccgggaggcaaagattgtagtgagctgagatcacgccactgcactccagcctggatgacaagagtgagactccctctcaaaaaaaaaaaaaaaaaaaagaaaactaaatattttgctaaagagcatgtttcactgtttgacttttaggccagtgaatggtcttagtttttatgctgacagtgtttgacagtttagattgcacctttgggaaaagaatagcacactagggtttggggcatggtctgtgccttaaaacagggtttgatgaggaagaaagctacaaattgtaaaagtttttttgttgtgttttttgtttgttttgtttttgttttttttttggagatggagactcgctctgtcgcctaggctgcagtgcagtggcatgatctccacctcccgggttcaagggattctcttgcctcagccttctgagtagctgggaatacaggtgcccaccaccatgcccagctaatttttgtatttttagtagagacagtgtttcactatgttggccaggctggtctcaaactcttggtctcatgatccgcccgcctcggcctcccaaagtgctgggattacaggcaagagccactgcacctggccataaaagttgtttttattggctggtcctcaccaggtgaagagatttctagttcttggaattggctaccatgaggtaggcagattctgtcctcagcaaatgagtaatcctgtgagaatacgtgacctctaaacaagctcggaggtgtgcagtgggaaggcagcagctcctggcgtgagaaggggtgaccatggggcagtttacactggcctcaggacccacagatttgctctagacatctattctagttcacttaaaatgattttacctttgctggtatgaaggaaacactgtgttctagtgctctcactgtttttttgtttgttttagtgttaactggtccatgtgttaacatttccatatttgccattttaaacggctttagtgttcttttgtataagtatatcctattgttttgctatttccctgtcttgccatttttgttttttgttttttgtttttttaagtaattataagtaatgtcactatgaacattttatactattccttttatttttccccttcggtgtgttttttttgccatatgttctcaagagtggaattcttaggtcagagtagcttaatatgttaggctttggctaacggcataccagaaaaatggggccattttcatgtgcatgtgtgctgtgtgttgttttcagatctctctggcatggctgaaaggaagacccagccgagcatggtgagtaatccaggcagctgcagcgacccccagcccagccccgagatgaagccgcattcctacctggatgccatcaggagtggccttgatgacgtggaggccagcagctcctacagcaacgagcagcagctgtgcccctacgcagctgctggggagtgccggtttggggatgcctgtgtctacctgcacggggaggtgtgtgaaatctgtaggctgcaagtcttgcacccattcgacccagagcagaggaaggctcatgaaaaggtaaagtcacaaacctttgcatgaactcatgttaagaaatctgaaatgtactgaacaggacacggaaggccatccatatacactcaagaaatctgaaatgtactaagtgacagaattgttggtatttccacaggcatccccctgccagtaatacccatattatgtatctggtatatttacatcctgttttcaggttctttttcctgcagtcattttgccattttttttttttaatggagtctccctctcacccaggctggagtacagtggtgcaatctcggctcactgcaacctctgcttccctggctcaggtgatcctcctgcctcagccccaccgagtagctgggattacaggcgcccaccaccacacccggctactttttgtatttttaggaaagatggggtttcaccacgttggccaggctggtctcgaactcctgacctcaagttgtccgcctgccttggcctcccaaagtgctgggattacaggcatgagccaccatgcccggcctattttgccaatttttaattactcagaataaagagaaaaagaagtcgtatctgaaatataaaatcatgctaagttcaaagaacagatctagctcaggaccatggtatgtcgtctgtgtgtatgtctctatcacatgcagatacagcatcctccctccctgggttcacacttcctcatggttgggatccagctaggtgaagttttggaagatttgagcccaaatcatagaatctgaggagccacttgttggaagggccttttaaagtcattaatgtctgcagtgttttgggaggctttgccttatgctaggccctatgcatgatgcagagggtacgaagctggataagaggcgggggagggccaggcatggtgactcacacctgtaatcccagcactttggcaggccaaggcaggcagattgcttgaccccaggagtttgagaccagcctgggcaacatggtaagatccccgtctctacaaaaaaaaaaaaatacaaacattagccaggtgtggtggtgcacacctgtagtcccagctactcggcaggactgaggtgggaggatcacccgagcctgggaagcagaggttgcagtgagccaagattgtgccactgcactacagcctgggcaataagagtgagaccctgtctcaagaaaaataataataaaaaaatttaaaaatgccaggtgtggtggcttggctaacttttaaaattttattttattttggctgggcacagtggctcacgcctgtaatcccagcactttgggaggacgaggcaggcggatcacaaggtcaggagattgagaccatcctggctaacatggtgaaaccccgtctctactaaaaatacaaaaagttaactgggtgtggtggcgggcgcctgtagtcccagctacttgggaggctgaggcaggagaatagtctgaacccaggaggtggagcttgcagcgagctgagattgcaccaccgcactccagcctggacgacagagagagactctgtctcaaaaaaaaaaaaaaattattttatttttcagaggtgaggtcttgctatgttgcttaggctggtcttgaactcctgagatcaagcagtcctcttaccatggcctcccagagtaatgggattacaggtgtgagccactgcacctggcctaaggcatgtttaaatggacagcgtattcctagataatcaagaggtaaattagtactgactccatgtggcagcggacaaggagacactctccattgtcttccagggaagcagagggttagagctgtcttctttatgcaagtgtgtgaggtctctgcggtgagtgttggcttgtctcagatctggacagactgagcttacaagggctgggcctaggtcttctcactcttgctcaaatgccagcacatagaaggaattcagggcatgcctagtgaatgaatgaattcattgaatcattttcttggggagaagtggtgcttcttacataggactaggctgccagcctcaagcctcatggtaaggacgagtcagcatctctgatgtagacatggctcagagtcgggggaaacagtgcccagaggagctgggggactagggccgcagtccttacggactctgactccactgcagtttaacctttttggatctccgtgttctcagtcctaaatgggtggtgaccatgtcacctcctaggaaagcaaggggctggaccagtgatggtttgaagtcctttgtgtggtctgagggagatgtcagtgtcctgacttgggggagcctgggcctttgctcacagcagtcgctgtcagtgttccttcctgatctcagctgtggcagtgtggctgcagctactcctagggctcctgccactcctcagtggcccacaaccaaagccttccttcctgtctgtgcttcagatctgcatgttgacgttcgaacacgagatggaaaaggcctttgccttccaggcaagccaggacaaagtgtgcagtatctgcatggaagtgatcctggagaaggcctctgcttctgagaggagatttgggattctctccaattgcaatcacacgtactgtttgtcctgcatccggcagtggcggtgtgccaaacagtttgaaaacccaatcattaagtaagtacagccaggggtcttagctgtgggagctaggagaatgtttgatttgagactttattccgtccacttttaagccctccgttaccctcaagagtaactggtgagttctggcccctggctgcatgaacttcagcaagtcatttactcttcctgagcctaagtgcctgttcctataaaagatgggcaacaattcctaccaagctttctgggtgttggggaggaactcagcaaagatgatctgtgtaaaaaggtgttaaatggcactgacctgttttcatctcctagccttgtgtttgaaatccagtagtacctgcctgtagcccagttgcctgttaatcattttgagcttcgttttttccccccaccaaaaacgaaaatagggttatttgaggatgaagtggaataatgcatgtaaaacattctgcatgatgcctggcacatgggatgtgctcaatgtggccaacataggagtctcaaattctccagcaggacaggggaagagctggcatgtggagaggttactgcacgcgttctactgttcagaactccacatctgtccgctcatctcattccctcaaagaccctcctcagttacagattaggaaacaggcctggggtgcgggggtcaagtaatttgcctaaaatcgtgtggtgaaacaactgctctattgagataaaagcccacaatttaactcaccactcatccgctttctgtctctacagagttgcctattctggacacttcttataaatggaatcatagaatttggggccttttgtgcctggcccctttcactgagcatagtgttgtcagagttcatcccgactgtagcatgtgccagagtccccttctcctggcggaatatgttccattgtatggacgcagcacatttcccttatccattcctcagctagtggacatttaggctgttttaactttgcaactattatgaataatgctgctgtcaacatttgtgaacacagcatgtgggcatgtgttttcatttctcttgggtatacacctgggcgtgggattgctaggttttatggtataataactctacattaaactgttggagaatctgccagactctgttcaaagtggctgcacccttttacattctcaccagcaatgtatgagggttatttcatctgtcttttttgttgaggaaaccatatatgtgtgtgtgtgtgtgtgtgtgtgtgtgtgtgtgtgtgtgtattttttttgctttaagttctggggtacatgtgcagaatgtgtagctttgttacatgggtatccatgtgccacggtggttttctgcacctctcaacccatcacctaggttttcagccatgcatgcattagctgtttgtgctgatgttctccctccccttgcccctgcaccgacaggccccggtgtgtgatgttcccccacatgtgtccatgtgttctcattgggaaaccctattttgttaatagtaaataaggttcttggatgattgtgatttcatcttttggaatttctggtgaaggaaatgcctgtagtggtgaggcagttgagcaagaggtttagcagagagtgtgcccaggcttcgtaacatgacttctcccttagtaatctaattcttatttcaggtcttgtccagaatgccgtgtgatatcagagtttgtaattccaagtgtgtattgggtggaagatcagaataaaaagaacgagttgattgaagctttcaaacaggggatggggtaagtgcttttgagtttcgacgtgcccctgctgcctgcctggctctgctgtcagcccgtgtcctcgttctccttcccaggagtgtggtcttaggggcctcttcctctcttccttctctcaggcaccatgctgggctctgggatgcagcaatgagcaaggacatggtgatgtggacctgtttagttttggtgttttttttttttttttttttttttcggtgagatagggtctcactctgttgcccaggctggagtgcagtggtgcaatctcagctcactgcagcctcagcctcctgggctcaagcaggagcctcttgagtagctggggccaccagtagtgtgcgccaccatgcccagctaattggctaattttttttggtagagacaaggtttcgccatgtagcccaggctggtcttgaactcctaggctcaagtgatcctcctgcctcggcctcccaaagtgctgggattacaggcatgagccaccgtgcccggcctcaaatgttcctctttatcctggttgtcagcatgttgatattttgcctaggagtggagtggtttttctctacgcttatgtcactccccaagatgagcgaaattttagctattgtttcattaactttttttctgtcttgtttttttcttttcctgctgggactctacttccgtttatgatagtttttttatattgttcatagatctctggggatattcattctttttcaatctttttttcttttcatctccttgaacatagttgtagcagctactttgaaatccttgttatcttgaagttgacctctgttgtcttttaagaatggatcacattttcctgattcttcgtatgtctagtaattttagattttatccttgacattgtaaatattacattgtagagagacttaggattctgttatggtttatctgtaaagtgatgatttttttttttttgagacggagtttcactcttgttgcccaggctggagtgcagtggcacaatctcggctcactgcaacctctgcctctcgggttcaagcgattctcctgcctcagcctcccgagtagcagggattacaggcatgcaccactgcacctggccaattttttgtatttttagtagaaacggggtttcaccatgttagcctggctggtctcaaactcctgacctcaggtgatccgcccacctcggcctcccaaagtgctgggattacaggcatgagccactgcgcctggccaagtgttgctgtttttaacaggcaggtaaattgtttgaactcaaacccaggtagcagttcagatctcagttctggttttgcattcgtagctgactttgtcgcattcctgtgtggtttgggagttagtcagatttgggcagagtttatacacagcctttgagcactttttcacaggccccttactttgtgggattgcttcctcactttccaatggctgtgatttccttgaactcttgtcttttagttcttcaggccagaaagattggatttccccttggagttttagccaccccatgtggttatgattttggcctgctccaggataagagctacttctttttttttttttttttttttttttggagatggagtcttgctttgtagcccaggctggagtgcagtggcacagtctcagctcactgccacctccgccttccaggttcaagcacttctgcctcagcctcccaagaaggtgggactacaggcgcatgccgccacgcctggctaatttttgtattttagtagagacagggtttcactgtgtttcccaggctggtcttgaactcctgagctcaggcaatccacctgcctcggcctcccaaaatgctgggattacagatgtgagccacaaaagctaccttttttaaaaaaggtaacttagcctttgccattgctattcttctttgtgtttactcctccaaagaatctaactgcgtttgttcattctctggtgccttcaggtcttcttgaaatatttgtgttaagacttatctgcaggagggttgggtatggcaggcgtttacttgtcatactaaaagtgaaactatgcattaccttttttaatggttcctttatgttgcatattagtttactaaagcttgattttttttttttttttttttttaccattttttcctcatacaatcttcctgtgtgtccacaagagggcaaggcgtggcaagcagaggggtcccagcttgtagaaaagggccccagcctgtagaaaagggtcccagcctgtagaaaggggctctgctgaaaagcagtctggagattgttattgctatttggatctttccttgctttgctttcctttaatgactgtgttttttgcaatccacaaacatttactgagtactcactatgggtcaggtaccttctagctaagcaccactgggggatgtagagattagtaagacaatttcttttttctttcgagtctcgctctgtcacccaggctggcagtggcatgatttcagctcactgcaacctccgcctccagggttcaagtgattcttctgcctcagcctcccgagtagctgggattacaggtgtgcgccacgacacccagctaatttttgtatttttttagtagggatggggtttcgccatgttggccaggctggtcttgaactcctggcctcagatgatctacccacctcagcttcccaaagtgctaggattataggtgtgagccactgtgccccgccaagtaagacaacttcatgggaaactgcaaaagggcaattatgatacaggtttgctggtgaccagttcttcatgagggaccatctatcacaacagagaaagcacttggatccaccgggggctgccaggggaagcagcatgggagcctgaaccatgaagcaggaagcacctgtctgtagggggaagtgatggaaggacatgggcacagaagggtgtaggttttgtgtctgggggacactgggagtggctcctggcattgaaacaggtgtgtagaaggatgtggtgggacctacagactggaatctaagggacacttgaatcccagtgtgaccatggtctttaagaacaggttggggccaggcgcagtggcttatgcctgtaatcccagcactttgggaggctgaggagggcagattgcttaagtccaggggagacatagggagacctcatctctttaaagaaaaaaaaaaggttgggaagctcctccgtgctgctctgaaggtggaaactggtgggagtgggagggaggccagtgaggaagtggccctggcaggcaggccccagaggcttccacaagtgtgggaacccaaaggaaggggagattgggaagtgatttgtaaacagaatgaacacagttgggtgtgagagccgaggacacagagtgagtcagagtgaactggaggcttttggccttggtgaccagataagcctgggggaggaaaaagagtaatattcttgtgagagtgggggaccagtatataatgtgtttgacctgatcgagttcatagccagtgtgctaggatgctctggagttgtccagcaggctctggtgagagcaaactgctcacggtcatttgaagtccgctcagaactccaggcaagcaggggcctggaggatgtgtcgtccacacacctgctctccagccacctgtgctcaaatcagatcagctggccagggagcttgttctctctccccccaccctacccccccgccaccacccccagtgagacgaagtctcactctgtctcccaggctggagtgcagtggcacaatcttggctcactgcagcctccacctcctgggttcaagcaattctcctgcctcagcctcagcctcccgagtagctgggattacaggtgccagccaccacacccagctcatttgtgtatttttagtagagatggggtttcgctgtgttggccaggctggtctcaaactcctgacctcaagtgatccacccaccttggcctcccaaaatgctggaattacaggtgtgagccaccacacccggccagagggcttttctttatgctgctatgaagccgtcctcagagaacttcaccaccggcctgcggccatcccatctgacaagacggaaaaccactggattcaggagcctcctttccctgttcttgtctcccgctgtcacacaccccagctgcccctgacagcagcgtgccctttctgttgtttggctttatttctgtgactttccccttcctctgtactccgagatggccctctggattcttgggtatctttttttttttaacttcagtttgggatcctttatgattggataaaccagagttcatttgagcaaaatgggaattcatttgattgagtttccttgggcagggttcttaacatagaggtctgtggggagaatggtagaattaagagagagggaaaacattttgaactgtttggtcactgtatgctgtagacccatgttttatgcattgaaaaacactgttcagagaaggggtccaaagcacataaggcgtgaagaagccctccctggtgccgaggttggagacaggaaaactggaaggagacctatggctttaggcagttgctaaaaccctctgctttccctgtagccaccttgacagcactgcggccaggaggaaggggagagttggcttggtggggtacctagggaactttgagcagagacaagtggcccagcttcagagcttagtgcccagaggagtgaccaggcctggcttagctctgtggtgacccaggaggtgctctggagctgccggagggcctgtggagcactgcagtctccacacagcaagtccccaggcaggttaatatcctttgcaaggctgcaggtaagtggggatacttcctatcctgcttggaaatcagaatcccagctgtgtgtgacctgagacaaatcactcaacctctcccagcctcagctgccccacctagaatgtgaggctgacctacctctggcgtaagggtggtaaggatggaggcaggcagtggcccagtttggacccctcattttcccaccagcctcttgactttttctttctgcttttcaggaaaaaagcctgtaaatactttgagcaaggcaaggggacctgcccatttggaagcaaatgtctttatcgccatgcttaccccgatgggcggctagcagagcctgagaaacctcggaaacagctcagttctcaaggcactgtgagggtaaggactttagccatctctagttggggacacttagcagctgtgggcatttccaggtaccgttcctggcagagaaatggggtaggcaaaagaacgatcaaggaacgcagccttcctgttgctcttagcagtaaccaggcatgtccactggctgtttttgcagttctttaattcagtgcggctctgggatttcatcgagaaccgagaaagccggcatgtccccaacaatgaagatgtcgacatgacagagctcggggacctcttcatgcacctttctggagtggaatcatcagaaccctaaagagtagatggttgccctgcatcttgggctccatcggccgaaactttcccaagccagggtgtgcggagcttccctgtactgcagccaaggtgacgtgtgacttggatttgagtggagttgggcttagccttagtctcattcaatctccattattacagccatggggaagagtgaaagatataaagtaacctaattaaatgtatggaattgctatttttatagctgatatagttacacctcaagcccctcaggggtaacaactaacaaacacccaaactgtttggattgattgctttaaaaaacaaacctggctcttacctttgatcttttcttccccagaaatagtaaacttgcagctgcccctaatgcagcatatttttcttaccaaaggagtcttcagccctataaaaggattcctctatagtgtatttctctagtgtatttagtgtgtcgtcaaaattttgatttatacagagctttcaagaacacacaatgcaaagtgagcgcagcatagctgttaacaaacatacaacttttttctagggctttaagggtggtcatttttttcaagttctctcaagtgtcccaaatcagggtagcaatcttgttgccacatgtgcagcaaacaaagtggaagtatagatcttcttctcccttagggaggctcttgaaggagcaggaggtacagtactgggtagcagtctggccctcctgtcgtctggttggtgttggggcctccagccagggccctctaggggaaccaagcctctgctctcacctgtgggttcttgcccatcagggtaattgtattgagaactcaaatatacgtgcacttacatgtgtggttcgtactcaagtgatctattatctagctgcaaagcctggctttgatttgaaattttgtaaaaatttcatggcacccaaggtttctgattctgacccagcagtggtcctgaagagagctgatggcaagtcttgtagtcattttgattttaattgaagggtgagcataaccttgtgaaccagcactagcttgttccaagctggaatttatctaatctatttttgtgtttaaaaaagctgtacctaccaaataaataaatagtttataaaatgtattacttaaggtattagctgagtttagagtactttctgcttaattaatttttatacttaactcttcagtagaggtttacaaagagtacaaaggttaaattacaaattcattcccagcctaggctctgggcacatttcctgttcttgaattctgctcctgaagagggtgaacaaatggggcattcaagttgtgagctcagaattactttaaaaggaggtaacagccagccattacacctaaatttaatttattttattaaaataacataattgagggaccatcagataactgtattttgtcaggtgcaataaaaacaaaattaaaacccaaatcatcaag

SEQ ID NO: 38281 - DNA, 2338 bp, Homo sapiens
cgcacgcctgctaggatcagcggtggtggttccgcgatggtaggcggcggcggggtcggcggcggcctcctggagaatgccaaccccctcatctaccagcgctctggggagcggcctgtgacggcaggcgaggaggacgagcaggttcccgacagcatcgacgcacgcgagatcttcgatatccgccgctgctgggcgcgggcgggttccgggggcttgcggtggggggagcagtgatatcgagcagctggtggagccgcatcccagcagggcgttcctggcagagggttctaagtgggcaagggcgcagagtcccttttccttcacttcccacatctgattcgctccatcaatgacccggagcatccactgacgctagaggagttgaacgtagtagagcaggtgcgggttcaggtgagtcacttccgaggggagcgagttgttccagagagtcagaaaggtttctgtgcagcaggagctggcgtgctctatgctcacgaacaccgaagggtatctttggggagggagattgttgtgcctattttatgggtgttgaaactgaggcccatagaagttggatgatttgcccaaaacaacaaactaagaagagggaccttgggctgagggtggttgactcttgacatctctcctccacaaccaggttagcgaccccgagagtacagtggctgtggctttcacaccaaccattccgcactgcagcatggccacccttattggtctgtccatcaaggtcaagcttctgcgctcccttcctcagcgtttcaaggtcagttggagctgagccccgggagtgagaccaggcattgagggtctactgctgaggatggggactgggagagcatgaacatggataggacatcagagtggggcctggaaggatccccattagcagagaggaaactgggaggaagctttccaagtcgatgtgacaagaataaagatctgagctggaaagtggagaaaagtattgaagagtgtggcaggaagggcagtagggagcggcagatgggtttggaccaggggtggggcacaggcaggcctttaaatcaacagtagtgggccagttctttggatagaattggaatagctagggccgggcgcggtggctcacgcctgtaatcccagcactttgggaggctgaggcgggtggatcatctgaggttaggagttggagaccagcctggccaacatggtgaaatctcatctctactaaaaatacaaaaattagtggggcgtggtggtgtgtgcctgtggtcccagctacacgggtggctgaggaaggagaatcaaattgaacctgggagacagaggttgcagtgagccgagattgcgctgctgcactccagcctgggcaacagagcaagactcagtcttggaaaaaaaaaaagaattggaatacctgtggatgggtttggggtgtaacggaagggccagagtccaaaggcatgattaggaggaaggatcagctggagatggtgcctgagggtctgggggctgcagggaaaagtgtgggtcggtgggtgggtgttcaggccctggttatctccctcccagatggacgtgcacattactccggggacccatgcctcagagcatgcaggtaagtgtggactggtggtgagggtgttggcccgggcaccccctaagcagtctgaggcttcccccttgcacaggagtctatgggcaagactggagatgggtaactgtgtgagtgaaattgccagagactcctcagtatgggttatagcctagaccgaagctggcctgagaagactctcctttgcttaccatgtcctcttctcccaaatcccctctcaccaaatatacaggaccagagtgtgtcaggcttcagcagcgcaggaggcagccagggggagggatcctaagaaggcagattaggtgggctcaggtggttgaagtagcctgatcaatatgtggggtcctgggaaggaggtgacaggagggctctgttgctgcgggggacatatcctatatagaggttcagaggtagggctggctagcactctggccagagcctagctttgactctgccttccccacacccttcttcccacctagtgaacaagcaacttgcagataaggagcgggtggcagctgccctggagaacacccacctcttggaggttgtgaatcagtgcctgtcagcccgctcctgagcctggcctttgacccctcagcctgcatactggtatcctggtcccagctcctgccagggctgttaccgttgttttcttgaatcactcacaatgagaaactaacattttgctttttgtaataaagttaatttatattcagt

SEQ ID NO: 38282 - DNA, 52040 bp, Homo sapiens
gtcgcgttgaagccagcgtccggccggcagagcggcgtcggcggggttggccggggcggtgtggcgctagagcctgggcgggccgggggcaaggagtcaaggcttgggggcgggtgacgggcgggcggagggcttgcccccgtgtggtcctcggagcggcccgaggtccagcctcccagcggtcccggaggaggatgcgaccggggggccccgggcggggcggtcggcggcggctgcagcgctagcggcgcgggggctgggcggcggcgccggcatgaggcgcagggccggtgtccgcgggagggtggcgctgccggcggcccggccgctcccgctgcaattgctcgctgggctcgtcgtgccctgccagtggggcccccgcagctctcgtcccggccgccgctggtgaccactcgccgcccctccggaggcttcacccgcgccctcccccaggacgcgccagcggagctccggctccttcgccctggacgcggaggccgcggtgtgcggggcgacggcgaggccggaagatggcctgggtgctcaagatggacgaggtgatcgagtccgggctggtgcacgacttcgacgccagcctctcgggcatcgggcaggaactgggcgccggcgcttacagcatgaggtactgggctccctgggcggggagaagcctctgtctccttggggaaggcctgcgcagccctgagtctctgccagatgcggctgctcccagaggtgcgcgggcctcctgggctgcggggtcggagtcctgccgcgtggcggtcgggggccatggaaccccaaaggcctctgctcgccctggtgacgggcgggtgggggaggatggccccgcaagcgtcggcctcggaccgctcctgagtgcttcatatttgctgtaaaacacgcccagctattaggatggcttgggttggtgggggaaggggcttcttttccttataagtgatttacaagtcccattggagctagaatacactgtacgaaaaggcagcacttatattgggagaatactgtctagcgttttgggatcagttcctactttgttgtcctacattatgatcttttctggctgcagattttaatcacttgatgttagtaaattataattgaaagagcagcggtgggagtagcactgtgacttcgttttgttcttttgattgtctcaaagtgaagtttctcattttggagactaccctctcaggctgtttcctcttgagggttttaagatgcagtgattgcaccacaaataattgtttagtctctgctgtctgtaccagcagtcattcattttaatatggagagattgaaacagatctgagcttagtctccgccctttatcctttttaactgttaggaatttggaaactctgtatttttttagtggctttattgaaatatagtttaccatagcgttgacttgactaataaagtctaaaaatcagtggtttggcagcttttcaataatgtgaattaagtgtagctttctgttctttagaaaatgtctgatgttttggaagtgctctacagtttcccagtagcattcatacatcttactgcagctctagaggaggacttctgggttaaagctggcctggaatcttggtggctgctccttgaagtaattgggtctttaaatcttaaggagaaattctgagccataaagaactctcagaaaggttggagacatttcttggagtgtggaagtgagtagtggaaggcatattaaacctggagttccccagcgtctggctctgatttggtctctgttgggcttcctgaacttggcacctcttctctctgcagttgtataacttaaggcctgtagatgagttggcttattttctaaaacagctgtttcagttgttgaggaaattgagctactgaaagtcatggagtcaccccagaggggagtattagaggcagtgcttctctagtgaaaacgcactcctctagtgccattctgctccttagctctctactggaaacacgaggcttatagtcaaggcaaaggaggcacgtgaagcaagttcaatatgtgtctctcctcagttgcttctcttttatggtaaaatgaaagtttgctgctgaaaagtttacttattgatagctattttgagcttttacttttttctagggttttatttgacctgtactttgatttagtgattcagccaacttattaatgtaataacttctgtgtatggtttatttccatgaaaaggaagtacaatcttgatgattttaaacctttccctgaccatgtatttttaaagtaatgtgtgagatctttgtaattctgtgtaacctacagtactctttacagggataattttcccttgaattcttttttggttgtgtcatttaatctaaattttcaaagaagtttgaaggtaattaccatttttaagaaggtttttttttcgtatttaattgagtcctcaaaaactaagagatgagagtgcttgcctcttgcaaattcaaggccctttgtttgaaattctcaaactaaggaaattccaaaattgactcgataaggagaaaatctgaagaaggcgttagctgctgcaggcctccctggactgcagttgtactttccatgcctggccctggagccctgagagggttggagtgcctatgaatggccagcttgagcattcagtcacttcctctggcatccagtgggaaggaaagcttatctttcaaagttcaagaagtaaacttgaagaaattactggaaaaatgacttcttgatacaaattgattttgtaggcagctttctatttttctttcaaaatgaaacatgcttactgtatttgctttttggatggcttaaaacaagaggtatttcttaaaagacttctcttagggaatggtttcctcatcttttgggaggatagtttgaaaggaagaaatggcttctgtcagtggtctgacttaaaattaggcaggtgtgatgtttggtatgcttgtagacctagctacgtgggagattgcttgagcccagaggttcaggggtgtagtgtgtgctatgattgcacctgttaatagccactgcattccagcctgggcaagaatgagacccccttctcttttgttgtttccccccacccctttctcttaaaacagtaggaaaaatatgtttgtgtaaaataatgtaggctggtaatattgggaatatattggggctaattactaacattacctttgcttctctttttcttttggctctggttctcatgtgttctgtgtgtgctgttgtattatacttttttgttgttgtttttgtttagtcttttttggtggttatatttggatgtgagatgtgaactgcagcagattctatttgaaatgaggcaggtcataaatgtttttaaaaatcttggttacagtaacaggattttagagatggatagagaccttccttagaaaccttttagagtctagaccactccttttcttatactgtaaatgcattatctgagggtcatagatgttaaagtgattggcttaaacagatgaaggctgatttttcccccacacagagtgaagactgaaactcatggtaacttgaaatctgggtcattctcgttttgtgaagtatggagtagataaccaaatgactttaaaaaataatactcattaaaactcaaagagggtctttggaccacctggtaattttctttccatctcactgtatgaaatttatcatctgtagccaagttaatttttaggatttgggggctcaatattgaaatatttttgaaggttataggaagtaatggcttgtatagcttactcttttaaaaattttgatattaaattattactttaaaaaaggtattgtctgagccctgtttgttaaacttcgctgtggtataaatctcttgaaacaaaagatatacattatgtattttgaaatgggaggtacatccatagtttacaaataatttgctaaatcaaaactgctttgagctaatgacagatttcctatgttgattgaaaggtaaaatgtttatttaagaaatctattgtacaacaaggttactgtagttaatgatacaatgtattcttgaaaaatgcaaagggtggatgttaatgttctcaccacagtgataactgaggtaatacgtttgttaattggttgaatttaaacattggacagtgtatatatgtcaaaacatcgtgttgcacatggtaatgtacactattatctgtcactttttaaaaagttaaaaaaaattaatgttatagatcctgtaaggtaacagaatttcaacttagatcagtattaagttagtacaagattagcaagggtagggtttattatgtagctattaataattgatgattttcttttggtctcatgctaaaatagaatgtccctgagtaggtgatatatatcttggaagtacagatgatctccaacttatgatggtttgacttaaaatttttgttgtataagccatattcattcagtagaaacaccttcagtagacactgtatgttgtattttgaattttggtctttcccaggctcctgatacatggtatgatgctctcttgtgatgttgggcagtggcagtgagccatagttcccattcagtatactgtgttgccaagtggttttccccgactgtaggctaatctaactgatctgagcatgtttaaggtaggctaggtaagctatgatgttcagtaggttaggtgcatgaaatgttcgtttgagactaggtcttgctctgtcacctacactggagtacagtggtacaatcatggctcactgcagtcttgactttcctgggcttatgcagtcttctcacctgagccacagagtagctggaactacaggcagtgccaccatgcctggctaatttttaaatttttatttttagtagagataaggtcttgctatgttggccaggctgataaatttatctttgatttatattttcaacttacaatgggttgattgggactttattatatgtcggggaacatctgtgtagaacaattttaggattagtgaaatttaaaaatgggttcttcagaatactcccagaattggcagtaatttctgttttttttccttagaatcttttcatgaagcaatttctataaaacttctaatttcaaggtttaacaactttttcctggatttaatcttggctgcagtacaggaaatgatttaataaattaactcatttaaaacatttattgatttaagattatagtgtccacattttaaaatttattactgtaaagctaaggttggcaaacctttctgtaaagggctaggtagtaaatattttaggctttgtgggatgtatggattctgtcacattttgttttttacaaccctttaaaaaatgtaaaaccagatcgggcgccatggctcacgcctataatcccaacactttggagggccaaggtgggcggatcacgaggtcaagagatcgagaccatcctggccaacgtggtgaaaccccgtctctactaaaaatacgaaaattagctgggcatggtggcgcatgcctgtagtcccagctactcgggaagctgaggcaggagaatcgcttgaacccgggaggtggaggttgcagtgagctgagatcgcgccactgtgctccagcctggtgacagagagagactccatctcaaaaaaaaaaaaaaaaaaaaaaagtaaaaccattcttaccccataattgtgtaaaaacgggctggttggatttagctcttaggccatagcttgtcaacccctgctctaaaggatagagtcaccgagcgcagtggctcacgcttgtaatcccagcactttgggaggctgaggcaggtggatcacctgaggtcgggagtttgagaccaggctggccaacatggtgaaaccccatcttacaaaattagctgggcatggtagcgcatgcgtgtaatcgcagctactgggaggctgaggcaggagaattgcctgtgcccgggaggcggaggttacagtgagccgagattgctccactgcactccagcctggggtgacagagcaagactctttctcaaaaaaaaaaaaaaaaaaaaaaaaaaggatttgctgactactgaaaccttactttcaagaaattatttttatgtagtctaagaactgtctcagctaatttatgtaattccattgtttgtctatagatttttattgtgttcagtttttaaaattagggttcccccgcccctgtaagatatagtacagtttatatccttcaattaggactgtttgaaacttggtggtttattgatatggtctcctaaacttgatgtttcatcatagtggcatttgttggtttgccagtacacatttaaacgtttgctttggctggaaataccatctgatgcttttttctttttttttcttagctgtaggttctatgactgatactattattattattatttttagagacagggtcttgctttgttgcccaggctggagtgcagtggctatttgcagacttgatcactgcacactacaggctctaattcctgggctcaagggattctcctgccacaaactcccaagtagctggacccacaggtgggccacatggtgcccagcttcatgactgaattgaaaggaggctctgtattatttactttgcttgttttgggacagatctaatagatgaatatgaaattgtcagcctttggtggtagagtcttttttttttgagatgtggagtcttgttctgttacccaggctggagtgcagtggcactgtctcagctcaccgcaacctccacctcccaggttcaagtgattctcctgcctcagcctcctgagtagctgggattacaggtgcatgccaccacgcccagctgatttttgtatttttagtagaggtggggtttcaccttgttggtcaggctggtctcgagctcctgacttcgtgatctgcccgcctcggactcccacggtgcccggcctatggtagtcttttttttttttttttttttttttaaaggctgggtgcgcggtggctcacacctgtaatcccagcaatttgggagactgaggtgggtggatctcttgaggtcaggagttcgtgaccagcctggccagcctggtgaaaccccgtctctactaagaatacaaaaatcagccaggcatggtggcatgtacctgtaatcccagctactcaggaggctgaggcaggagaatcgtttgatcccgggaggtggaggttgcagtgagctgagatcgcgccactgcattccagcctgggcgacagagtgagactccgtctcaaaaaaaaaacaaaaaactctgagttttttggacattgtgaaattgttgccttgatatgaactatgacaaaactagttattactcattcatgtattcatagttgaacttttaacttaaaactcttcattttgaaatttttcaagttacaaaagtagtatggagagttcacatgtacccttcacccagcttctcctacttatacaaccagagtactattgtcaaaatcaagaaattagacttggtgcaatactgttatctaaattacaaaatttatttggaattcacagttgtctcccttttgtcctttcagattccaatccaggattctgtattgcatttagtttttgtgtcctgtaacaatttttagtttttccttcttttatgattttgacacttctgatgtgtagtggttaaaactgttttagaaacatgtaattttttggtgtgggtggggaatgcaaagatgagacacacttgtgaatgctatttagccttgaaaggatctcttatttttagcagtgattttgagtagagtaggaccacagttgcttgtatttgtttagttactactttgtctcaatttatctaaatataaataggatgctgtatatgttgtagtaacttcataatgtgaaagtatcaagaaatttgaaaacattaaaaaatttatttagaataacaattacaaaccattgtgttttaaccaaaaaatttttttaaattaaaaaactttgccaaaacagagaacttagccagaagagggtcacactgtgttacccaggctgaagtgcagtggtgcaatcatggctcactgcagcctcgacttcctaggctcaggtaattctcctacctctgcctccctagtagctgagtttatgagtatgcgccaccatgcctggctaatttttttgctattttttgtagagacggggtttcaccatgttacccaggctggtctctgggctcaagcagtccgcctgtctcggcctcccaaagtgttgagattacaggtgtgagccactgcacccagccagttttaactttctttggatgagtaaatgtttgactatacatgtaatttatttaatggatatgagagtattcagattttgttaatagtggttggttcatgaccttggctgtcaagtatgtctttcctgctgctctgtagtttataccataacattctcatccatttcctcccctactcatctagaaagcttaatgacacctcctcagcctcacaactcatccttgccatgcctattttcaactgattcccttagttatttactgggaaaatggagctgtcttttttcgttttttttttttttctttgagacggagtctcactctgtcgcccaggctggagtgcagtggcgcaatcttggcttactgcaacctctgccttccagattcaagcaattctcctgcttcagcctcctgagtagctgggactacagacgtgtgccaccatgcccagataatttttttgtagttttttagtagagacagggtttcaccatattggataggctggtcttgaactcctgatgtaatgatccgcccgcctcagtctcccaaagtgctgggattacaggtgtgagccactgcacccggcggaactttcatatgctgtactggcttgtgagtttttctatggtgtatttaggtgtgtatttcttatttattctggtttggtcatttgggcttcttgaatccatgaattggtatatttcaccagttctagaatttgctcagccttcctgtcttcagtttttgcccctattccgttctttgctgagacttgaatttaatgcaaaatcttctcacttggtcccttcttaacttcttcattttcctctctgtgctgctttctgaataacttctttttacctatattccagcattccagtctcctaattcagtcttcacttctgtctgagctgctattaaacctgagttcttaatttggacagttttattttccagttctagaagttctttttgctctttttcagttttgctgtcctttaaagtttcctgttccttccagatactttcaggcttttcttttatttctttaaatagagtaagtacgattttataatttggatctgataattccagcatctgaaatctctggtggtctgtgtccagtcaggaaaatagaaatcagtgagatgtctcaagcagagagggatttagtgaagtatttgattgcaaaggagctggaagggttggaggaggaggccatgttacctggttgttcttgggcttgttgctggaggcatggctgctgatcccctgaaattttccgcagctgcattccgtgtggttgcctgtttttgcatctggcttttccctttcccgctctttcaattttccgccagtgtttgcctttggagagcctgacaagactgtctagcaagaattcttctatatgtagttttcaggcttctaaccttctgcagtagaggcagaaaagatctgaataccagcagacaaaatctggaactggatatatgtcatctgttgtttttgctgttggtttttgcttctagagtcttgtttgtccttttatgcctggttattttggtgtactggcatttcagaattacttggaataatttgatgcctaagtcttttcacttgcttgtcagacccctgggagccctacctgtcagtggttccccggaccaggctggagaagctaaccagtactttcccttcacccttaccctgagcatctagttgttctcattccagtttaatgtggatggctgtatcctacacccacaaggccactaaaactacagtacagctttgcagttctttcctcagtttgggtaggtaaaagccactttcagttctaggcttgcttggacttactgcactttttcagatttcagcctgtttctttatcttgttagttctttaatactttcaagaatatatgtgttctctgacaacttttttcccccctatcctcagtgagggtggatggggtataggttcatttaaattacttagcctgccattactaaacagttctctatgttgttttttctattttgtttctttcatgtctctttagaattctcatttagcttccatatatgttttatctatcttgtccttaagaaaaattcaaattttcactgtttttgaaaatcagtacattcacataattattttcaaaggctatgagagggtgtacagtgcagtctctgcctcacactagggtcttgcagtcattcatttgtcctccctgaaggcagcttacattgctggatttttagatgtcctagtagatttttatacttcatttgatcaagcttgttgtgatttccaagtcttttttagcatcctgatttttggtgctaagctacattaaaatttaccaacatgtagatctttcagttttgccttctaaaatgcatcatttgggcctggtgcagtggctcatgcctgtaatcccagcactttaggaggccgaggtgggtggatcacttgaggccaggagttcaaaatcagcctggccaacatggggaaaccccactctactaaaaatacaaacattagccaggcatggtggtacaagcctgtaatactagctacttgggaggttgaggtgggaggttgaggctgtagtgagccatgatcatgccactgcactccagcctgggagacagagccagaccctgtcttaaaaaaaaaaaaataaagaaacaccctacttttagttccgtttaacattctgtctttagtactcaaaagtctgtttccatttatgggattacaaaaaccatcaaggttttaggactttcaacatagtagaaattataatcttgtctggagacctagttttcaatcttaatactaattggttgattattaatgcagcaatcagttcattgatttagcaagtatttgagctcctttgtgctagatgctggcatcagtcattgaagaaacacgtatttggagttacgtgcttatagcagatacaaagttagtaagtcatgtatatttttggaaagtggtaagagctgtgtatagagctagggtagggaaattgggagtgtgggtgggaggactccagtgtcatgttgtcactgaaaagatgacatttgaatgaaatgagccattaggatatccagtagaagagtagaatcaggaggccggggtagttggagcagggggaatgagggtgacgagaagaggggttgaagagcaggttgcgtagggcttttttttttttttttttgagacgtaggatttcgtaaggactttggttgaaagtgagctgatgtaaggattcagagaattgaaatggtttaacttctgtttgaaaaggatcactggttgctgtgttgactggaaggcattttctttctaattaagtaaaaaattaattggaaattcaatagcaaataatctttacatgtttatatgtttgttcaggagtcgtttagcacttaccatgagcatagtattttctgtgtggatcatggagactataaccaagtgaataaaaaagtggttgtcttctaggatctgaagcatataaaattgtcttccatatgtgacaatttattaaaaaaagccattctcatgcagttatacatcttattttgatgatctgtatctaatgatcaacccaagcagttagcattgaaatgttaaaattattccctgtgttatttttcggtataattaatggttctgagtcacaactctcattcttgttttctttctctctgagagggttttaaatgcttacatatacacaaaatgcagtatatatttttatcttccctggagccaatttgactgttatgactgatttttataaagaggtgatctgattcttttttttttttttttttttttgagatggaatctcgctctgtcactgaggctggagtgcagtgtcacgatctcagctcactgcaacctccgactcccaggttcaggcaattctcttgcctcagccttccaagtagctgggactacaggcgtgccccactacgcccagctaatttttgtatttttagtagagacggggtttcccccgccatgtctcgaactcctgacctcaggtgatcacccacctcagccttccaaagtgctggaattataggtgtgagtcactgctcctggcctgaagtcttctgaaaagtttttatatctgcccccaaggcaggagcttaggtggggcaaaatccctaggtcaaggtgttgagagaactctgtgggagtgttgggaccattgctaaccgtgtgatccttggttattacttgtgtacgtaggagtgttttgacaattcctgggtataaataagagagggagaattagtggatagttagtatctttgaaaatcagcacagtgctttaatagaaatgcatggggggagtagggactactggtgggataacgttctctcccagggtttccgtcccatttcacttgttttcacattctgtttttgaattgaattgaattgacctggctacccaagtatcttagtgaacagcttgtaggaaaaaaagagaaaataagcagttcagacaagtccctattattggtgttgatacagtagttattcatttgatgttttgttgttgctgttattatcattttactttttattgaagaatgagtatagaaaagttaagatacaaacgtacagctcagataattatctcaaaaacaaataatcaccttccatacattaataggggaaatgtaaaattattgcaaccactttgaaaaacagcttggcagttgctcagaaagttaaacagaggcggggcgtgatggctcacgcctataatcccagcactttgggaggctgaggcgggcggatcacttgaggccaggagtttgagactagtctggcctacatggcgaaaccctgtctctactaaaaatacaattacctgggtgtggtggcacatgcctctaatcccagctacttgggaggcggaagcatgagaatgacttgagcccaggagtcagaggttgtggtgagccaagataccaccactgcactccagcctgggtgacaaagtgagactttgtctccaataaaataagtaaaataaagttaaacagagttaccatgtgatccagtaattccagttccaggtgtatacttagcagaatttatctacacaaaaacatagaaaagtgttcatagcagcatgattcataattgctaaaaaatggaaaccacccagatggccatcatctgaatggatacagaatacggtatgcctatacaatggaatggagccattaaaaagaatgaagcattggtacatgttagaacacggatggtccatgaaacatgctaagtgaaagaagccagtcacaaaagaccacatagtcatatgattccatttaaatgtcccaaatagcaaatccgtagagatagaaaacaaatcagtgggtgccaggggctgagtgggtctgggatagtatggtgagtgactactaatgggtatgggatttctttttgaggggagaaaatattttggaattcaagaattagatactgatgatgtgaatatacttaaaaccactgaatttcagactttaaaagggtgactttatgatatgtaaattatatttcaataaagctgttaaaaccaaacaacatccaataaaaacagtgtcccagaagacccctcatcattctcccaatcagtgccccaggttattcttagggggagaatagcagctgctgcgactgctgctgctcctgtttacctctcagtaggagccattgttttagattaggcatgaagcttcatgttcttaacacttgccaaggcacagcagggaactttttgtaaaaccccattttaatcagatgcttctttgtaattctatggtgtcaagtgtgacctacctttggcagcagtattatttcttgcctttcaaatcaagtagctaggtactcttgacttgctttttttttatagaaagaatctggaccttaaagttttaaaagaagtttttaaagtgctatatatatatatatatatatatatatatatatatatatatattcagagctgccctgccgccctcccccacttcccaccccgagataggggttgttaatgccatcctttagatgaaccacatagcattcatagttcttttattctacatataatttctgatcttaaaaaaaaaactatccctaaatgtttatatgcttttaaatatttcagacaagattgggtgcattcaggatgatatggctgtagacaaatatttcaaacccaaagtaaggtcagtgttgattttttgcttttcagtgatgtcttggcattgcccattttcaagcaggaagattccagccttccattggatggtgaaacagagcacccaccctttcagtatgtgatgtgtgctgcaacgtcaccagcagtaaaactgcatgatgaaacgcttacttatttgaaccaaggttagtgtggttatgtcacatttgacatgtaagaatttacagaaatacaaaataatattttggcattgtagcctagattattggtaataattaaaaattaggttctttttcttaaattttacaacttaatgaaaattgtaggaattttactgtgagcagctgaagtacagtttgtgtaaactgatttgcattaaagagggtctgaggaggaagatttattacaggatttttaagacataatccaaaggactagcaagtaggaaaggaagtcagttatttttagggacagtgatttcaatatggaacttgagaatgaatcagaagtccagctagcaaggaacctggattttgaacatgaagcagttctgtgctgaaaatagacttaagctgcaccaggatggagtctgtggctaaataaacatcaaattttatcccctatatcttgtttgtagtttatgtcagagtgttacatttcagtgatatgaaagggttggtggggaaggagggaaaatagagatgtgggggtagtttacctttttttttttgagactgagttttgctctatcgcccaggctggagtgcagtggcgcaatctcggcacactgcaacctccgccccccaggttaaagcaattctcgtgcctcagcctcccaagtagctgggattacaggcacacaccatcacacccagctaattttgtgtaattttagtagacagggtttcaccatgttggccaggctagtctcagactcctgaccttaagtgatccgcctgcctcggcatcccaaagtgctgggattacaggcgtgagccattgcacccggccgagtttatctttggaaagaggagagtttgccctttgcagtttgggcacaggctgatgtgacttacccctgtaaacaaaagtattttgaatgcaggaattaatttgttggatacatatactgaaagcaggttgaattctgattttaaacaattttttgaacatttttactgttatatgctcattgtagaaaaactgggaaatatgtgaagggataatgccaaaaattgactaatatttttggtctgtttcttgaatgtatatacattttctttcaaaaaattagaattatacatctgttcacttgagtatatagtgtttatttttctgtcattaaatagaatttttactcgaagttttggaaagagcaatagattttagacttttacatgtgattaatctgaaatgtggaagaataacttatttctaccttttcatttgatatataagtttagaatctataaggttttaccttcaggtagtcctgtctctggcacttgtgacaattccctgtttgtttttatatttagtgtttggataggcaatcacttatttgagagttaagttttatatttgaaagaaccttaataacttatttggtaatctgttgtagacataaaaataacagaagaaacaatgtaggggcaaggatattcactgtaactttatttctaaagataaaaaaggaaataacctgaattttccttacttgtggaatagtcgattaagttctgttacatacataccatggaatgaattagtacacatatacaccctgtttaaagcaacatgtaggatgtgcatttattggcctgggggaatgcccataatttatcatggttgttcttaaaccagataaagatatttcatatcgataaaagtcataatccaccatctgtagtagtgatatagtagactgacattaattgatactgtgcatctagcattgtactaaatacatgtgttaaccttattcagttctcacagtaactctaggagagatttattcatttatagattaaacttagagcagttaattaccttgctcagtgtccatttggaaagcttaggttttaacaaaatttttttgaagtattacagtaatgtgcacaaatcttaatgaatttttacatatatattcccttgaaactactacctatttccatcttttccagtactccagcaggctcccttgtgcctctttctcaggtgatacctcacttgaatataatcaatgtaagggcaggtgattttcttgtcctttattctgcttactgcagtattaatgttgagtattttcttggttctggaattgtgttcatttatttcttgattttttctagtcttttcagaaaaaaggtagaaagctgaactgtatatgtagacatgtttaaaacaacatacattttagtaattttaaaaaatatgggccgggcacgatggctcacgcctgtaatcctagcactttgggaggccaaggtgggcggatccatgaggtcaggagatcaagagcatcctggccaacatggtgaaaccccgtctctactagaaatacaaaaattagccaggcatggtggcacacacctgtagtcccagctactcaggaggccaaggcaggagaatcacttgaacccgaggcagaggttgcagtgagccaagatcacaccactgcactccagcctgggtgacagagcgagactctgtctcaaaaaaaaaaaaaacaaacttttttttgagtaattttaaaggaactgtacttttatgtacccttttaaaagaaattataactttcaaaataatacctatatgagtatcatatataatatagtgtgttgtgctttgcacagactgtatcttagcatttatcatcttgacaaaaagttttaaacccaaaattttccatgaatccttaaacaagtttttaattttctataaatgtatattttcttccttcccttccttttctttttctgctccctttctcttctccccctttctccccccctcctcctctccctccccctctcccttctttctccctctctttttggtcttgctctgtcacccagactggagtgtagtggtacaatcatgacttattgcagccttgacctcccaggctaaagtgatccacccaccctagcctcctgagtagctgggactacaggcacaggacaccatgcctggcaaatttttaaaaaaaattttcgtagagatggcggatctcactattcattgcccacgctaatctccgactcctgggctcaaacgatcttcctgccttggcctcccaaagtgctgggattataggcgtgaaccactgaacctggcctttttttcttctttcctccctcctcccttcttttcttttccttttatttgtttgtttttagagacaggatcttgctatgttgcccaggctgtttttgtactcctgggctcaagcagtcctcctgcctcaggccttctgagtagctgggatgtagtccttaaaggtatatttttctaatgagaggattcatagctttttctagatttggacaaggattggaccagactgagacatttctgagtatctttcaccctacctctttgtctactgaataatagaagcttgctaatttaaagtaataagacaaacaaagatccagactagcaaagtatcttcagctcactagacttgcttttctttttctttttaattttattatttatttattttttgagacagggtctcactctgtctcttaggctggagtgcaacgatgcagtcttgctcactgcaacctctgccacccaggctcaagggattctcctgcctcagcctctggagtacctaggactatgggcacatgccaccatgtgtggctaatttttgtattcttagtagggatggggttttaccatgttggtcaggctcgaactcctggcttcaagtgatccacccaccttggcctctcaaagtgctgggattacaggtgtgaaccaccactcccagccgaaatggtcattcttgatgaagaatatttgccactatgtaatgctgtaaagaaaataaaaatcaaatttggtatagtcttcactttgtcagtagaaattggagcaagttttcctagttgtattgatgtcttagtgtcattttttgagttctttttgaacctcagagggactgagtttaaaaacttatttgtgtttaaggctgggtgcggtggcgcatgcctgtaatcccagcactttgggaggctgaggtgggcagatcacgtgaggttaagagttcgagaccagcctggccaatgtggtgaaaccatctctactgaaaatacaaaagtagctgagcatggtggcgcacgcctgtagtcccagctactcgggaggctgaggcaggagaatcacttgaacctgggaggtggaggttgcagtgagccaagattgcaccactgcactccagtcccccgcccccgccccctgcaagaaaaaaagcaacctgtgtttgtgtttccctggttatgcctgaataagaagaggagttaagtccctgactttaactctggagtaaaaactgtagtcccaaaatggagccaccagagggtggagtacacatagctggctttccctttgggcagagatctggctggaataggctgccttttgtcttaacagctgggggctgagcctgtgatgcttccacacctgataaatatgagtgagacttctgatcttacccccttgctgacttgctactgctggatcagcccctaactcttcaaatgaaaagaatttctccttgttagtccccaaatacattttcatttggagaccaaattctacttggagaatacgctgctaagaatgttaattaacccacctgtaatcccagcatttttgggaggccgaagagggtggatcatctgaggttgggagttcgataacagcctggccaacatggtgaaaccccatctctactaaaaatagaaaaattaggctgggcatggtggctcacgcctgtaaacccagcactttgggaggcagaggcgggtggatcacgaggtcgagagatcgagatcatcctagccaacatggtgaaaccctgtctccactaaaaatacaaaaattagctgggcgtactggcatgtgcctgtagtcccagctactcaggaggctgaggcaggagaaccgtttgaacccaggaggcggaggttgcagtgagccaagattgtgccactgcactccagcctgatggcagtgtgagactctgtctccaaaaaaaaaaaaaaaaaagccagtatggtggcacacacctgtcattccagctacttgggaggctgaggcatgagaattgcttgaatttgggagagggaggttgcagtgagcccagattgcaccactgtactccagcctgggcaatagagtgagactctgtctcaaaaaagaaaaaagaatgttaataaagtacagctataagtccctagaaacagcatgtttattggattaagaattccgttaaatatttcagaaagttctttttgcttagtttcatttttcacaacagtagatttcctcctggttagtttcagttcatgttactaaagtttcatgataggaataggactttagaaataaggtttctaaagcattgaatttagcaaagtgggggctgtcacatcttgggctccatgttgccctggagtcccatttgatgaagctagactagagtatgtgtcttcaaaggtgggtggggacatgaatcacaacagttatatttttcaactctggcagaatttttgcatttctgagccaaaaatggaacaaaaaataaaacatgaaaagtaaattgagaaaataaagctaaaaataggactagcatctcacagaatattactgttggactatattaactttatatttcattaatactggatccttctttatatttcagttacaacctagactgttgtttcaggaagccgtggtattaaaaattatggattggggacaaattaggaaatttctaaaagtctggttgttctctcaatggatattaccattgaagaatataatagtttccaatagggaaaccactttaagcgtagcaagtgttatagagtcttttcttttcttctggttttttttttttttttgagatggagtctccctcttgttgcccaggctggagtgcaatggcgcgatctcggctcaccgcaacctccgcctcacaggttcaagtgattctcctgcctcagcctctggagtagctggcattacaggtgcctgccaccacgcccagctagtttttgcatttttagtagagacggggtttcactgtgttggccaggctggtctcaaactcctgacctcgtgatccgcccacctcagcctcccaaagtgctaggattacaattgtgagccactgcgcccagcctaattttgtatttttagtagagacggggtttcaccatgttggtcaggctggtcttgaactcctgacctcaagtaatctgcctgccctgacctcccaaagtgctaggattacaggtgtgagccactccacttggccaactcttgatttttctgcctcaagtcagctcctggctgtctttgaggtcaggaaatggtgactcttcttcaattccttgatcaaaaatcaggagtaatcctcaactcttctttctgttacactttacatctaatacagcagaaaactgagggatttatactgttctgataggtgaaaaatgatttcagtgtggttttaatttgcatttctctaatggaagttgtctttcaatatgtttaagaactgttggcatttccttttgtgaacccacatgtccatttcatttgctcatttttttcttctagggatactggacatttgttagcaattttttttttttttttttttttttggagacagagtttcgttcttgttgcctgggctgtagtgcagcggtgcaatctcagcttactgcaacctccgcctcccaggttcaagcgattcttctgcctcagcttcccaagtagctgggattacaggcatgcaccaccacgcccagctaatttttgtatttttagtagagatgaggtttctccatgttggtcaggctggtctcgaactcccaacctcaggtgatctgcccgcctcgggctcccaaagtgctgggattacaagcgtgagccactgcgcgcagcctaattaaatacttcttatggccgggtgcggtggctcacgcctgtaatcccagcattttgggaggctgaggcgggtgaatcacccgaggtcaggagttcaagacttgcctggccaacatggcgaaaccctgtctctactaaaaaataatacaaaaattagctgggcgtggtggcgggcacctgtaatcccaggtactcaggagtccaaggcagggagaattgcttgaacctgggaggtggaggttgcagtgagccgagattgcgccactgcattccagcctgggcgacagaacgaagctccctgtcaaaataaataaataaataaaaattaatgtttcttattgatctgataatcagcataaaccttttgttgatttttatttcctaaattcttgtgaggttgagtgtaattttaaacataaatggtgtatttttcaaaactttatattcttcattttgaaaattatttctgttttcagaatatagatccattgttaaatatagtgcatatatcttcttccaatctgtgtcttagtttaactttttaaaaatgtctcttcccatacaggtgttttttagtgtttctctgtctgttgaatgaatgtaagcaacttttctttgtaacagactatatatatgctgttttccttcaccagccttggagtgatgtagttgtattttgataaccccttgttgaattttgaccctataatctagaatcctttgtatatttttctgtaagccccctgggagtatggacaaggtgttggtagttataaagattctcaacttcatgtgatattataagcattctttaatttttactgattttctgcatgccaaattatactgtcatttttattatttaataacagataatccagaaatcattttttgtggatttggagtacattattaatttttttacagcagcattttcctaattatctagattgatgtgtgaatatctgtgttttctaataaacactaaaagtggaaacaacccaaatatccatcagctgatgaatggataaacaaaatttggtttagtctttacacagtggaatagtattaggcaataaaaaggaatgaatattatttggcaataaaaaggactgatatatactacatatgggtgaaccttgaaaacattatgctaagtttaaaaagcaaggcacaaatacccacatattgtatgattctgtttatgaaagtatccagagtgggcaaatcgtagaggcagaaagtggattggtgatcgctagcagttggccaggtggggggtgggggagggatgggaagtgactaatagaggtttcttcttaggatgatgcgagtgttctaaaactggtagtggtgatggttgcacaactctgactatactgaaaaccaatgatttacacactttttaaaaatgtgaattttatggtatgtaaactatatctcagaaaagctgttacaaaaattagtcttaggtaatgcaagcataataaaagtttagtgtaagagagtggcagatgaagataaattgacagagaaactcttgtctcctgtaataatgttagaacagaaggttggtgtgattttcagggaagagaaggatcaacctgaatttgcttccgtagcaaattaacaaactatcattgtgtaatgtatgttctgagaaacatgcattttgaattatgttaagcaaagtgatgttctttataaggattgttttttatacacaatttctttaaataggtcagtcatatgaaattcggatgctggataatcggaaaatgggtgatatgcctgagatcaatggaaaattagtaaaggtaaggacagtccattttaattcccaatggatattgctgtgattgaatgagtttttgtttaaaaaaaaattaatttcacttcaataattgttgtattacaactttttaactttatgagctatattttgtttattcacctgtaaaatgggaattatagcagttattgggtagagtaattttgaaagacccttggaaatcaaggagcaatagaaaagttagttgtagttatggggtaaaaaactcatcaccacaacaaaaacctataagcctctctaaaagtaaaagataatatggggaagaatgtcaatgttggcataaaactttaaaaaatcctttaccttgtaaagtttcatttaaaaaatagaaatctctgttcaccctactcatgtatctgaatgaagaagtcagtcatcctaggtataggaggcatagctgttttccagctaacctgttcttttaggatgtatcctcagaaccatccctgccccctggcccctcctagcctgtatccatcatacatcatggctagttataaattccatagcattacagggcagggttaatgaaagaatcttaattggggaaaggtaaaacctcatgtggctaactaagtgttagcaagagacaagttctcttgatccttccatcttcccacagagtggcatgtcagggcccaggtgctgctgggccctcagtgtggaggggcattctattggaaagacctgccctctgtggatctgcctttttagtgggtaagcatgggaagggcagccttgtggtgggaattggattcaggcaatctaaatttggtgtgttaactaatttggcatgtatgggaaagccagctgcccagtacctggagggcacctggaaggttacttagggatcaaatgatgggttaccaaaggtgctttggaacttcttgaatgtgcagaacatattcagcaatgtgctttctctgattgttctgtttttgtctttctttgttctgtgtttttttttttgttaatgtatcagtgtaaaagggttggaaagttgttttaattgtgaactccataataaaatttagtaggatttgatgggccctatactgaggtctttaaaactggatccaaaaatgttagaacaatttttttaactttttattatggtaaaatttgaacatacccagaagtaaagagaatggtacaatgaatccacatatatccatcatatggtggtatataataaatatatctggtatatatcatgagttctcataagttctcatgccaacttcaacattctccacaatttgccagacttgtttcatctattccccttgtgctttttttgtgtatgccggattatagaatttactaatttgtaattttaactcagttcttcattcatgaccattcagtgttctgaggaaaatataacaaactttgacatccagaccaaatgccaaaattcagtgtccatcaaggcattgaagaaaatcaattctgaagcaattgtctttgtcatttatcagtggagacaagctggctttccagggcagttccctgaataggtggtaggatttagaaataattagtctgataggtgatacctaatgtttaaaatattttggcaagctggttaaaatacctgtcagattaacttgggatggcagggtaaagttgtatgactgctttaagttcaacttccttgtatttacttccaaattaaaacatgtaaaaacatttaatatacaaaattaatgcaagcaaataaattaagggaaaaatgacacctcattatgacgtaatgaactactgttagtagcaaaaccattaacttataaatgcacagtgaatgttttgctgacataacactagtatattccacctagacaaggttacttattctgaaggcatcagtatctaaatatttagcccactgattgaaaagggttcatttttaaagcattttacattggcttcatcttctgtttgataagccagctgtgtgatttttggtggatgtgccaggcatgcagttatattctgtaagcttgtctgggattaagagctactgtctgctactaccaaagactgcaggatgagtttcttggaaattacatcctttttttagctagagaatccctaaaatatgcttcaaatttctagagttttatttcctggccctaggatctttgactatactacttaaatttgtgggggaaccttggggatcaagtgataggtttgcgaaggtgctttggaacttcttgaatgtgctgaacatatttagcaatgtgctttctctgattgttctgttttcgtctttttttgtcctatttttttcttttagtcttattgttagggccccatcacatgttgctagttctgaaaatgcagtcaatctccttttagggagaactttcagataacgagattttctccctgtttcatataagaagttcctttcctctctcccgccctcctccctctctttctttttctttcccttcctcccttccttttcattcctttcttttttcctttccgttcttttttgggtaggggtttctggtagaaactggaaaacctgctagacaaattctaaaagctatataatgctagaatttttcttatatatcttgtaatttcctaactttggtcctccttttatctttagtattttagtccaaccttctagaatggggcttagtaaagctctgaagtctaatacctgtattctaatactgttttcatctgaatatgtgtagttagtatggttcttactgagtatggaacaattagaactgtgatattttctgtgctgtacttttttctggagacgagctggctagcagatgtgaaccactggcattggtgtcttaggggccaccactagcctatgcaccatcactatgagagctttgctctggtcaggtgatggtgtgaagtgggtgctgggtaattgcttggacaggccctgcaggtgtgggtgcaggtaaggaagatgggaataaagcagccactgagccctataaatgtctcccacatggtactctttatctcaaagaaaaaaattgcttttaattggctgctgggattacaggcatgagccccaccgcacctggcctaagttcactttttcaaggcagcgggcagtgtttcggatttttgttttatgccagttcttttttttcaaaactcaaagtttttttttttttttttttgtgatggagtctcgctctgtcacctaggctggagtgcagtggtgcgaacttggctcactgcaagctctgcctcccgggttcacaccattcttctgcctcagcctcccaagtagctggtactacaggcgcccaccaccatgcctggctaattttttgtattttttgtagagatggggtttcaccgtgttagccaggatggtcccaatctccctgacctcgtgatcctcccacctcagcctcccaaagtgctgggattacaggtgtgagccaccgcacccagccagaagactcaattgttaactgttattttaaattaacaaagttttaccattgtttctgggtttctctgtctccatcttttcatttttaataactcctgtgtgcatctggtattttctttataggaatgtaattcttgctcattaattttagtgggaagaaccttaattttgaattgcaataacaaatcattttataaaatcaatacctaagttaccattttatttataattttagtttttgagttataattctttgcaccaaataattgtaccgtaatccaggtatccaagggcaaaagagttcacttacagaatgtttaaaacagaatctagttgtatgtgttctactgctacaggttaacacataagaagtagaaatggtcctgcattttagctggagcagtttaaaagtactcattttccgcacttattccacagagcatcataagggttgtattccatgacagacggctacaatacacagagcatcagcaacttgaaggatggaagtggaatcgcccaggagacagacttcttgatttaggtacaggcagtgatcaaaagaccatggagatgagggtattgtttagctatagccagtaatgtgttgtgttggcatcatgaattacttgtgtggggaaagttttggtgtttgtggattttgtgtcttttttttttttttttgagacagagccttgctctctcgcccaggataagtgcagtggcacagtcttggctcactgcaacctctacctcccgtcttcaagtgattttcctgccttagcctcccaagtagctaggattgcaggtgcgcgccaccatgcccctctaggatcttgtgtcttgagagttgttttctatatatacatacgcacacacatacatatatatgtatgtatgtatatacattattttctttttatttttttcccatcctcgtattataaagaaccgagagagttgttttatagttaaaacgtcaagtagctttttggtgctaaactaatgtgaacctggaattttatgattttgaaaccgtttaattgtaaaccatctatcttttttttttttttttttttgagacggagtttcgctctgttgcccaggctggagtgcagtggcgcgatcttggctcactgcaacctccgcctcctgggttcaagtgattcttgtgcctcagccttttgagtagctgggactacaggcacgcgccactgcgtctggctaatttttgtatttttagtagagacggggtttcaccatgttcgccaggctggtctcaaactcctgacctcgggttatccacctgccttggcctcccaaagtgctgggattacgtgagccaccacgctcagccttatcatattcttaaaaaaaatgaaatacaaaccatggtaggggaaacgatgatattcgtttagggtgggtttcgatgttgaagaagttgatcatggagaccattgaaagacagagttcaaagcagttacagttatttcattagaacataatatagtaagttgtaagttttttaagttatttaaagtggatgtttttatgtaacttctttttaaaacatagatattccaatgtctgtgggaataattgacacaaggacgaatccaagccagttaaatgcggttgaatttctgtgggacccagcaaaacgcacctctgctttcattcaggtttggatttttacattattagaagcttactaacctagttatttaggtcatggtaggattgaatttttgatacagtatcatttcctttaaatgtctatttataaactatgttgtagtgtctttctatatacatagttaggtttaatctagtaagttcaccctattttaaactaacatatatgaagacattctatgatatgtaaagcattattcaaatgttatttttaccactagtagtcccaataatgaaaatgtctatttttcatgagatgtatttctcttgaacacaagctgctatttaaaaggatacgattgaaaaaagattgaggttttaaaattccttctagcattatttttaaaacattctaatactgaaaaattcaaacctctacaaataggataataatgatgactaattgtccatgtaaccatcacctggctttagcagtttttagtagtttccgcccccttttagttattcttggagcacttttttttttttttttttgagatggagtttcattctgtcacccaggctggaatacagtggcatgatctcggctcactgcaatctccgcctcccagattcaagctcttctcatctctcagcctcctgagtagctgggattacaggtgtgcaccacaatgcctggctgatttttgtatttttagtagagatgggggtttcaccatattggccagactggtcttgagctcctgacctcaagtgatctacctgccttgtcctcctaaagtgctgggattacaggtgtgagccactgtgcccagcctgttagagtactttaaagcaagtttcaggcataccatttcatccataaatatcatgtctctaagagatgagttttaaaaagtaactataatatcattattctgtgtttaaaaaaaatagtgattctaatacccacaatgttcaaatttgtatgtggtggaatttaaactaccaggtaggtaatatatagaaaaggaaaaccacttacttgctgaccagccttcataagctatgctttgcatgaactgtaaaaaatcatttgtattttgcattttggtattctaccaatattattctccatcagttaatccctgggggcatggtttatatccgttgaatattgatgtaaactcatactgttggtgtttgtctataaggcaactagttatgtagtaaatcaaagtgatacaagacctggctttacatatcaggttgtgttgtcatattgcagagatcagttttaatagtgagtcattagaagagggggatgtgcagcagtcagaaatgaccaaggtcttgctgttaactctgtgtgaaaccctaaggctgtcatccagggtgggtattaggagacagggcaggagtggtggaagatgagtattgccctctggatcctgaatggactttgaagagttgaccaaagagtttagatggatacagaataggatgggtagtgggttttctggactgtaaaatttccccaggcaaagtatcacaaattggcatctgtaggaacagcagtaagatagttggctgggtagaataggggtaatggcagtagagggcaaacaacagaagctctaaacaatgaagtgaagattgctgtggattgaacagggcttagtaccctgggtctgagatgagcagacagtccaaggtggaggtgggcagtatacataggaagctactgtagtgttgtacccctgattggacccaagtcctgcattagaggagaggcactgtgatgggcaagagctcagaaagtctggagaggctcagttggatttgtgagagggaagccatatcttaaaaacaattaggttcatagataatttggctaatatgtgtgatgagtttattttaaaggatcttgaatttatagtggtgtcaggtcactcaagagggaacaaaatagaaaaataaccagtggaagttctttgaatccatttcagcctgaatcgttttataggtacactgcatcagcacagaatttactccacggaagcacggaggtgaaaagggagtgccctttaggatccaggttgacacctttaagcagaatgaaaatggagaatacacagatcatctacactcagctagctgccaaatcaaagtttttaaggtaagacagagaacccgggttttctgtaattaaggctcagttttgcctgtaaagctgtgtgtctgcagcctgatagatgaaatagtatactttgtttttaagcctaaaggtgcagacaggaaacaaaaaactgaccgagagaagatggagaagagaacagctcatgaaaaagaaaagtatcagccgtcctatgataccacaatcctcacagaggtaatgtagtaaagcatttggttttggaagagaagcaaaggttgcatattagtctatttctaagatgagttctgctacaaaagggttggggaagattgggtggcagtttgacatgttattctctgtgaaatttctggggaaaatatttaaatttggggattttgatagactgtttcctgggtgggatcttaaatgaagatgctgaaatcccaatgaggtcttagaaacagaccttaaaaactttgaagttggcaagagacttaagttggagcctagaaagtccaatttttgtcactgctggggttttgcattttttttaactttgaatcctgttagtcatgcatttgtttaattggactgaagagacatgaaacagggtgttagatctttctttgtataatgaaaagacattgatcccaatctttggtgtttgtccagatgaggcttgagcctataattgaagatgcagttgaacatgagcagaaaaagtccagcaagcggactttgccagcagactacggtgattctctggcaaagcgaggcagtgtaagggacttctgcttctcttttcattgtgcaagaaaccttgtgcagtgttagatataggaccaacttccaccgcaaagtaaagccaaaattgtttttgatgtccatgtcttgatttaatttgcttttgtttagacttcctgcttctgtttgttcctcactgaggaaaatttcctaaatctaacactttaaaacaaagcaaaaaacaatgttgaccatattgggtggttttggagggaaaaaaagacactcagagatatgtattccctccctgactccttcccttcctccttccctccctctctccttcacacacacacctccttcaagagcactgaaattaattgaaaatactttctttagtaaattagctattatttttgtgtaactgaaaagggtcttgctttctcatgtgtatacttgataaaattttgtggacagttagatgatggcagcaagcttgacattaacacgtgcagttctttgttacatttttctgcatgtagtataaaaatgtgtgtctgtctatgcttctaagagcctgtttggcagcactggtagaaaaaaaaaaactctgatgggattcatgtttcttcttggcagttgcattgtgaattaatgcttcaggccaaagtagtgtaccttgctacacctagacctgggccgcccccaatatgcagtcagggggcatctggttgaatatgtgctttgtccagttaagtatagcaaatctttattttatgacatgactcttcatctattagtccacaaacgatgatcctgctttgcaaacttagatcagctacataccttcagtaaatataaacacagaacattaaagaatcatttaaaataattgtcatcatatgtattcgtgactgctgtattcactgttgcagtctttgcactattaaagtaccagaggatttttcattcttacacatatcgcaattgctgtggttaaatgtagactttgaatgttactgtcacaagcactatcacaagaaactcatttccaattatagtatcgaataaaaatgttttaatgcttctctatgcaatgaaactgaaattgtactcatcctagtgccactggaagcacacgttacattttctttaactgggcttttttttttttttttaaataaattcgaatcaaagattgttaaaacagctgtatattctttcctaaaacacccgccccagcaattttgtttttatcctcttctgatttctcagctgaagacccaccaatggttcttagtaaacttctttgggggggattctggcaactcacttttcctctcctgttataaaccatttaactaataaagaagtaggttctggtaattcctaaataaaagaaattcattatagcccagaggtaatctgaagatgggaaaactgttggtaaattcttaatgattcttaagtctaaagtatgcaaaacgtcagcagttcactggcctgggatttcacatcttcctcatgtattgcttactgccctggctgtatttgattttgttcagatgcttttaggggtggttagagctcatcttgaaaacctgtttttaaaaatgcagggtacagattgtcacttaaaaaggaaagtttgcagaatttcatatgtttcttcaaactcctacaaaggaaggccaacatttcatagagtttttggctagttacaattggctttcagtaaaaagggatatccagacttactgttagagtcgaaaagatgccgaatgaaatggtgccacactgaatagtcactactgttggttaccaggagatgccgtacaacaaaactcttagtgtgtctgttggtcttcatctctgagctgtatatgattggctcaaatgatgactgccaatttctacagcctaaaatgggtgatcattctttacctggggagggactgtgttcacagtgtaccgaaaccataactatgagcccaggccaggcattgctagcgccgttatgaattcaggagcataggcactgcaccatcgcttgcttttcgaatgttagaagaatctaaatatctaaaagcaaaatgggtatttatggagttttggtaaacttggtgtttctacattactctgccatgctaacttgaagctttttgatggcttcatttcttcaaatggctggcaataattacaaaaagtttagagagacttgatacttttaatattaaatggtttacattatttatacatgtatgttatgctgtgttatgttttatatgtgcagggggatgttgtagcaggaaaatctttcagatagtagaggtgaggtgacagtgtgtgatacccatgattagatttgctagtcagctcacagggtcttgggttcatcaaacagtgtaaactgaggaggtgatactttgtaaggtggaaagaaaaacaagggtctagttttttagttatttatttatttttttgagatgggctttcactgtattgccaaggctgacctcaatctcctcaagcagtcctcctgcctcagacttctgagtagttggaccacaggtgtgtgtgtgccatcacacctggcttaaaaggccctaattttaaaagaatgggcattgttgtgtaaaatgtaatttatagcaaagttgctatgccatgcaataagtttattcaaagctctccagctaaattagatttcttttttgaaagctgactgataatagaagtaataagtctgcaatcatttttcttttttaaggagatacataattgggtagttgagattattttccatgtatccattgcttttgatggatgtcagacaagcgttttaagcccctgtagccattggtgagacttaatttctgccctcagtgtgcttcacagtttcttagctccattacaccagtggtcttgacacttacctactcaaaataatttttaaatttttttagagacagtgtcttgcccagtcacctgggcctggagtgcagtagtgtgatcaaagttcactgcaacctcaaactccttggctcaagtgatccaagacacttgagacaggttctcgctgtgttcctcaggctgatccccaactcctggcctcagaatgatcctcccaccttggcctccgaaagtgctgggattataggcatgagccaccatacctggcctcaaaagaattttgaaaaaggatatacttgcacctttccagattgacatctgaaagttttcatcataaagttttttcatcataaatttaaatagctgcaaaggaggcaatgttctggcgtggtggtgatttgcgtttacaatttaagataaaactgtgacattactcttgaagtgcatcctatggaatctaaatgccatggcagtttgaccactgctattgttcattcaaaaaattcattaaatccaagattttactctgttcttccttcttggtctcatgtttgtatttcactccccttaaattttatcctaatatgacatagttttatgcctgaaaatctttaaaaatttttttcttatttatttttattttttattcctgaggcttcaaatgatgaaactgaaatttttaaatgatcaccctaaaaaaattgccttacaacaaatttacataaattgaaatttaatttttaaaatttgctgtgaccatagcctcttaactcagtcaagatatttaaaacttattagtaccaatttatcaaaacaacaaatcctacagattttgatgaatatttattacatgtaaaaatagaaatattattggaaatgcatcttgaatgatgagacaggatagaatataacttctagaattttatacatatgagcaattttgttttttctttcggtagtgtcattcaggtcctggaagtccttttgaatcatctgtcaaaaatcccagggacatttttatgtgatctactagattatttcaatatatgtcagttgacaataggtccatcctcctgaattattttgatagcaaataattgaaaatcacctgacttacagaaaaacttagtcattagagttatgtactttttctttcctttttttcaagatgggggtctcactctgttacccaagctggagtgcagtggtgtagtcatggctcactgcagcctccccttcccagattcaagcaattctcctgtctcagactcccaagtagctgtgactacaggtgtgctccaccatacctggctatttttttttttttaatcctattatctttagcttggctttgggagagtcttcattatatttacttatttatctattttcattttttttgagatggaatctcgctctgtcacccaggctggagtacaatggcacgatctcggctcactgcaacccccgcctcccaggttcaagcgattctcctgcctcagcctcctgagtagctgggattacaggcacacgccactacgcccagctaagtttttgtatttttagtagagacggggtgtcaccatgttagccaggatggtctcaatctcctgacctcatgatccacccacctcagcctcccagagtgctgggattacaggcgtgagccaccgcgcccggcctcattatatttattttattgtttttattttttggtagaaacagggtctcactgtgttgcccaggctggtcttgaactcctgggctcaagctatcctgggctatcctgggctaccgccttggcctcccaaagcactgagattaggggcatgagtcaccgtgtccagcctgggacagtcttaaaccccagggctatagttagatgtgatgcctttcttgtgtaaaatgagagaaggatgattatgaaaggggacccttgaaactgagtcctcagatccattggtttttagaaagaatacctgtaaagtgaaatcacaccatgtgatgtctgtatctcaagtctgaagacttgtatttgagattactctggcatgcttagcatgcttttgactgactttttcaacctcctaattgtaatagtgtatctccgtgtctttgttctgtttctggtcagaattttgcctggagctgaaaaatattaaagttcaccataacccttccagaaaatataaaagaaagaaagaaggaaagatagatagatagatagacagacagacagacagacagacagacagacagacagacagatagattagatagacagaccagacagacagacagatagatagatagatagatagatagagatagatgtagtactgtacacagttgatgtattttgatgctgggcctgtctggtctgtcttgaggattattaacctttagaggtatcagagaagcaaatgggtactggtgaggctgctcattagggaagagggcaaaaggagcactagctaggtcagagccatgtttcaggtcaccatgtgatgtcagatgttgcttataaatcctttcttgtcttcgccattcttaaatcttgataggtgcctgttgggaaactgataaagaggatactggtaaagagggaggagaaagctcttcaaagcaattatacttaagcatatattttaaatgcctttataaatttttgctgctgtcatcactttaggtcttctctaagattaatcagtgtctagacgcacacagcaggtaaaacttttctttgccacacagaagtaaatttgacatgtgtctgtgaggttgcttgataaatgtcagctgtctcgcattttataatcttgcatttggttagtgagtgaattacaaaaatatttcttccacatattttaaaagcatatcactaatttatttctgtttctgtccttagtgttctccgtggcccgatgcccccacagcctatgtgaataacagcccttccccagcgcccactttcacctccccacagcagagcacttgcagtgtcccagacaggtatctagtttgtgtgatcgtgtgcctgcagctaactaatgctcatgtgccttcatttccccatctctccatgtacagcagccttttgtttgtattgtacctaaaggaaacagtaaggggaagtatcctgtatcttggtggcagaggacaatcattgtcttttcttcacctaccagccttttttactccgagccccttgtgccttaacatagtcacaactatggtaattgtagacaaggcgccattttcaagacatagccaagatatattctttgtaagattaaagacaacattaacagtgtctataggtagagagagagggacaaagtgagtttattactaagttcattcacttgtctgtaatgcttatatcaaatgggttattttctgcagtatttcttttctctcccaatagatatgctatttttttaattaaatctttaaaggaagacctttcggtttctacagacttgctgtggttttagaaatggaaatggtggactctttattctgttatccagccttgactggcaagagtctagagtaagctcagggtgggagcaagagactgcatttggggcatcttgaaggtacagcagtaccccatggcggctttccattctagggctttgctgcagaactaatgcagagtagttagcatcagaagttccctatttttaggaagtttcttgttggggaggaaaattatgaaagctaagatcacaaagaaaaaggttctccggtcatgctgacaaggtctgatgagaaagcaagcaaaaatgtgctctccccctgaggagatggataaactgagaaggcagcttgttgtcatgtaggctattatgctttaagagtagaaaaatagccttggactcagaaaattagaggagtgaccagaggaccagtaggttaccatgtctgagggcttagaatagtttcctagtcagtcagtccggtctgaataatcttagaaaatgcttatggctttaaaggtgagctgtaagtttatgtactcactagtagactggagaacttattgtgttcccagcactgttctaagtgttctgatacattagtgcccaaacagacagacccccgtctgaaggagcttaagttcttatgggtagaaaggatataaataatcaagataataaacctaagcaattgaggcacgggggctaagaaaggagtcggtgctcaagagccagaaggtagccctattccctgtggagctgtttttcatttcattttacttagaagcacaaggatagtggtacaagttaatttcttttgttctcttgaaattcaccctcatcaatcttggatatatgtattacttaaaggagtatcattttatatttttgcttagggtcattgtactatttcttgtagctcattttttttgcaattattttcaactatttatctaatttgatgtttcatattttttcccctaacttttaaaaattaatgtgtatccttcattttccttggcatccctgaagataattggggaagcccttttgtttcacaaaacttgaatttcttactagtacagatgaagaaggcacaaattaagacacagtcttctgtgtcttaatttcgtcatcatgtccacaccctaagctgttgcgcttgcattttgttgcagactttcatagctgtctcccactgttgccttacttgaaatttgcatagttacaatgcaacagcttttaatgccttgattaaaacatatatgtattataaaaatcatcatttccttctttctcctttctccccagcaattcttcttccccaaatcatcagggagatggagcttcacagacctctggtgaagtaagtatctttctcctaaaactatctgatgctttcagggttctacattttaaagttttggtttttgtgcaaatgtatggagtaggtgagaagttttgttacatgtatggtaatgtgtggtaatcgagtcaggatattttgggtgtccatcacctgagtagagtacatttttttaggtatagtcatcctactctgctacgaaatactgaatttactccttctgttttattgtatgtttgtttgcaccctttaatccagttcttctcatcctctctcttatccctcacccattcttcccggtctctgttacctatttttccactctctcccttcatgtgttcaaatttttttagttcccacatataagtgagaatataagtctttctgtgcctggcttatttcacttaagacaatgaaatgttcatgttgtccatgttgctgcaaaaggtgatttcattagcagcggcatgatttttctctttttttatggctgaatagcatcccattgtgtatcatgtttaagtttctgacaagggcctgcatcatttgggttgctggagtcagactcatgctctttttgggtgttttttacttcagactccgaggctttctgtgttttgtttaaatgttctaagtctgaatggttccttttatttatgttcattttcattgttaatagcaaattcagccttcagctacgatccaggaaacacagcaatggctgctcaaaaacagattctcttcctacacaagactgttctctaatttttcaggtatgtgtatgtgtgtgtgtatctgtgcatgagaatgttttgtttttgtttctgtgcttttattaactttatatttttaaaattttgaaataactatggataggaagttgcaaagaaaaatgtacagagaagttctttatatctatcccccaataggaatatcttgtatttttattatatgctattgaagccaggcagttgacattggttcagtcagcagttttaccagacttacgtgacctcatttgtgtgtaggtgtatatagttttacatgatttttttcattttaactttattttgaaataatttttgttttacagtaagttacagagctagtacagtgatatttcggtgtactcttcactccgtttctcacataattatagtacaatagcaaaaccaggaaactgacattggcacaacgtatgttatggtatagatatttgtaaccaccaccacaattaagatgacaggattgtgccatcactacaaggatctccctcctgctaccccttcggagtcacacccacacccttcccccaccatccctagtccttggcaaccactttacattctgtctataattttgtcattttgagaatgttatataaatgcaatcatatagtatatagccttttgagattggctttttttcactagcataacggccacctaagttgttgtgtttatcagtagtttaatcctttttactgctaagtagtgtttcatagtctgagtgtactcaattacagtttttatatacttatgggtaagttttttttcttgcacagtaagctaagggaatgttaagaaggaattttaaaaggtatcaagcactgcttctccaggtagtgctataggaaacctgtttagagggacagtaatagataatgacaggtggggcagaggtagcatttcccaaatatatttggctctgggactcttttccaacatgaccacctagtaacatggcctggccaaacatcctgagaagtgctggatcacagtaaagtggtagttagcattccttcacctgcagtgcagtagggccattaaaacacaactttgtgaatccctttaagaggacagaacttgtgtgtgcacacactcagcctgaagaaaagcttgattttgctaagaacatggtttcttactatgccacgtattgtaatgtttgtgcaatgagtagttattccccgtgtacttctttgtctctttaaagttccctatggaggtcatttgctagctggggactacatttttatatgattaagtaaagccttttatgtgtgaaaaactagaaattgtaaaatttcagggtcggggagctggggtttgtcttgcactgttgtatggaaggcagatgaaaagcatagcacatagaaaaagcgccgacatttggaactgaaggaggccccacattactccttttacatcaggcaaatccatgtttctatctggtgagttttaatccctttcgctgtgagcagtgatcacatggcgtggccttctgccttttccttatcctgggggcttcttccaagaaagtgggcgaggagctagccatggtaccctttgggcacatctcctgagtcacagcactgacagtagcatggtgaggaggacagtgagtcttcttgctctgatccttgggggcattcacatttcaggaagggttgtacattgcagttatctgtccagttctctgtatgggttaagggtgtgcacacacatacacagtactctctggtcacaactgtgaggtgcatgtagtaagccctagtagagagatgaaagagagcctctttgcttacctgactctataaaatgactctattaatgctcatgtctcatgggagatgtgcttctctgatctttgttttacagactagaaatttagtaggctattgcatttgagcctttaaaaaatagaaagatgactccattatcttctacatatgtaagtggctatttatcatatggaagtcaagccttcatcccaaagttcatcttaattcccccaataaactgtatcctgggtgttagagaataaaacaaaagattatggatacattcagacattaaaaagtagagagaatatgatgaactcccatgcagccatctcctaccttcaaaaactaccagcatttggtcagtcttgctctccactatttcctctcctgccttctgttgtatttcaaagcaaatcctagatgccatatcatttatgcttgaaatactgaatagtagttcatggtgtgtatgtactcaggtatggcttttttatacttatatgtaagtttttttttcttgtatggtaagcgaagggagtgttcagatagaatttttaaaagtgtcaaacactgcttctctaggtggtgctataggaaacctgtatagagagacatttacacttgtaaatgacatcgtaagtaggatgtgcttgggggaaatcttagggtataatgtgtgattctctgccattcttctgttaaaattagctgctgtgacagagttgtttatgttataaaatttaacatgtttgactttacattgcacgtttcagaataaagaggcccagtcctagttcggctaccaactcttacagactttaggcaagtcccacaaactctggacttccatttccttttttttaaaattaaagattgactggcccgggtgatctcagggtttgtttctgtggggtgggttagaatcatgtttcttcacatagccacaacccagtcactaaataaggtagatgagtgaaatcctatatcgggaagagttctttaggccctgctctcattgatttgattcatcagcctcaggacttctaagctccttcttgatacaggacatggaaaagccagcattttccttggctctgaaggacaggtgtctgtttgtcttcttatattgttcatgtgtatgtgtgtattcaggatatctgattattttgaaggacattggactgcatgaagacagatgcctgtaaagcagttctgttctttttccatttatttgagaaaaatatttttgctcttctctaggtgccgacttattaaaactgacaaaggaggatttagttcaaatttgtggtgcagccgatggaattcggctctataattcactgaagtcaaggtaaaatactgtgaactgttttgcttgaaataagaatgtacctttcttcgcgtggggaatttgggcagaatgtgtttccacgctaggttggcgtgtgtgcctgtgtgcgccatcgagcattggcagcattgtgctcacaagaagactgttttgtgtacaccttcagggcaggcccagatatgatgcaggcactgatgagggcagaggtagactgtaagactggtagaaatgcacatgggcagtactgatttcttgaagacgactgggtttgttgccaagaaaacaaaacttctaatttaggtgagctatacagaatctatggttttcaaggtcatgactattactaaacagttattaaaaatgtaaactaattgtgaattaaaatgacagaaactgtaaattgtgctggcttgtaagaaccatttactatcattgctctttctatacttgtggtgtgagaattccattaaaattgaatcttactgatttttaatttgctgacttaatcttgaaacttaaatttaccagcatctgacagaccatctcaatggtttagagtctggatcatcatattagaccacctgtgatagttggtgtgaggtgtgtggtttttatatttttattagtaaattactttgtataacgaaataacattataaagttctcataaggaaatagaacttagattcctgtagttgtcatatttgtacatgtgtaaggcagctttctctcccaggctcatcagtggcatcttctgattgcaggtcggttagaccccgtttaaccatctatgtctgccgggagcagccaagcagcacagtgctgcaagggcagcagcaagctgcaagcagtgcaagcgagaatggcagtggggcaccctatggtaggtattgagggcatctcaattctgtcacttctgagactgtcagacagaaacggaaaggactcgattgagcaggctttggagaactcttgctgtgttaggaatgccaagttgctcatgtgggagccttgacagcaatgagaggtggcagctctagggtgaagtccttgggagaagaggaaactggcattctttctcagtcattgcagccacactatgggtctgtttttcatgtggcccttcatgccggaaatatctaacaagtggaaaaactagcttgaatgcattgagttctggcttttttttttttttggtcagatttactgaaatgatgaatataacactggcagcttaacaaaaaagcaggagggtttttctttcctttttctttttttttttttttttttttttcaattttcctgactaggtatggggagaactcttaaagcataacatatgtgcaacagtgcctgcatgtaatagtcctaagtgtgtggacttgtcactgacaagtgttcggccagcattgtgcaccttgtgtggcgcgtctggtgccgtgtttttatgtcactgtaaataatactacccagtacgttatcttgggagggcttctcatcctgagcatttaattgtacggtatagtgctggattaggacagagataatcttggcttctccctcttctcacctctaaatatggcccttaaaaaaagcaagcattttaaaaggcatatattttctcatttattgtatggatatatggtaacatttccttctttccatactctgaagtagaacaaaggcaacatgctcagaactttaaaaaaaaaaagatgtgttaatggcattcagagatgcagttatttgccctaagaataggtagagctctgaaaaatgtcttgtggtttgaattttactgaaaaattggaaggatagcatcactactgtgaacttttctatttggtattattttgacttcaaaagctctgaattttgagattaagtatacaaattcttaaaggataaaaatttaaaggagatctccatgtatcatcaagagcttatacatcacttagatatggccaagattataatattttggaaggtgtattctcaaacatgagtgtttgtggagggatatggggaaatattggatattttcccataatcagcaaactttttctgtaaaaggtcaggtagtaaatatttccatctctttagatcatacatagggtctctcacattcaactctgtgattgtagtgctaaaatagccatagacaatatgtaaattgtagataaggctgttccagtaaaactttatttaaaaaaaaaaaaaaaaaaaacaagtggagggcaggaattggcccatatgggctgtggtttggtgacacctgctctagatcatttctatattcttactgtaattttagttccagcttcttttatgtaatggaaaattctgggtttctatactcacagaccccttgtttggggaagcaaagttctcagtaatgatattcctgatccatgtctggctttaatcagtaattgagcaggacgtacaagagtgagactcactacagatgtgcactgtgcagatgtctgctgataagttctgtgtagcaaaaatgcagaacactggaatgtggctggggctttctgtaaggaagcatcacacttcattgtttatattagcttttcatatagtatcttttatttaaaattttttgtgggggaggggcatatacagatagcttttattccttaggataaattcctagtagtaggattactggatcaaaaactataatgcttaactgggcgtgctggctcacgcctgtaatcccagcactttgggaggcctaactgggcagactgcgtgagcccaggagtttgagacagcttgggcaacatggtgaaaccctgtctctacaaataataataataataataataataataataataaaaattagccaggcatggtggcgtgtgcccccaccatagtcccagctacttaggaggctgaggtgggaggattgcttgagcctgggaggcagaggctacagtgagctgtgattgtgtcactgcactccagcctgggcaacaaaaaaggacactgtcttaaaaaaataaacaaaaagaactatgactcttttagggttctttttgtatattgctagaaatacatgaagtatatattatttttaaaaacagctttcttcaggcataatttacataccataaagtcctcccattgtaagtatataatggtattttagccaatttagagagtttggcagccattgtcaaaattcagtttgagttccattatttcaagaagatcccccatgtccatttgcagccaattcctgtttttaaattttgaatacatgaaactatattcattgaataaaaatatgaagaaaaattcaaacctcaaatctttttgtccagggatttctgttaatgtttattaaattatatttgtggatataaataatgtattcttacgttttagattggtagttcaagatttcaaggtagtaagatgggggaaagaaatagtttattcccatttaaaatgtttttttacttttttggtactttgaaaggtgtgaccttcgtacagatcctacagatcaggcagaaaacagatcaaagattactgttaaaatgcttttctttttttttttttaatttcagtttatcatgcaatctacttggaagaaatgattgcctcagaagttgctcgaaaacttgcgctggtgtttaatatccctctccaccaaattaatcaggtttacagacagggtcccaccggtattcacattcttgttagtgatcaggtaaatcaaatcatttgtttttccttttcagactggtatttacttttatacatgtaattgtagaactgtagaaaaattctgtgacctcttttgaaaatacttatgagaatcattttcagagagttgggaatcactttggaagaacttataaccaagagtttcaggcatcctagtgataatatggaatacaagccaaggaaaactggcttagcctccccccagccctttaggatgcagccaatcactggggcactctagggatagtggcaggctttggccctttttatgaggtgagtcactggatgtgttttccttttgtctattatttgatgactaatttaaaaaaacatgtaagatatataatttttcccctagtgattggtggcaagtaataatagaagagcactttatgcaatttttgttcgagtcatcatccactggagccggcagggaatgtgcccctgtgggtcacatgggtgactgaccaggtctctcagggaccattatggacaggcatagtgaacacaaggcagtgcagcacgtgtgcatctttgctgcctcacactgccttcatgaattatcgttttggccattgagtcctgtgtttgtttgagaagaatatttactgttttaaaatcattttaagaaacgacagttggatcttaattgtacttacgcatttactttatccttccagatggttcagaattttcaagatgagagttgttttttattctccacagtaaaaggtactttgcatgtgtgtgtgtcttaaaatgctggaatcatgagagatggtgtgtgcctctaattagtgcctctcgtgtttattctttaaaatgattgctttactcattttaagaagaaagtttgataaatgagaatatttctagtggttgtaacagaaattagcatataaggaagaggagtcagtctttctagatgactggaaaaaaaaatctcaattcattcagccaacgtcttactgagcactttgtgtcagacaccgtgcttctgtcgctcagtggatctattgaataaaacagaatccatgaaactcctattggggaaagcaaaccaaaattggccaagagatacacaaaattcccaatatgttaagttccatgaaggaacaggaaagtgtgggggtacttatggataagggagatctgggttgaggggaatatgaaactgtaaggcaaggcttctctgaggaggtgttattaatcctgagacttgaagaatgagaagaagcgggagctggccattggattagcatccccaggcaacgtggggctgtgtgcaaagaaaacacctggcttcttggaaagcctggcagtgggccatgtaggtgccatgcagtgtgtgagggtgagcggatcagggcaaatcaaagcaggaggccgggtctggcatgcggggaccggatgatgatggtagttcggatttacttgaaatgcattgggttgtcactgaagttgtttaaacaaaggagtagtaatgtgactagatttttctttcactttcacaactctgtggagacagatgagaaggtggcaaaacgaggcaggagatatccaggtgaaaggtgatggtatcttacacgtttatagacagggtcccagtgggctccacttttgagggaggaatagttctgacaccttattttctgtggaaagtaactgggcagatggtgatctcattgaagaggtaagtatggttggggtaaatcaaccaagagtttgattttggatatgtagaaatgtcaagtaggcagttgactattaccagtctggggctcagagaagaggcctgggcttgagatgtaaatttggaaaccttcagcatatcagcagtgactcaaagctgtagaagttgttaaggtcatttagggagagaatatgaaaagagccaggaccaggcttaggtggctccaacattaaagaggagggattcctaaatgtaaaattatttgagaagagatcatacattcatagactgttttaaaagtcaggtgagctaagatccaaatccggtcttagcacaaaagctgcccctagaagagggagatgtcatgtgtgtcaggtgtccccagactactgaaatactgattttattttgcgcctcacatgttgcgtatgccatcaggttacctgcaaggctgagttttaactctgaactggttcactctttcagaaacatctttagcctagtacccttctgctcagtcttttgttttcacagcagtacagtttttaccttgcataactgacattgtctgaaaaagaagacatatactataattgcatagttttgttttgtgaaaccagcagacattttttggtattagaaatcataggatctcccctctaatctcaatttactgttttgtttttttttttaaactttgtcgtcatgagaaaaatcatttttttatgaatgcctatattgcttctcactatttactgagaaacactaggcaaaaggaatgatacagttttaaaatgtttgaaatctctgtgagtagctcagaaatttttctggaaaaggtagatgtacacatttgcatttactccctcaggtcctctgccctgacacagtatatttcacctgttctccttctagctcttgctccccttatggacagcactattattgtgtgtcttgatagatgtccccctacccccagaactggcagacagtgttggaatgcgggcgttgatagtgggccaggcttcgcagaatgtctaaaaagggaatgtgtacatgaagttttttgggggaagaggagctagagcaagttaatctgcttgtttctctagaatcatttaaaggtaacctctgaattgggaagggaggttgtagttggcagggagttttccatttaataggcttaatttcctaagcctgactgaagaaatactgtctttcctttttctgcagctgaaagtagtgatggcatccacataattttgaagtgatgtcttatatagactgaactgtattcagtaccaaatagtcacgcttaaaagtgtgtgaagactgaatccaagaagtcttgggattggattttaccatatgaaatgtttcatattgaaaacacaagatgacctttctaatgagctgtatgagaggtgaatctcctcactgtcactgccatagccaagcatcctcatgagagtgagcacatcggcacagcatgcatccagctctggaggccacggtgcaggcatagctgcctgctgctctggcagaggccagtaaatacagttcctagaagcagcctttgctgtctttttacactgtatgcggtttggaaatgaatgtagaaacttactgtgggcatttacctttctgtgccagtttggcttttattgcctgaaccttatgctgacctggagaggagatgggggacagtgctgttgtggggccagcagtgaatctgtatgcggagagttgtgttgtgctgatgtggccgttggtggtcaggtaagaggctcggcaccttcttggaagaaatcatgtctgagggtgtacgtttgatatgatcatgccagattggagaagatccaagccaggaagatgggcttgaagcaaactgcattatcaggagtaccttggtgagaggatcagtgtaaatcctaataggtacaaagacttttgtgttttggctttgtcacagatttattgaaaaacttttttgcttctgcttccatttttagcattttagtttctggttttcatttttggagattccttgccttttaaactcgtggtttttctctcattttcttccctctctccctccatctctgaccacccccaccctaaccccccacccccaccatcctattaaacatttttaaagccctaccccagacattggaaataggtgacccaagtagggggagaaagtattattgttgatagcttctgactaggtgttaagggatcttcattatgaacaagatgaatttttttctggaaacactagatgttatcaatcaaacactaaaatgtaccatacaaatcccttaagcctctcaaatattgagctttagtacaatcatggatagacattctggtgatgatttaggggctttttatacaccacatactagcttctttctctataagagtgcctctttcataaaaccaaatgcttgtctgctagcatacttttcaaagggaatccactgttttctcactttcctcccatatctccgtccttcatccaaaaccttcccagaatccatcagcaagcatgtttgaggcctgtggtgtaggggactgaattttttttttaacttctattccattttaattgtaggatatctttgtccatatacccaggtgtcctgatttgaatgtactatttgatcctcattgtgttcaggcaaaaaataggaaatgagtaattttgagtttgaaatctctcccagaagacaaactacttcagtgagtaaaagctttgacattttatgttttattcataaagggggttaattatttgctacaaagaagcacgatctattttcatcatcgatttgaaaatatctgtaactcctatagatcctataggcagagagttttcctttctgactttttccctttgctttcgtgtgaccacatgttttctgtaccagtcactggggaaagaagtgagtttatctcgtttgttttaaaagttttgcttgtctatttagcattcctttttgggtctcaagatttatggaacaataaatgtcatttaatgctgtgtgcttattttgaattcctcatcaggttttagaagcggggtaaaaatacttagatgcttatcagacttgaaattatactgagtggcattgaacgtgagtttgtcccagtgaaacaggctaaataaattttggcaccagcaaatttgttactttgtttttttaatagtaggatgtacacatttcagtataataaatgttttctgattgttttgc

SEQ ID NO: 38283 - DNA, 7769 bp, Homo sapiens
ctctcgggcgccgggcggggccatcccggggctgtccgcggagacgcctatgcggtggaggctccgggcttcagctagggcgggggagcccagcagaaggaccgagcagcctggcaccccactttgccatcctctccctggaaatctcggggtcggcgggccggccgcttcgcgtgggcgaaatcagagacacgtggtttccaaggccccttcgggttcgggaaaattttatggttcgggtcacagtaggaagcggacaatgaggcgggagggcagagagaaccgcaacacctggtgccgggtcgggtcgtttccggggctttcagtggccggaagtcgcggcgcctgtactgactctaggaagggctggagttgttttgaatgggcgcccgtaagagaggtgggcaagtacgtgttacagacggccacgccgccctttaggcggtcaaggtggggcgaggagacgttcgcccccctgcagtcggccgggtcactacccaagagcctttggaggcggaagcatggaacggtctgcaaacgttcccgagcgggcctctgcggctctggcgggcgtttcgaacttgggcgccgggcacacgcccagtcccgagagcgctgagggttcccttagcgtcgccctcaccccggccaacccgcggggcgccagagtcctggccctttaaacgccgcgcgtgcctcggcgtcttcgtttcgcgcgcccgcccgcggcgccggcggagcgaacatggacccggctgcgcgggtggtgcgggcgctgtggcctggtgggtgcgccttggcctggaggctgggaggccgcccccagccgctgctacccacgcagagccgggctggcttcgcgggggcggcgggcggcccgagccccgtggctgcagctcgtaaggggagcccgcggctgctgggagctgcggcgctggccctggggggagccctggggctgtaccacacggcgcggtggcacctgcgcgcccaggacctccacgcagagcgctcagccgcgcaggtaaggcctggcccggccggggatggggatgctgatcagcgccgaactcgggactcctgggaacccgcagggtcaggagttgcctctgcctgcttgtgaccttgggcgagtgacttggtctgaagtctccgaaccctctgtattcttttgtgtaaaataggggcactcctgatgcctactacctggaattgttcgagttctcataaaatcgttcttctaccgtggttttttttttttttttttttttggtttgtttatttatgttttcgagacagggtctcgcattatcgcccaggctggagtgcgatcgcggctcactgcagcctctgcctcccaggttgaagggatcctcctgcctcagcctcccgagtagctgggactataggctcaccccactgcgccctgctaatttttgtattttttgtagagatagggtttcaccatgtcgcccaggctggtctcgaactcctggcctcaagtgatccgcccaccttggcctctgaaagtgctgggatcacaggcgtgagccactgcgcccagcctttaccatgttttaaggagactttttttttttgagacggagtttttttttgctctgttgcccaggctggagtgcagtggcgcgatctcggttcactgcaacctccgcctcctgggttcaagcaattctcctgcctcagcctccccagtagctgggattacaggcgcctgccacccagcccggctaatttttgtatttttactagagacgggggtctcaccatgttggccaagctggtctcgaactcctgacctcaaatgagccacccgcctcggcctcccaaagtgctgggattacaggtgtgagccacggagcccagcctctaccgtgttttaagacttttttgattaagagatgggagatcacaggaaagggaaagcctttttcactttccaaacgttcatcatcctctctccccactgcccccaaatcctaaggctgtgtatttatttagtagtagtggtggtacctttatggaactgatgacttagactccaggctgaaacaggaagaggtagaaaggtgccccccccaagtggtgaccccctaagtggtggcccagctgccttgagacactttatacctaccccacaccttgcaactcttcattacttgacttcccaccacccgcccacagatgcttatttgctggaccagagggaacagaggtgggtaaaaagggcatggagtactctgtgtctcccttcctgcctccacggtccagcttcccctctgaacacagggggatggtctacagttgtggcttcccggcatgaacgtgcagcaggctcccctgggggctttcctgcggagcttgccacacgcaggccttggctcagataccaccctccccctcggatatttgagatagactttggctggaggatcacatgaaccccggagttcaaggctgcagtgagctgtgatcaagctactgcactccagcttggatggcagagtgagaccctgtctccagagaaaaaaacaagaaagagattggaggtagaccccactggtgaacatgagcctgggtggtagcccagctctgcccccagaggtccctggggttagaggagtgagagtgaacaagtcaagttgaaacagttgttccatgtctgtgggagtggggtgtataccctggggctgtctggtgtccccttgggactggagtgagaaaagaggggtctgtccagtatgggacagagactagaagattcctcctacacaacctcgcagcaaagggtgggactcctgcttggggaccgtgctggccaggggcttaaacctgggctgctgtccagtgcctccctttcccctaccgcccccttccatctctagttcctcttcccgatgttctagcgtcatttcagaagactcctctggaaaacacccttgggggcagggcctgggcctgggggtgccaggtctagaagccttttccgtctgctgcccgcagctctccctgtccagccgcctgcagctgaccctgtaccagtacaagacgtgtcccttctgcagcaaggtccgagccttcctcgacttccatgccctgccctaccaggtggtggaggtgaaccctgtgcgcagggctgagatcaagttctcctcctacagaaaggtgcccatcctggtggcccaggaaggagaaagctcggtgagccccagggaaccccctgcatccttcctcctttcctgggttgtcctggagcgccccctagcctggcctggctctgcagcctgggaaggaacttgtgatccttgtgcctgtaaggactatgggggaagtagctgcatacggtagatgctcaataaatgtaggctctctccttccgtaccaaaaccaaacacctgctgggtctcagggaggcagaacaccacagcttaacaacatagattctgaaatcagcgatctgggtttgaggtgtgattcacccactcactagctgtgtgacttggggcaagtcacttagcctctctgcgcttgcttgcttcatgagtcaacaagggaccatattctggcttgcagggacggcagatatgaaatgcctggcacagtgcttggggtctagtatgtagcttccagaacccaccctgcccctctacctgggaggccaaatgggtgagtgggctggggcttagaccccacggctttcccacaccttcctccccattggccacaaccacgtctccctacttaggatgggtgccctgagggcagggcggggaggactccgggcatgtccccaggaatggataaacaatgcccagagtgtcttgttaaagagcccctggtgactcccagcggctgggttgcaacctctgattaaaccacccttttctcttccagcaacaactaaatgactcctctgtcatcatcagcgccctcaagacctacctggtgtcggggtaaggagcccctcggagaccaggtggccattgcttttggtggcttcctccagggaggcctcccctgagttccctcctgggagcacgtggagctgctgcttagatttccagagtacagagtggctcgcacctgtaatcccagcactttgggaggccgaggcaggcagatcacctgaggtcaggagttccagaccagcctggccaacatggcgaagctccatctctactaaaaatacaaaaattagccaggcatagtggcgagtgcctgtagtcccagctactcaggaggctgaggcaggagaatcgcttgaacccgggaggcagagggttgcggtgagccaagatcgtgccactgcactccagcctgggtgacagagcgagactccgtctcaaaaaaaaaaaaaaatgattttccagagtagcccgtggccgtcctcctccaagccccctactttgtcctccccacacctccctctcttggggaggtagccctggcatctactccaaatccctcttactgcaagagtccggagagcctttgttggtcctggctccactctgaggctggggcagcggggttggtcggccacaggggacggagggggaaggagttggggtgatattgtggctctctccgaaggcagcccctggaagagatcatcacctactacccagccatgaaggctgtgaacgagcagggcaaggaggtgaccgagttcggcaataagtactggctcatgctcaacgagaaggaggcccagcaagtgtatggtgggaaggaggccaggacgtgagtggggctggggctggcgggggaaggtggtgaccgcaggggtcttctgtagagtaggaccaagctgagcaagatggcgtgagcagggagcagcatgggagaccagcggggctggggccgggccatgccggatttcagtagagaccttcctgcagccgggcgtggtggctcactcctgtaatcccagcctgttgggaggccgaggcaggcagatcacctgaggtcaggagttcaagaccagcctggccaacatggcaaaaccccatctctataaaaatgcaaaaattagctaggtgtggaggcacacacctataatcccagctactaaggaggctgaagcaggagaatcgcttgaacccaggaggcggaggatgcagtgagctgagatggtgccattgcactccagcctgggtgacagagcgagactttgtctcaaaaaaaaaaaaaagaccttcctgctcaggcttcagcttcccgcccgtgcagtgggtatgttctagagaatgcagcctgctcccaacacagcccgggtcctggcttaggaagtccctcccgtgcccgcagggaggagatgaagtggcggcagtgggcggacgactggctggtgcacctgatctcccccaatgtgtaccgcacgcccaccgaggctctggcgtcctttgactacattgtccgcgagggcaagttcggagccgtggagggtgccgtggccaagtacatgggtgcagcggccatgtacctcatcagcaagcgactcaagagcaggcaagtgtgtgtgcacatccggggcctgctgtccccgagcctccggtgccacgagcagtggtgatcccatcacacccctcaggagaccagcgggaggccgaggcctagggcaggtgggaaacgcattatggattatgggtcccttggccaagatgggacttggacccagagctcctgctcacctcccctggggacagcagggctggccttgaagccggaagcctgggccctgactggcgcctcctctgtggctttctccctggcctggtctcttgcctttaccacagcctccccgtctgggacggatgctccctgaggcgtctgcagatgtgatgctctcacctggggtgccgtcctggcttccacacctcccccctctccccagaggagaccctcttccctgctgggctgggagtgggggctcccctgaggggcttttcccttccccgcccaggcaccgcctccaggacaacgtgcgcgaggacctctatgaggctgctgacaagtgggtggctgctgtgggcaaggaccggcccttcatggggggccagaagccgaatctcgctgatttggtgagtgtggtggtggcaggtggtgcctggaccgagggttctgtcctcagagtgggggaggtttgcaagggaaagcctggacggtgcttgcatcttgccagaggaacctgcctctctctgccatcacggacagaaactcgcctcgaagtggctccaggagagaaacagatgaccaggaaccgccttggttcacataactgacaagttcagggaacgggttggcttcgggccctgctggatccagaggcccgggtggtgttaccagagcccaagctctacctgtcgccatcaacactgccctccctggagttggcttcagcctcaggcgggctgggtccggtgctccaggcttctcccagaaaacccctgggagggcgtctcactggcctggcttcactgccctttttccttttgtttttttttgttgttgttgtttttgttttttttttgagaccaagtctcacgctgtcacccaggcgggagtgcagcggtgcagtcttggctcgctgcaacctccgcctcccaggttcaagcaattcttctgcctcagcctcctgagtagctgggattacaggcctgtgccaccatgcccggctaatttttgaatttttagtagagacagagtttcagtatgttggtcaggctggtctcgaactcctgaccgcaggtgatccatccactttggcctcccaaagtgctgggactacaggcgtgagccagcgtgcctggcccactgctcatttttaaaactgtcctgcccctgggtgacctgggtcttgaaactgggtggtggggtctcttctcccccatctcaggacctgagatgaggggagggcatttatcccaaggaaacttgctggggggcagggtctgtggcccagaaaagggggtacagatgtgaagcaggcgagacctgcagccaccccacatgctttgttcaaaccctcacctgtgctgttggcccttgagtgggtcacgagctccaaggggggaggggacgggacctggccacacagctggcagggaacgaaggaggtctggatgcctgtcaaaccagctatggtgacacgtttctgttcgtgccccaggcggtgtatggcgtgctgcgtgtgatggaggggctggatgcgttcgatgacctgatgcagcacacgcacatccagccctggtacctgcgggtggagagggccatcaccgaggcctccccagcgcactgaatgtccccgcgcagagcagagggaaggcagcggaagacgccagctgccagggcctggggccactgggccagcgcctggcgatactggttgggggcaggatcattctgccccttgtccacgcacccccaccagccctctcgcttctaacacagggcacctgctggggctcagggatgttagggacgagttccagccctgccactgccctggggcgacccctccctgtccctgcctccctgctctgccgcccctcttcctggaccctcagtggctgtcccatggctacatcctgtgggtgggggccctcgacaggacagcaggacggtttgttttcagtggaatcccatccctgggttcccctggttcccactcttcccaagcctcccgggactgggacatgtttgcaataaaggaaaggtttgtggcgcctgtcatggcaggcatctcatgg

SEQ ID NO: 38284 - DNA, 6733 bp, Homo sapiens
gcgcgcctcgccggcgcctccatcccggatccttgctgcagcgtcagcgccgccgcccgtgcctttcctcttcctcctcctcctccttggcatccgcctcttcttcctcctgcgtcctcccccgctgcctccgctgctcccgacgcggagcccggagcccgcgccgagcccctggcctcgcggtgccatgctgccccggcggcggcgctgaaggatggcgacgccgctgcctccgccctccccgcggcacctgcggctgctgcggctgctgctctccggcctcgtcctcggcgccgccctgcgtggagccgccgccggccacccgggtgagcgagcgcgctgggcgcaggccgcggggcgccccggggccgggatcgccgggcggggaccgggttgccgggcgccgccgccctcgtcctgcccaggcccgcaggccctgcaggcctggtccgctggtggcgggggccccgcctcgcccacgatggaataaacaggcctggccggagggcgcagcgcggagcctccaaaaggccgcgccggatggggcttctgccggttcccagaggcgtaccttacattcatggcttcttccgccgggagcgcgtctggctcaggcctccgcgccgcggccatctggctctgggcgggcccgccgggagtctgcctgtgtgcgtctctgtgtctccgtgttcggggctcctgcgggtgtggggctggccctgagtgcccgccggcttcgctgccggtgcgcgtcccggggtcggggcctcagtgctgctctgcctgtcctcacgccttgggtggcgctgggcaccggccttgtgcgccatggtgggcgctgaagttctgggggcacttatggcgcaggctcggggtgctgttctagcttcaataggagggagactgttgcagcctcagagcctccgcctgcatcccctgccctcgagggcactggcattctgtctttgggactgagggctgcaggtggactccggaggagggtgataagcccagggtcctgggacaccctctcacctgcacagatgggtcctgagggtccagagagcagagctccctgcaggaacccaggatgcaaagctgacgtttttctggggggactgaactgggagactttgcgactgcattcgtacagtactcctggcagccctgcagaagaggtgctgtgagcccgttttacaggcaaggaatccgaggcatggagaagttaagtggattgtggcacagctgaggcgctgtcctgggcagcctggttctgtgtgtgtggcctcaaggggccagagtgaggccggcttcctcctgggctcagtgcccctggatgggaggtgggcatgaacaggagaggcttccgagaatcagagtgtgctcagccaggaaaggcggaggccacctattcaggaaacggggctgcagctgctgtgctgagcccgggtgggtggcaggtgccagtcctcagttcaccggcctctgcagcttcgtgtctgcctcaccgggagacctggcagggccctccctaggcaactcctcccattcccagtgcccagtgcttggaagggagggccctcaggcagcccagacgttggcgggtggaggggggtgtgccagccaccgtccagctgctcttgttcctgcgacctcttttcaggaggaggaagtgggggatggaggctcctgggctggggaaaagggctaggaggggcctggaacccagaccctagagccagctttgtacctcaggcccctgcctttggcgtggtggacggtggggtatcagcacaggagcggggactgcctcactccccaggtgccaagttggcgggtgggcccaggtggacctgctggcacaggtttaatgtttaacgtgcccaagtcccggcccactgatactggaggctgctgccccaggttgtggagggtgtgcggtgcctggcgttggctcctgtgcccacctgccactgcggctgctggaactgccttgaaggaaggcggacagcctgagggccctgagtgtcaggttaccaaggaaaccaaaccagccaaccaaggtctggagaaggatgatgccccgtgtggcccccgtggccctgcctgcagtgtgcagtgtggggctgggcagagaggaagagtcctggttagccagaggtgccaccgcagactccccaggcagggttgatggccctgctggggttcccctggctccactggcttgctgtgactggggacattccttagctttgaggcaactcagctatatcccagaggggaaactgaggcagagggccattgccccctcgccccgttctccagcaccaggataagactgattagccacatgtgtcagctggcaccgtggcctgggcccctcatcagcgagatgaaagtgtggttaggaactagggaactagggcctggcctgccatccccagcactgccaacctcggcctcctgaggccctcgggtgccacctggcccctgactgcagcccctggtgtggtggctttgggagtgacctgcctgggttctgtgtctgaggccagtgaggtcagcagactccatcttaggtgtcctcggtgcctgggggacaagccagaggctggaggagcagcatcccttccaggctgcacacttgtcagtgccgggttctggggagagccgcacgggaaggagaggtcgctggcggcatcgtttgctgctccccagagacagacctgggcccttccctctgggactcccaatctggacggggttcctggcttgctgtggggcatgttgaggccggaggctgggcttgtggggctgcacggccctgcccaggagaactcagcactgcctggacggcgagactcagcttctgagctgagggctctatcaggcctggaagtggaccctggggaggggtggggcagggtagttctgataagtcctaggactgttcgcttccgggttctgagccctggcgtcagggaggaagggcatgtccagaacaatggccagaaccaggcccggccagctcggggggtgacgggggcgggtggctggggcagcgctgccgtgtgcaggggccgagccctgcggggccgtgagccggccctgccttctgcttccttcccagatgtagccgcctgtcccgggagcctggactgtgccctgaagaggcgggcaaggtgtcctcctggtgcacatgcctgtgggccctgccttcagcccttccaggaggaccagcaagggctctgtgtgcccaggatgcgccggcctccaggtacgagagcaaagggggaagtcgatggggggatgtccctgcatgaacctctccctgtaagaagcggccggctgggcgcggtggctcatgcctgtaatcccagcactgtgggaggcccaggctgttggatctcatgaggtcaggagttcaagaccagcctggccaacatggtgaaaccccgtctctactaaaaatacaaagtagccgggtgtggtggcacacacctgtagtcccagctactcaggaggctgaggcaggagaattgctttaacccgggaggcggagcttgcagtgagccgattcaccactgcactccagcctgggcgacagtgcgagactctgtctcaaaaaaaaaaaaaaaaaaaaagaaggccgggagcagtggctcacgcctgtaatcccagcactttgggaggccgaggcgggcacatcataaggtcaggagatcgagaccatcctggctaacacggtgaaaccccatctgtactaaaaatacaaaaacaaaattagccgggcgtggcggcgggcgcctgtagtcccagctactcgggaagctaaggcaggagaatggcgtgaacccgggaggcagagcttgcagtgagccgagatcgcgccactgcactccagcctgggcggcagagcgagactccgcctcaaaaaaaaaaaagcagcagcctgcagcctcaatgcccaggcctgtgccaggtggtcttggggcccctggaccttgtggggtgttgggtccaaggcctgggagatcctcattcactctccacgaagcctcccatcctttccaaatggaggtgggcccaggcctggggcagtcaggccctcccaggagaagggctgcacgatgtgaaatgctgggatggccacgggagaggaagggcccattctccccgggcctgggctctgcagggtctgcccagaagccctccaggcccccacttccccgtccccaggcagcttgctcttttccaccactcactgtcctgtccgcctgttggcaaatgttgaagggtgccagcactggctgggtgctggggatgccccgctcgccagcctgagccgcatctgtcgggatggccagtcactgagtgacttcaggtgtggtgagggctttgctcagaggtgctgggggtgggagcagcagcggcttcctggaggaggtgttgagaggagcaccgagaagtggctgtaagggtctgtgtggatgcacctcctgccaacctgggagcgtccacccagactgtgcagcccacagtgggtaccggtggagccctgccaccagccccacccctgacagctgcccccgttctcccaatgacctggggaggggtcccgggtgcttggcttccttcggcttccccccactccttggggagtccctgcccctctacccgagaaggtgcttggaggtggggaagcagaaggggctgtgctggccagccctttatggacatgggttggggcgagagaccccactccttcctccccgtgcccggtctttggacgtttccctagcgcctcctcccttgccctgcctccactttccgggaagcactgcccctcacaggaagcgcccgcgctgtcaccatggcaatctgggagggagagggcctccaggcgtgtacccagtcctcaggctcctgggaggaacctgccagaagcggggaggccgggcctggggctacctcctggacggacccctccacctgatggcccctcaccctccccaggcgggggccggccccagcccagactggaagatgagattgacttcctggcccaggagcttgcccggaaggagtctggacactcaactccgcccctacccaaggaccgacagcggctcccggagcctggtgagacccccgcttcccctgccccacggccctgtccctagcccagtgctctcattctaacctgtcctctctcgcagccaccctgggcttctcggcacgggggcaggggctggagctgggcctcccctccactccaggaacccccacgcccacgccccacacctccctgggctcccctgtgtcatccgacccggtgcacatgtcgcccctggagccccggggagggcaaggcgacggcctcgcccttggtaggtcttggtcgggggtgggcaggggcagcagggcgccctgcagaaggccgccctcacacgccccctcctgcagtgctgatcctggcgttctgtgtggccggtgcagccgccctctccgtagcctccctctgctggtgcaggtgagccagtggccgcgggcagggcagggagggtgccacacgctcagaggtctcaggccccactccccacaggctgcagcgtgagatccgcctgactcagaaggccgactacgccactgcgaaggcccctggctcacctgcagctccccggatctcggtgtgtggcccccttcagccctgaggctcccgcccaactctggccgccaactgaccctcgcctcctccttcccacagcctggggaccagcggctggcacagagcgcggagatgtaccactaccagcaccaacggcaacagatgctgtgcctggagcggtgagtggccgccccggcactgccacccccacccacccaccccccatccccacctccacctccatttccacctcccctggccaactttaccccaggccctgccaccctcacctgcacgctaaccttcacctcccccgccgccctgcaccctcacctcccctggccaacttcaccctgggctgtgctcccctgccaccccagggctgaggtgggctgagtgcccacttccagactgggccactggcacctcgagggcatggggaggacccagcgatccccccccacccaggcataaagagccacccaaggagctggacacggcctcctcggatgaggagaatgaggacggagacttcacggtgtacgagtgcccgggcctggccccggtgagtgcctcagggtgcagggaggggcgaaccatctcctggggttccctcccagcaagtatccccccagcccacccactgcccagcctgacacccacattcgcagaccggggaaatggaggtgcgcaaccctctgttcgaccacgccgcactgtccgcgcccctgccggcccccagctcaccgcctgcactgccatgacctggaggcagacagacgcccacctgctccccgacctcgaggcccccggggaggggcagggcctggagcttcccactaaaaacatgttttgatgctgtgtgcttttggctgggcctcgggctccaggccctgggaccccttgccagggagacccccgaacctttgtgccaggacacctcctggtcccctgcacctctcctgttcggtttagacccccaaactggagggggcatggagaaccgtagagcgcaggaacgggtgggtaattctagagacaaaagccaattaaagtccatttcag
